United States Patent 8,344,211 (PLANT NUCLEOTIDE SEQUENCES AND CORRESPONDING POLYPEPTIDES) - sequence listing, part 15

SEQ ID NO: 57024 - DNA, 692 bp, Zea mays
  misc_feature: Ceres CLONE 1501812
  misc_feature: Encodes the peptide sequence at SEQ ID NO. 57025
  misc_feature (484)..(484): n is a, c, t, g, unknown, or other
  misc_feature (485)..(485): n is a, c, t, g, unknown, or other
  misc_feature (513)..(513): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (637)..(637): n is a, c, t, g, unknown, or other
atagctggagctccccgcggtggcggccgctctagaactagtggatcccccgggctgcaggaattcgcacgagaccattacctagaacatcctaatcgaaaaagggatagcacgccgaggaaggtcgacatgtcgtctccgccgccgccggtgaagctgatcggcttcttcggcagcccgtacgcgttccgcgcggaggcggcgctgtgcctgaaaggcgtgccgtacgagctgatcctggaggacctgttcggcagcaagagcgagctcctgctccaccacaaccccgtgcacaagaaggtgcccgtgctcctccacggcgacggccgggccatctccgagtccctcgtcatcgccgagtacgtcgacgaggccttcgacgggccgccgctgctccccgccgacccctacgcgcgcgccgcggcccgcttctgggccgacttcatcgagaccaggctcaccaagcccttttctcatgcgatcnntggtggaggagcgcgaagcgcgcctgcngttcgaggaagannngcaagagctcgtggccctgctggaagcgcaactcgaggaaagaaggtctccgcccgggacaagccggggtacctcgacgtgggcgcgtccgggctcgggccctggccanggtcttcgagagctcacgggggggcccggctcccgaggaccaccccccaccttgg

SEQ ID NO: 57025 - protein, 187 aa, Zea mays
  misc_feature: Ceres CLONE 1501812
  misc_feature (6)..(81): Pfam Name: GST_N Pfam Description: Glutathione S-transferase, N-terminal domain
  misc_feature: SWISSPROT Homolog: EC 2.5.1.18 Glutathione transferase
  misc_feature (119)..(119): Xaa is any aa, unknown, or other
  misc_feature (133)..(133): Xaa is any aa, unknown, or other
  misc_feature (170)..(170): Xaa is any aa, unknown, or other
MSSPPPPVKLIGFFGSPYAFRAEAALCLKGVPYELILEDLFGSKSELLLHHNPVHKKVPVLLHGDGRAISESLVIAEYVDEAFDGPPLLPADPYARAAARFWADFIETRLTKPFSHAIXGGGARSAPAVRGRXARARGPAGSATRGKKVSARDKPGYLDVGASGLGPWPXSSRAHGGARLPRTTPHL

SEQ ID NO: 57026 - DNA, 686 bp, Zea mays
  misc_feature: Ceres CLONE 1501842
  misc_feature: Encodes the peptide sequence at SEQ ID NO. 57027
  misc_feature (643)..(643): n is a, c, t, g, unknown, or other
aaagctggagctccccgcggtggcggccgctctagaactagtggatcccccgggctgcaggaattcgcacgagaccattacctagaacatcctaatcgaaaacacatcacatatccgttgtggcagcagccttcgtgcaggcatggcgagttcatcttgtgccctgctgggtctggcctgcttcgtgctcctggcagcggccgccggcgctacgcagtacaaggtcggcggcgacaatggctgggccgtgccggacgccaccgccgagtcgttcaacacctgggcggagaagaccagcttccagatcggcgacagcctcttgttcgtgtaccccaaggacaaggactcggtgctgctggtggagccggccgactacaacgcctgcaacacctcctcctacgacaagcagttcgacgacggcagcacgtccgtggcgctggaccgcgccggcgccttcttcttcatcagcggcgtcgaggccaactgccgcgccaacgagaagctcatcgtcatggtcgccggcgcgggcgcgccggcgccggccccggaccggcagggctccggctcttcctcctccccgtcgacgtccgcgccggtaccctccaagggtggcggcgccccggtgccgccgtcctcgcctaangcccccgccgccaagaactccacggccaagggcgcgcctccag

SEQ ID NO: 57027 - protein, 181 aa, Zea mays
  misc_feature: Ceres CLONE 1501842
  misc_feature (34)..(119): Pfam Name: Cu_bind_like Pfam Description: Plastocyanin-like domain
  misc_feature (167)..(167): Xaa is any aa, unknown, or other
MASSSCALLGLACFVLLAAAAGATQYKVGGDNGWAVPDATAESFNTWAEKTSFQIGDSLLFVYPKDKDSVLLVEPADYNACNTSSYDKQFDDGSTSVALDRAGAFFFISGVEANCRANEKLIVMVAGAGAPAPAPDRQGSGSSSSPSTSAPVPSKGGGAPVPPSSPXAPAAKNSTAKGAPP

SEQ ID NO: 57028 - DNA, 695 bp, Zea mays
  misc_feature: Ceres CLONE 1501847
  misc_feature: Encodes the peptide sequence at SEQ ID NO. 57029
  misc_feature (695)..(695): n is a, c, t, g, unknown, or other
aaagctggagctccccgcggtggcggccgctctagaactagtggatcccccgggctgcaggaattcgcacgagaccattacctagaacatcctaatcgaaaagacaactatcccaccctggccgtgtcggtcgtcgccgtcgaccgtcgttgaagcctttgtgtggccgcacggccacaccgatgctgcagaaggagcttccgcggtgcgcgtgcggcgaccggagcgccgcgccgccggccttctcgctgctgttccccaagcccatggggctgccggcggagcagtggtactgctaccacgaggagggcggcgcgtcgccgtacggcgcagccagcaccccgatcgactgcacgctgtcgctcggcacgccgtccacgcgccgggccgaatcagccgagcgtcggcgtcgccgccgccttgatggaggagccccgccaaggctctccgccccggcggtgcgccaactgcgacaccacgtcgacgccgctgtggcggaacggcccgcggggacccaagtcgctgtgcaacgcctgcgggatccggtacaagaaggaggagcgccggcgacgtacgagtgcggcgggtacgctcgaccgccgcgcgccgccgcagcagcagtggggatgctacggcccgggcgcggggaagtcggcggcgtcctacgggatgtacgatggcgacgatcgcgtctn

SEQ ID NO: 57029 - protein, 90 aa, Zea mays
  misc_feature: Ceres CLONE 1501847
  misc_feature (13)..(48): Pfam Name: GATA Pfam Description: GATA zinc finger
MEEPRQGSPPRRCANCDTTSTPLWRNGPRGPKSLCNACGIRYKKEERRRRTSAAGTLDRRAPPQQQWGCYGPGAGKSAASYGMYDGDDRV

SEQ ID NO: 57030 - DNA, 688 bp, Zea mays
  misc_feature: Ceres CLONE 1501855
  misc_feature: Encodes the peptide sequence at SEQ ID NO. 57031
ataagctggagctcaccgcggtggcggccgctctagaactagtggatcccccgggctgcaggaattcgcacgagaccattacctagaacatactaatcgaaatcccttccccaagaagccgagagcgagaggcgcaatgggcgaccgggcgtacgcgccggccgtgaagccggttcccgtgcgggccaccaacggcaccgcgaacggcggcggcgtggggcctccgcggcccgcgccgccgtccatggtgcccggcgggcgcgtgccccctccgccgatgtacaggcggaggcccgcgcagtcgcgtcctccggcgcggcgtgccgggcggagcgcccgcgggtggtgctgcgcgtgctgcctgtagctgacgctggtgatggtggagctggcattcctgggcgccatcgcggcaggcgtgttctacgtggtgtacctggcgcagtcgcccagcttcccggtgacatcggtgcggctggcggcgctgaacctgtcggactgagacgcgctcacctcccgcgtggagttcacggtgacggcgcggaacccctacgacaagatcgccttcgactacggcgacatggcggtgtccttcgactcgggcggctcggacgtgggcgacgccgtggtccctgggttcctccaccggtgggaaacactacggcatcaacgccgcctttgtccccga

SEQ ID NO: 57031 - protein, 76 aa, Zea mays
  misc_feature: Ceres CLONE 1501855
MGDRAYAPAVKPVPVRATNGTANGGGVGPPRPAPPSMVPGGRVPPPPMYRRRPAQSRPPARRAGRSARGWCCACCL

SEQ ID NO: 57032 - DNA, 695 bp, Zea mays
  misc_feature: Ceres CLONE 1501870
  misc_feature: Encodes the peptide sequence at SEQ ID NO. 57033
aaagctggagctccccgcggtggcggccgctctagaactagtggatcccccgggctgcaggaattcgcacgagaccattacctagaacatcctaatcgaaaaaaaaagcacactgcaccaccaacctttcctggcttcatctcctcctttcctccccaaaagacacaagagggggaagagagagagaggagaggcagagagaagagggggaggcagtccagtgtccacgcaggtacgctccacagaagagagatggcgatgcggatggcggcggcggcagtggcgctggtggcggtgatgggcgtgctggcgccccgagcggcggcgcagacgccgaactgcgcggagaagctgatcccgtgctcgccgtacatgaacacgacggggacgccgccggatacctgctgcggcccgctcaaggacgccgtccagaacgacctcaagtgcctctgcgacctctacgcctcgccggagatcttcaaggccttcaacatcagcctcgaccaggccctcggcctctccaagcgttgcggcctcagcgacaccaccgccgcctgcaagggcctttctcctacgcagtctcctccaggatcgccagcatcaggcggcagcagcaacgccgcccgtcgcgctctgccggacagtttcgcgggactggtgacgagcttgttcctagctctgtggtctgaattagt

SEQ ID NO: 57033 - protein, 147 aa, Zea mays
  misc_feature: Ceres CLONE 1501870
MAMRMAAAAVALVAVMGVLAPRAAAQTPNCAEKLIPCSPYMNTTGTPPDTCCGPLKDAVQNDLKCLCDLYASPEIFKAFNISLDQALGLSKRCGLSDTTAACKGLSPTQSPPGSPASGGSSNAARRALPDSFAGLVTSLFLALWSEL

SEQ ID NO: 57034 - DNA, 671 bp, Zea mays
  misc_feature: Ceres CLONE 1501872
tccccgcggtggcggccgctctataactagtggatcccccgggctgcaggaattcgcacgagaccattacctagaacatcctaatcgaaaacttttcaacttcttcgaagccctaaccctcccggcgaagtcgcgatgtccaacccgaagggctccaagatgctccagttcatcggctaccgcgtgaaggtgacgatccaggacggtcgccagctcgtgcgcaagtatcatggcgatctaccgccacgtgaacctcgacctcggatactgcgaagagttccgccgcctcccgccctccaagtcctcctaggccaccggagaactctaggagcgccgcacgttgggcctcctcctgctccgcggataggaggtcgtctccatgaccgtttagggtcggctgctgtccgaccacccacgtgcctaggccagtgtggcctgcgaagccctcgccggccctggtgtcagcctgctctctgggagctgtttgtgctgcgaacctctgctccactgtgatccaggtcctaggggccctgagcctgggctgggtggactggcccccggaatggtgcattcctcgatctcacctcaagggatggccagttgccggatcaacccttttcttacctgtagtcccagcgcccaccgcccgcgattgtctccacccctgcctg

SEQ ID NO: 57035 - DNA, 694 bp, Zea mays
  misc_feature: Ceres CLONE 1501875
  misc_feature: Translation starting site: 355
catagctggagctccccgcggtggcggccgctctagaactagtggatcccccgggctgcaggaattcgcacgagaccattacctagaacatcctaatcgaaaaagtccccgctcctgtttcgatctcccgaatcccgatcccgctaccggaggcggaggcgatggcggcggcgccggcggtaaggttcccggtcttcgggctcgtgcggctgctgggcttggccgccgcggcggcgatcctcttctgggccgtccacttccgaggcggcatggcgctctccaccgaagaggagagcaagctccccctcttcaacgttcacccagtgttaatgctgattggtttggtggccttgaatggcgaagtgggctgctgggttttggaccttttggtaccccggtggatcaagaagtggccgtgcatttttgcttccctggcatgtcttctttggtatattcatctatgttcttgctatcgccacaagtgtgactggactcctggagaagtcaatctttatgcagagcgccaaaatgattgagcgcttctccacagaagccatgtttatgaactccctgggaatgctgctggtgttgttgagcagccttgttattcttgcactcgttagtcctggacccagcatgatcgacacatacagaggctcttctgagtgagaggaaatgattacagcctagtttc

SEQ ID NO: 57036 - DNA, 551 bp, Zea mays
  misc_feature: Ceres CLONE 1501880
  misc_feature: Encodes the peptide sequence at SEQ ID NO. 57037
  misc_feature (252)..(252): n is a, c, t, g, unknown, or other
ctccccgcggtggcggccgctctagaactagtggatcccccgggctgcaggaattcgcacgagaccattacctagaacatcctaatcgaaaaacacgcactgacccacaccccccgcaccgctctctccccacccaggcacccagcctccacgccacagaatctctctccctgttcccccctctctctctctccgaactctaccccgcagtctcgggccgcggccatgtgcggaggacgcctcccaacgccngtcgccgagggcagccagcccgcggcctccgagggatccgccgacgccgccctgccggctgccgcgggcgccaaggccgcggaggcgctgctcccgtcgctcagtatctggggcgccgtcgcagcgcacgcgcgaacgccgtggtgcgccgcctcgtgcagacgctcgcagcgccccagcggtcctctccccagcgctacgggtggcgttcccggagcccaaggccaatcgccgccccctggcccttcaagggccagggccttccccgccgcctccaagtccccccgcggcccccccca

SEQ ID NO: 57037 - protein, 108 aa, Zea mays
  misc_feature: Ceres CLONE 1501880
MCGGRLPTPVAEGSQPAASEGSADAALPAAAGAKAAEALLPSLSIWGAVAAHARTPWCAASCRRSQRPSGPLPSATGGVPGAQGQSPPPGPSRARAFPAASKSPRGPP

SEQ ID NO: 57038 - DNA, 693 bp, Zea mays
  misc_feature: Ceres CLONE 1501883
  misc_feature: Encodes the peptide sequence at SEQ ID NO. 57039
aagctggagctccccgcggtggcggccgctctagaactagtggatcccccgggctgcaggaattcgcacgagaccattacctagaacatcctaatcgaaaaattgattgatcggacggacgcgcgtctccggtcccgtccgtaataacactgatccgatccacgccggccggcgatggagctcatcaagtccagggcgaccgtgtgcgcgctcctcctggcgctgctcctgctctcacactacgacggcgggacgacgacgacgatggtggcggaagcccgagtgtccatgtcctagagccaccaccactcgttcccctgcatctccaaccgcctctgcagcaacgagtgcgtcaaggaggacggctggtggaccgccagctactgccacctccgctactgcaggtgccagaatgcctgctaagcaaagctcttgaaacacccttcgcttgccagaactgaactgtggtagtactaagtaacacccttggctagttgtgcacaacctacgtaccgtgcatgcatgtaatgtggtgtcatgtaacgtgacagcgatgattattaataacaataataacacggcatgtagcctttgcatgcttctacagaaccaagaaaacaagcttatcaataccgtctacctccagagggggcccagtacccaaatcgtcctatagtgagtcgtagtacgcgc

SEQ ID NO: 57039 - protein, 40 aa, Zea mays
  misc_feature: Ceres CLONE 1501883
MELIKSRATVCALLLALLLLSHYDGGTTTTMVAEARVSMS

SEQ ID NO: 57040 - DNA, 688 bp, Zea mays
  misc_feature: Ceres CLONE 1501888
  misc_feature: Encodes the peptide sequence at SEQ ID NO. 57041
  misc_feature (220)..(220): n is a, c, t, g, unknown, or other
  misc_feature (221)..(221): n is a, c, t, g, unknown, or other
  misc_feature (224)..(224): n is a, c, t, g, unknown, or other
  misc_feature (225)..(225): n is a, c, t, g, unknown, or other
  misc_feature (230)..(230): n is a, c, t, g, unknown, or other
  misc_feature (231)..(231): n is a, c, t, g, unknown, or other
  misc_feature (246)..(246): n is a, c, t, g, unknown, or other
  misc_feature (343)..(343): n is a, c, t, g, unknown, or other
aaagctggagctccccgcggtggcggccgctctagaactagtggatcccccgggctgcaggaattcgcacgagaccattacctagaacatcctaatcgaaaaacctggttctccgtccggtcagaccaatcaacaaagtgacgcgagcacgagcatccatcgtttccccttcttccccatcgcgtgccctcgccgcagccatcttccatggcggaccagnnctnncacgnngacgagcagatcgcnggagttcaaggaggccttcagcctcttcgataaggatggcgacggctgcatcactaccaaggagcttggaactgtgatgcgctcccttggccagaancccccactgaagcagaagctgccaggaacattggattcaacgaggtttgaatgctgatgggcaatgggaaccattgacttccccagaagttcctgaaacctgatgggcaaggaaaagattaaaagacccccgactcccgaggggaggagctttaaggaagccctttcccgttcttcgaaaaagaaccagaaagggttttcaatcctcgggctggcttgaattccgcccatgtcattgaccaaacccccgggaaaaaaccttacttaaccaggagggtccaacaaaaataatcccgtggggcccatattttaccgggaacggccaaatataaatcccagagggttg

SEQ ID NO: 57041 - protein, 38 aa, Zea mays
  misc_feature: Ceres CLONE 1501888
MGKEKIKRPPTPEGRSFKEALSRSSKKNQKGFSILGLA

SEQ ID NO: 57042 - DNA, 684 bp, Zea mays
  misc_feature: Ceres CLONE 1501890
  misc_feature: Encodes the peptide sequence at SEQ ID NO. 57043
aaagctggagctccccgcggtggcggccgctctagaactagtggatccctcgggctgcaggaattcgcacgagaccattacctagaacatcctaatcgaaaactaaacatttcgtcgaacgccggcggcgagtcgagctcgagctcgagccccagccaccgcagccatgctcctcacgaaaccctacctctccaattcgctccttccagtcccatccccgccgccgtcgagccctattctcagctccgaccatgcaagcccccttgccgcctctacttgccgtcgcagccgcctccgcatctccgccacatccacggctgcgccggctccttcgtcggctgccgctgccatcgcgtcgctgagtcgagtggacgtgctctcggaggcgctcccttttattcagcgattcaaaggcaagacggtggtggttaagtacggcggtgcggcgatgaagtccccggagctgcaggcgtccgtgatccgcgatctcgtgctgctctcctgcgtcggcctccgccccgtgctcgttcacagcggcggtccggagattaattcctggatgctgcgcgtcagcgtcgagccgcagttccgcgacggcctccgtgtcacgtacgcgctcaccatgtaggtcgtcgagatggtgctagtcgggaaggtcaacagaacctcgtctccctcatcacg

SEQ ID NO: 57043 - protein, 153 aa, Zea mays
  misc_feature: Ceres CLONE 1501890
  misc_feature: SWISSPROT Homolog: EC 2.7.2.8 Acetylglutamate kinase
MLLTKPYLSNSLLPVPSPPPSSPILSSDHASPLAASTCRRSRLRISATSTAAPAPSSAAAAIASLSRVDVLSEALPFIQRFKGKTVVVKYGGAAMKSPELQASVIRDLVLLSCVGLRPVLVHSGGPEINSWMLRVSVEPQFRDGLRVTYALTM

SEQ ID NO: 57044 - DNA, 634 bp, Zea mays
  misc_feature: Ceres CLONE 1501893
  misc_feature: Encodes the peptide sequence at SEQ ID NO. 57045
  misc_feature (329)..(329): n is a, c, t, g, unknown, or other
tacccgcggtggcggccgctctagaactagtggatcccccgggctgcaggaattcgcacgagaccattacctagaacatcctaatcgaaaaagtgagctagcctcccgagccctatctatccttttctcggcacctcgcgggtctcccgtccgccccgtcccgcattcgtatcctctcctcactctcgccgccgccgcttcccctgcgccccgagccaagatgaatgttgaaaagctcaagaagatggcacgtgctgtgcgcactggggggaagggtagcatgcgcatgaagaaagaggcagtccacaagactacgaccacggatgatnagaggcttcagagcaccctgaaaagaatagggagtgacactcatcctggtattgaagaagttcacatctttaaagatgatgttgttattcaattggggaatcctaagggaaagtttcaattggggcaaaaaaaggggggcccgggggaactcccaaaaaaaaaaacgtgaaaaaatggctttccggcctttaaaaacaaatttgggccctaaaaaactaaaaaaccctggggaaggtttgggggagaaattccaaaaaaaaagcccccgggggttttcgggggaaaaaggggggggccccccccg

SEQ ID NO: 57045 - protein, 92 aa, Zea mays
  misc_feature: Ceres CLONE 1501893
  misc_feature (37)..(37): Xaa is any aa, unknown, or other
MNVEKLKKMARAVRTGGKGSMRMKKEAVHKTTTTDDXRLQSTLKRIGSDTHPGIEEVHIFKDDVVIQLGNPKGKFQLGQKKGGPGELPKKKT

SEQ ID NO: 57046 - DNA, 483 bp, Zea mays
  misc_feature: Ceres CLONE 1501897
caaagctggagctccccgcggtggcggccgctctagaactagtggatcccccgggctgcaggaattcgcacgagaccattacctagaacatcctaatcgaaaataaaaaaatctttaagcaagaaaagaaagaaaatgcagatcttcgtcaaaaccctgacggggaaaaccataaccctggaggttgaaagcagcgacacccatcgacaatgtcaaagccaaaatcccaggacaaaggaagggataacccgccggggatcagccaaaggctgaacctttcccctggggaaagcaacctggaaaaacggggggaaaccctttggggaaattaaaaaatccccaaaaaaaaagggccccccccccccccccctgggggctctttgagaggcttttagggggggggggggccccccccttttaaaaacggggggggggaaaaaaaatctcccccccccgggggggaaaaaaaaaaaaaaaaaaaaa

SEQ ID NO: 57047 - DNA, 722 bp, Zea mays
  misc_feature: Ceres CLONE 1501908
  misc_feature: Translation starting site: 271
  misc_feature (27)..(27): n is a, c, t, g, unknown, or other
  misc_feature (28)..(28): n is a, c, t, g, unknown, or other
  misc_feature (30)..(30): n is a, c, t, g, unknown, or other
  misc_feature (32)..(32): n is a, c, t, g, unknown, or other
  misc_feature (57)..(57): n is a, c, t, g, unknown, or other
  misc_feature (193)..(193): n is a, c, t, g, unknown, or other
  misc_feature (209)..(209): n is a, c, t, g, unknown, or other
  misc_feature (222)..(222): n is a, c, t, g, unknown, or other
  misc_feature (227)..(227): n is a, c, t, g, unknown, or other
  misc_feature (229)..(229): n is a, c, t, g, unknown, or other
  misc_feature (398)..(398): n is a, c, t, g, unknown, or other
aaagctggagctccccgcggtggcggnngntnataactagtggaggccccggggtgnaggaattcccacgagaccattacctagaacatcctaatcgaaaaatcgcttggcgtccgcctcagcccgccgccaggagagccggctcggtcggttcgtcgaagatcccggatctgctctgtcacgaggtctttcnggcgggtgttgtctcngcgaggtgtagcngagcncnaaggtctggtcgcctgttcaggagagtttcgagaagctgaaatggctcctaaagctgctcctgccaagaagggtgatgccaagacccaggccttgaaggttgcccaggctgtgaagtctgggtcagtaaagaagacaatgagatccgcacgtccgtgacattttcacgncccaagaccctgaagaaggctagggaccccaggtaccaagaatcagcactaccgggaaggaacaaggcttgttcattacccaattcctcaagtatccccttccccccgaatcggcgaattgaaaaaatttgaagataaccacccctcttggttttccttggcgaccctcaagggaaaaaaaaaaaaaaatccaaggcttcctgtcaaaaaaattttttaacatttcgggccacaagagggcaccccccccttttcgggcctgttagagaaaaaaaaagggttctccggaaaattttatttacccccgacacccccggggggggg

SEQ ID NO: 57048 - DNA, 683 bp, Zea mays
  misc_feature: Ceres CLONE 1501912
  misc_feature: Encodes the peptide sequence at SEQ ID NO. 57049
ggagctccccgcggtggcggccgctctagaactagtggatcccccgggctgcaggaattcgcacgagaccattacctagaacatcctaatcgaaaaaaaaacaaaccataaagcgagctcgcagagcggatcgaacgggagaacggagaagagaacaagagatagtacttgacactcctgtcctgctcctccactcccacgctcccagccgagctcgagcgcacgcacacgcgcacaagcaggagctcctgtcccgctagatcccaaacagtctcctgcccgcgcgcgtttgggggggggcgcgaaggaatcaccggatggcgatgttcgcgcggccgctgctggccaccctgctgctgctgccggcgttcctgctctctgccgcctcggccgccgacagcaagagcaaccctgctgatgagctcgtggcactgatcaacagcaaccgcactgctggcaaggcatcttctgtttcggacaaccaaggtttgggatgcatcgctctgcagtacatcaaagcatacgaaggccattgtgaccaggtggacgacaagaagccgatggagtcaagcttcaccgacacgttcgccccgacctgtggcgtccaggccacaaccctctccaagatcaccggaaggctggtggcttgccagtcccagtacttggctccagctgaggccttt

SEQ ID NO: 57049 - protein, 122 aa, Zea mays
  misc_feature: Ceres CLONE 1501912
MAMFARPLLATLLLLPAFLLSAASAADSKSNPADELVALINSNRTAGKASSVSDNQGLGCIALQYIKAYEGHCDQVDDKKPMESSFTDTFAPTCGVQATTLSKITGRLVACQSQYLAPAEAF

SEQ ID NO: 57050 - DNA, 527 bp, Zea mays
  misc_feature: Ceres CLONE 1501929
  misc_feature (214)..(214): n is a, c, t, g, unknown, or other
  misc_feature (221)..(221): n is a, c, t, g, unknown, or other
  misc_feature (226)..(226): n is a, c, t, g, unknown, or other
  misc_feature (231)..(231): n is a, c, t, g, unknown, or other
  misc_feature (233)..(233): n is a, c, t, g, unknown, or other
  misc_feature (234)..(234): n is a, c, t, g, unknown, or other
  misc_feature (250)..(250): n is a, c, t, g, unknown, or other
  misc_feature (261)..(261): n is a, c, t, g, unknown, or other
  misc_feature (262)..(262): n is a, c, t, g, unknown, or other
  misc_feature (278)..(278): n is a, c, t, g, unknown, or other
aagctggactccccgcggtggcggccgctctagactagtggatcccccgggctgcaggaattcgcacgagaccattacctagaacatcctaatcgaaaaactgttccagacttccagtccagcgcccggctaatagccaagcagagcttctccctagcctttgcttgctcttcacagcgcaagctccgagatgatgatcaggcgcggcagcagnaagattntcttnacccntnngccctctttggctccntcctcttcaannctctcctcggaatcgnctgctccctcccccaaatgggggggaaattgtctcccctccctgcctggggccggggcccttcccccccccctcccgggggccgccccccccagggggggggaaaaaaaatttcccggggctccccagaaaaaaaaaaaaggaaacccccaaaaacctcccccgaggggggaaaaaaaaaaaaaaagtgggtttaaaaaaaggtggtgttcctttggggggccccctcttttaattttttattaagaaa

SEQ ID NO: 57051 - DNA, 688 bp, Zea mays
  misc_feature: Ceres CLONE 1501945
  misc_feature: Encodes the peptide sequence at SEQ ID NO. 57052
aaagctggagctccccgcggtggcggccgctctagaactagtggatcccccgggctgcaggaattcgcacgagaccattacctagaacatcctaatcgaaaaaactccgaccatccaatgaatgttgaacttggggtgccttatacccctatgctcctgtgtttgcttgatgcttatgtcacatatatatggttccatccgccctgtatgtgaatgaccgttgggcaatcaacaaagatagatcattacatgtgctcggattgtggtaaacaaaatgatgtagagagaccctcaaattcgtactcagtttcaccaaactcagattctaagtcgatattgttttcattgtcaacaccttgagggcgacgtacaacataccataaagatatgaagccttaccattgtaatcatgctgaaactacagctacatagatgagttctggtaaacacatgctatctgatcaacaaatggcctaatcgtgtttgccgcagtgcgaggcctatattttggccatttaacctctattgaatcaaagaggcgcaagacataattgctgcgacaaaaacacccctggtctaagagatgcagtatttatggtgtcagctcatcatactagagcatgttcgagatgctgatgtctacatttcgatagactaaccaatcgattgtagggcacaacgtatatga

SEQ ID NO: 57052 - protein, 48 aa, Zea mays
  misc_feature: Ceres CLONE 1501945
MTVGQSTKIDHYMCSDCGKQNDVERPSNSYSVSPNSDSKSILFSLSTP

SEQ ID NO: 57053 - DNA, 692 bp, Zea mays
  misc_feature: Ceres CLONE 1501946
  misc_feature: Encodes the peptide sequence at SEQ ID NO. 57054
  misc_feature (608)..(608): n is a, c, t, g, unknown, or other
atagctggagctccccgcggtggcggccgctctagaactagtggatcccccgggctgcaggaattcgcacgagaccattacctagaacatcctaatcgaaaaatcgcgccctcgtcgccatcgtcaccacaccaccactccctcactgccctctcactcccgatccctgcaccactaccgcctcctccgcttcacccctctcgtcgcctcttgcggcgaccggcggcggatcgtccgcggcgcaagcgcaaccatggggctcttcaccgtgacgaagaaggccaccacccccttcgaaggccagaagcccggtacctccggcctccgcaagaaggttactgtattccagcagcctcattatctgcagaactttgtccagtcaacattcaatgcccttcctgcagaccaagtaaaaggtgcaaccattgttgtctctggtgatggccgctatttctcaaaagatgctgttcagatcataacaaaaatggctgctgccaatggagtaagacgtgtttgggttggacaaaacagtctcatgtctactcctgctgtatctgctgtcatccgtgaaagaattggtgcagatgtaagtttgattcttaatgaangacagtctttagcagtatgaatatttacttttgtatcctttatactgtctaatgaataacctgactgttggtttataaacacat

SEQ ID NO: 57054 - protein, 124 aa, Zea mays
  misc_feature: Ceres CLONE 1501946
  misc_feature (16)..(122): Pfam Name: PGM_PMM_I Pfam Description: Phosphoglucomutase/phosphomannomutase, alpha/beta/alpha domain I
  misc_feature: SWISSPROT Homolog: EC 5.4.2.2 Phosphoglucomutase
  misc_feature (119)..(119): Xaa is any aa, unknown, or other
MGLFTVTKKATTPFEGQKPGTSGLRKKVTVFQQPHYLQNFVQSTFNALPADQVKGATIVVSGDGRYFSKDAVQIITKMAAANGVRRVWVGQNSLMSTPAVSAVIRERIGADVSLILNEXQSLAV

SEQ ID NO: 57055 - DNA, 695 bp, Zea mays
  misc_feature: Ceres CLONE 1501953
  misc_feature: Encodes the peptide sequence at SEQ ID NO. 57056
  misc_feature (695)..(695): n is a, c, t, g, unknown, or other
caaagctggagctccccgcggtggcggccgctctagaactagtggatcccccgggctgcaggaattcgcacgagaccattacctagaacatcctaatcgaaaaacatccaaaattcccagtccgcgatacaagaccaatccaatcccagcggaagtggaagcagtttcatttccttccttgcagctagcagcgatgattcttgtggcgatagtggcggagctgctcgaggagtacaccgcgctggtggcgcgggtgctggagcagctgctcaacgacgcgccgttcccgcgccggatgcgcttcctcatgctgcggagcctccccttcgtgccgccgcctctgcccccgccgccgccgccgcacgccctccacgttaccacccgagtctgattattggctccatttttctcaggggtttcagcctactgcccgccatggccgcccacccactagcctgcgcttgaggcagctagtagtagatactgtaggttgaccagtgatccacggtgtgtttctcgctttccttttgtctgttgatttctattggctatactacacggtgctgtaaaggatcaattagttctgcctttgaggccctcatttggtgtaaatatttttgataacatggaccatggaaaaaactttcctttgacaaaaaaaaaaaaaaaaagcttatcgataccgtcgacctcgn

SEQ ID NO: 57056 - protein, 65 aa, Zea mays; identical to SEQ ID NO: 44442
  misc_feature: Ceres CLONE 1501953

SEQ ID NO: 57057 - DNA, 646 bp, Zea mays
  misc_feature: Ceres CLONE 1501954
  misc_feature: Encodes the peptide sequence at SEQ ID NO. 57058
aaagctggagctccccgcggtggcggccgctctagaactagtggatcccccgggctgcaggaattcgcacgagaccattacctagaacatcctaatcgaaaaatcacaaactccacacggctctcctgtctccgctgcccgctccacctccctccatgccgtcggcttccctccgcctcgacgtcgtcggctcgggcgcggcgggcctggttgccgcccgcgagctacgccgcgagggccatgcacccgtcgtcttcgagcgcgccgacgccgttggacgcacttggctatacacgcctgccgccacgtactcggacccgctcggagcacggctacgcattgcagcctctacgcatcgcttcgagacaaactgccacgcggagaccatgggtttacgtcgaatccccctccgcgctgggcccgccgggccccggaaacccccgtcggtttcccgggaaagaggaggggtcccccccccgggggggttcacccccccgtttaaactggccccggggcgccctttaaaaaaggaagggtccttggggggaaaagaaaacccggggggggggtcttaaaacccaaaaaaacttcgggaaaagagggggccccccaaaaagaatttttaaaaacccccggggggccaaaa

SEQ ID NO: 57058 - protein, 139 aa, Zea mays
  misc_feature: Ceres CLONE 1501954
MPSASLRLDVVGSGAAGLVAARELRREGHAPVVFERADAVGRTWLYTPAATYSDPLGARLRIAASTHRFETNCHAETMGLRRIPLRAGPAGPRKPPSVSRERGGVPPPGGFTPPFKLAPGRPLKKEGSLGGKENPGGGS

SEQ ID NO: 57059 - DNA, 562 bp, Zea mays
  misc_feature: Ceres CLONE 1501963
  misc_feature: Encodes the peptide sequence at SEQ ID NO. 57060
  misc_feature (273)..(273): n is a, c, t, g, unknown, or other
aagctggagctccccgcggtggcggccgctctagaactagtggatcccccgggctgcaggaattcgcacgagaccattacctagaacatcctaatcgaaaagggttctggctcgccaaaccctagccgccgagtgccgcccaccgcccgcccgccctccgccgcgcgtcggacggtgccgagggaagaggcaccatgaggttggagaagtgctggttctgctcctctaccatctaccccggccatggaatccagttcgtccgcaacgacgccnaggtcttccgcttttgcccggtcaagtgccataaaaacttcaagatggagagggaacctcgttagggtaagtggacaaaagcttacaggccttttgcctggcaaggacttgaccccggatccacccttttgattttggaaggaaaaagggaaaagggcccaaggcctttaaaccccattttgcgggaaaaaacttgaagggctttccccctttttttcaaattttgccttcccctttggggaaaaaactttttttaaaaaattttaacctgttgtacccccggggggag

SEQ ID NO: 57060 - protein, 47 aa, Zea mays
  misc_feature: Ceres CLONE 1501963
  misc_feature (1)..(47): Pfam Name: Ribosomal_L24e Pfam Description: Ribosomal protein L24e
  misc_feature (27)..(27): Xaa is any aa, unknown, or other
MRLEKCWFCSSTIYPGHGIQFVRNDAXVFRFCPVKCHKNFKMEREPR

SEQ ID NO: 57061 - DNA, 683 bp, Zea mays
  misc_feature: Ceres CLONE 1501969
  misc_feature: Encodes the peptide sequence at SEQ ID NO. 57062
ctggagctccccgcggtggcggccgctctagaactagtggatcccccgggctgcaggaattcgcacgagaccattacctagaacatcctaatcgaaaactctctgtcgcatttcccgtcctgtccttcccttacccggcggcttaaaccctagttctcactcccatcgccgcttcagctccgccgcagcagatggagttctggggtctcgaggtcaagcctggttccactgttaagtgtgagcctggatatggctttgtgctgcacctttcccaggctgctcttggggaatcgaagaagagtgataatgccttgatgtatgtcaaaattgatgatcagaaacttgccattggaaccctctctgttgacaagaacccacacatacaatttgatctggttttcgataaagagtttgagctgtcgcacacatcaaaaactaccagcgtcttcttcactggctacaaggttgagcagccattcgaggaagatgaaatggatcttgattctgaagatgaagacgaggagcgggatgttccagtagtcaaggaaaatggcaaagctgatgggaagaaacagaaaagtcaagaaaaggcagttgctgcaccttcaaaatcaagtccggattccaagaagagcaaggatgacgatgattctgatgaggacgagactgatgattctgatgag

SEQ ID NO: 57062 - protein, 164 aa, Zea mays
  misc_feature: Ceres CLONE 1501969
MEFWGLEVKPGSTVKCEPGYGFVLHLSQAALGESKKSDNALMYVKIDDQKLAIGTLSVDKNPHIQFDLVFDKEFELSHTSKTTSVFFTGYKVEQPFEEDEMDLDSEDEDEERDVPVVKENGKADGKKQKSQEKAVAAPSKSSPDSKKSKDDDDSDEDETDDSDE

SEQ ID NO: 57063 - DNA, 694 bp, Zea mays
  misc_feature: Ceres CLONE 1501970
  misc_feature: Encodes the peptide sequence at SEQ ID NO. 57064
aagctggagctccccgcggtggcggccgctctagaactagtggatcccccgggctgcaggaattcgcacgagaccattacctagaacatcctaatcgaaaaatcggtagcatcgacacgagcgggacgagcatgctggacgagctcaacaagtccttggacaggaggggaatgcaggtaaagagcagaagcgatggcacatccatccacctgattcagtgctttaattatctgctctcaactccagcagagtgttctgaaaccagtgctgtctttcttttgttcgcagatcgtgctggcgaacccgggcagcgagatcatgaagaagctggacagctccaaggtgctggagcagatcggccacgagtgggtgttcccgacggtgggcgaggcggtggcgtcgtgcgactacgtgctgcactcgcacaagccgggaatggccaaggacagcgccgccgcccacgagagcatggtgtgacgagcaccgccacgccaaccgtatgtgtagtgtgctccggttccggtctgacgtaaccagtcgtcacgcggaccgagatgaattatgtatacacgtgtctcgagtattgtacacctgcaccgtcgcgggaaaaacgaattcagagaagaaaggatcccacccggtttttttttggtgaagaaaaaaaaaaaaaaaagcttatcgataccgtcgacct

SEQ ID NO: 57064 - protein, 52 aa, Zea mays
  misc_feature: Ceres CLONE 1501970
MKKLDSSKVLEQIGHEWVFPTVGEAVASCDYVLHSHKPGMAKDSAAAHESMV

SEQ ID NO: 57065 - DNA, 679 bp, Zea mays
  misc_feature: Ceres CLONE 1501987
  misc_feature: Encodes the peptide sequence at SEQ ID NO. 57066
aagctggagctccccgcggtggcggccgctctagaactagtggatcccccgggctgcaggaattcgcacgagaccattacctagaacatcctaatcgaaaaaaaaccctagaacgtggccttaaaccctcctcttccaacccctttttctcttcctcaccaagaaagaaaaacagacacacgtcactgttcgccttgtccggtcgtttctgctccattcctcctcctgcaagccgcaaaggaatcaggcggagtggcgcgatgggagagcaggtcgtgacggagcagatccagcggaagctggaggaggtcaacgctaccgtccaacagcacctcgcgggtgtccaggaccacatcaacttcaccatgcagcaagcatacttcaagtgcgcatatggttgctttgatcggcgccatactcaggaagcgatcagcaactgtgtggagaattgtagtgtgcctgtccttgctgccaacaatatttttgagagtgagatggccaagtttcagggaatgttgaaccggtcattgagggtctgtcaagataagtttgaagctgccaatctccagaagttgagatcagatgcaactcgcgaactggaatcctgtgtcaacagatctattgatgacagcctcagggtccttccgcatgtggtggatcagatcaagtccaccctcaa

SEQ ID NO: 57066 - protein, 139 aa, Zea mays
  misc_feature: Ceres CLONE 1501987
  misc_feature (10)..(139): Pfam Name: DUF842 Pfam Description: Eukaryotic protein of unknown function (DUF842)
MGEQVVTEQIQRKLEEVNATVQQHLAGVQDHINFTMQQAYFKCAYGCFDRRHTQEAISNCVENCSVPVLAANNIFESEMAKFQGMLNRSLRVCQDKFEAANLQKLRSDATRELESCVNRSIDDSLRVLPHVVDQIKSTL

SEQ ID NO: 57067 - DNA, 618 bp, Zea mays
  misc_feature: Ceres CLONE 1501997
  misc_feature: Encodes the peptide sequence at SEQ ID NO. 57068
  misc_feature (322)..(322): n is a, c, t, g, unknown, or other
  misc_feature (379)..(379): n is a, c, t, g, unknown, or other
  misc_feature (381)..(381): n is a, c, t, g, unknown, or other
  misc_feature (537)..(537): n is a, c, t, g, unknown, or other
aaagctggagctccccgcggtggcggccgctctagaactagtggatcccccgggctgcaggaattcgcacgagaccattacctagaacatcctaatcgaaaaatacgccgccatcttcgcaagccaccgcaaccgaagcccgccttcgccgccgccgcctctgcgatccccgcaaggtcgcaaacatgtctaccgtgctccagcgcccgacccccggcacggtccagtgcttcggccgcaagaagacagctgtggccgtcgcctacaccaagccggggcgcgggctgatcaaggtgaacggcgtcccgattgagctcatcangccggagatgctccgcctcaaggccttcgagcccatcctgctggcggggcgctccangnttcaggacatcgacatgaggatccgcgtccgaaggcgcggggagacgtcgcagatctacgccatcggccaggccgttcgcaaggggctcgtcgcctactaccagaagtacgtccacgaggccgccagaagggagtcaaagactctttcacccgtancgaacgaaccctttcgtcgccaaacccaggggctggaagccaaaaaatttcgggggtccgggcccccccccccagtttcaa

SEQ ID NO: 57068 - protein, 144 aa, Zea mays
  misc_feature: Ceres CLONE 1501997
  misc_feature (17)..(135): Pfam Name: Ribosomal_S9 Pfam Description: Ribosomal protein S9/S16
  misc_feature (46)..(46): Xaa is any aa, unknown, or other
  misc_feature (65)..(65): Xaa is any aa, unknown, or other
  misc_feature (66)..(66): Xaa is any aa, unknown, or other
  misc_feature (118)..(118): Xaa is any aa, unknown, or other
MSTVLQRPTPGTVQCFGRKKTAVAVAYTKPGRGLIKVNGVPIELIXPEMLRLKAFEPILLAGRSXXQDIDMRIRVRRRGETSQIYAIGQAVRKGLVAYYQKYVHEAARRESKTLSPVXNEPFRRQTQGLEAKKFRGSGPPPPVS

SEQ ID NO: 57069 - DNA, 652 bp, Zea mays
  misc_feature: Ceres CLONE 1501998
  misc_feature: Translation starting site: 212
  misc_feature: Pfam Name: NifU_N Pfam Description: NifU-like N terminal domain
  misc_feature (374)..(374): n is a, c, t, g, unknown, or other
  misc_feature (381)..(381): n is a, c, t, g, unknown, or other
  misc_feature (396)..(396): n is a, c, t, g, unknown, or other
aaagctggagctccccgcggtggcggccgctctagactagtggatcccccgggctgcaggaattcgcacgagaccattacctagaacatcctaatcgaaaaacacccacacgaaggatcccgaagccgaagagaaccctaccgaggaggcagaaaatccgtaggcgcgcctcatacgattccgagatccgtgcctcttatcggcagccatgatgctgcgcgcggcgggcaggcgactcctcggcgtaggaggcggcgatccagcgcccgcggtcgctgctgctgtggcggcgagcaggagcagaggataccacgagcgggtggtggaccactacaacaacccgcgcaacgtggggtccttggacaggacgacancgacgtncgaacggggatcgtncggcgcgcggcgtgcggggacgtcatgaagctgcagatccgcgtcgacgaagggtcccgcaggatcgtcgacgcgcgcttcaagaccttcggttgcggctccgccatccgggtcctctccgtcgctcccgaatgggtcaggggccagcagtggaaagaaggtggtgggcatcaaaaaccccgaaattgggaaaaccctggtttcttccccccagggaagccccccctgggaaaagtggcccttgaaaagccaatca

SEQ ID NO: 57070 - DNA, 692 bp, Zea mays
  misc_feature: Ceres CLONE 1502019
  misc_feature: Encodes the peptide sequence at SEQ ID NO. 57071
atagctggagctccccgcggtggcggccgctctagaactagtggatcccccgggctgcaggaattcgcacgagaccattacctagaacatcctaatcgaaaaattccaaaactccgagcaatcagtccaaacccgtgtccaccgaaagtttgatgggatcaggcctctcaagcagcagcagccaccggagcagcggcgcgtcgtcgtcgcttcaccagccaccggcggcggccccggccctggtcgtcgcggtcgacggctcgctacgggagttcgtcacgccggcggcggtgccgctcctcccccccgtctccgtctccgacgtgctgggcgcgaatgcggacgacggccggtccttcgtgtgcagctccagcgcgctctacttcgagaccgacgtcccggcgctcggcgccagcgagctgctccggccggggcagctctacttcgtcctccccgcggcgatgctcggcaggccgctctcgggcgccgacatggccgcgctggccgtgcgcgccacccaagcgctggcggcgggagcgaggcctccgcgtggcgggctacgcctactcgtgaccacacaggcgcgcgtcatcgcctgcggtcgcggtgtaaaacgagcacgcgtacggtcacgaggatgctgccaacgagaacctctcccagaagcatcttgacggtatcgagacgggtcc

SEQ ID NO: 57071 - protein, 173 aa, Zea mays
  misc_feature: Ceres CLONE 1502019
MGSGLSSSSSHRSSGASSSLHQPPAAAPALVVAVDGSLREFVTPAAVPLLPPVSVSDVLGANADDGRSFVCSSSALYFETDVPALGASELLRPGQLYFVLPAAMLGRPLSGADMAALAVRATQALAAGARPPRGGLRLLVTTQARVIACGRGVKRARVRSRGCCQREPLPEAS

SEQ ID NO: 57072 - DNA, 544 bp, Zea mays
  misc_feature: Ceres CLONE 1502029
  misc_feature (271)..(271): n is a, c, t, g, unknown, or other
  misc_feature (523)..(523): n is a, c, t, g, unknown, or other
aaagctggagctccccgcggtggcggccgctctagaactagtggatcccccgggctgcaggaattcgcacgagaccattacctagaacatcctaatcgaaaattgattgatcggacggacgcgcgtctccggtcccgtccgtaataacactgatccgatccacgccggccggcgatggagctcatcaagtccagggcgaccgtgtgcgcgctcctcctggcgctgctcctgctctcacactacgacggcgggacgacgacgacgaatgtgncggaagccccggtgggtgcatggggcaagaagccaagaaccaacttggttcccccttggaattctcccaaacccgcctctttggaaaaaaacaaatggggctttaaaaagaaaaaaaaccgccggggtggaaaaaccccccggggtaatatttggcccccccctccccccttttattggggagggggggccccaaaaaaagaggggggttcaataaaaaaaaaaaaaattttttttttaaaaaaaaaacccnctctgttggggggtttttttg

SEQ ID NO: 57073 - DNA, 693 bp, Zea mays
  misc_feature: Ceres CLONE 1502042
  misc_feature: Encodes the peptide sequence at SEQ ID NO. 57074
  misc_feature (1)..(1): n is a, c, t, g, unknown, or other
natagctggagctccccgcggtggcggccgctctagaactagtggatcccccgggctgcaggaattcgcacgagaccattacctagaacatcctaatcgaaaaatattccctacgcctcgctagcgccttccgcgaactgaggactcccgagaggccgagaccaccccgatgtccgccatggagaccgacatcaacgcgccgccgcccgccccagccggcgagggatcctccgtggtcggtccgtcctcctcatcctcccgcaagcccaacaagcgcttcgagatcaagaagtggaacgccgtcgcgctctgggcatgggatatcgtcgtcgacaactgcgccatctgccgcaaccacatcatggatctatgcatcgagtgccaggcgaaccaagctagcgcgaccagcgaggagtgcactgtcgcttgggataacagtgagtgggagttccagaaatatggccactagttcctgggcaccgtcatgtggtgttgggactttgctgccactcaagtgtttttgtctgccaaacagctccatctcttactgctttcgatgcttgcatctatcacccgtcaattataactagctagcagtacgtacacctgggactgtatttggacgatccattgagaggatagtaggcccatttttatcatggtatgtggatcttcataaaaaaaataaaaaaa

SEQ ID NO: 57074 - protein, 99 aa, Zea mays
  misc_feature: Ceres CLONE 1502042
MSAMETDINAPPPAPAGEGSSVVGPSSSSSRKPNKRFEIKKWNAVALWAWDIVVDNCAICRNHIMDLCIECQANQASATSEECTVAWDNSEWEFQKYGH

SEQ ID NO: 57075 - DNA, 690 bp, Zea mays
  misc_feature: Ceres CLONE 1502070
aaagctggagctccccgcggtggcggccgctctagaactagtggatcccccgggctgcaggaattcgcacgagaccattacctagaacatcctaatcgaaaaaaaatatgttttctagtaatggttaatatcagattctctcgtctctagcacgtcgccgcctcctctgtcactccattcgatttctcctctgtcgtcggtgtcattttggatcgatgcgcaagcgactcggcatcaggtcaggggtgagctaccttagctcggggctcgcttcttcatgcccctgctactaggttttctccgtttttcatcgctcagtttcttttagatcttgaggaaaaagggcgcggacagaagcagtttcttgtagatctaatcagactctgatccgtgtagcgtaccggcgacacgccgaagctagcatatttcatgccctctaatatgatgtgtgtggctgtggcatctctactttcgcgtcttcttccttccacaccgcagctcaggagcctagtcgctgtcgctgcactcgtcaggattcactacattttcccgctggaacgccagcttgcgaggtggctacgctataatggatgaaaagatttaatgaagttgagccttatcctttggcatggtaatggcctggatcttagaatttgaagcatcaatctccccgcccatactccacgtgtg

SEQ ID NO: 57076 - DNA, 685 bp, Zea mays
  misc_feature: Ceres CLONE 1502071
  misc_feature: Encodes the peptide sequence at SEQ ID NO. 57077
caaagctggagctccccgcggtggcggccgctctagaactagtggatcccccgggctgcaggaattcgcacgagaccattacctagaacatcctaatcgaaaagtcatttaaaggccacgggtaccaccactctactcttcgtcctcctcgatcgtcccaacaaccgcaatggcgcagcagaggcttctcgctctcctcctggtggcggccctcctcgcgctctccttctcgcaagggcaggtggaagcgcggaaggtgcaggtgcggcgcgcgcccctcggcggcggcggccgcctgcttccggaggcgatgatggcgtacacgacgacggactacgggccccccacggccaacaccaacacccacggcggcatggtcccgtcgccggacgacccctcctcgccgccgacgcactgaccggccagtcgatctcaccggcaacaactgtgttgttctttgggattggagctttggaagagaagattggaggagaggatcggaagaagctggtcttgttcttctcccttattgggcgcgcgtgttgtgttgtgcgctgctgtgtctgtgtagtccagctgtagctgctgctgtgcttagctgattgaaagtggaactgtagtgggtccacagtattatgcatgttttgtttgttgagacgtcagaacccatctctatcgttgaatc

SEQ ID NO: 57077 - protein, 82 aa, Zea mays; identical to SEQ ID NO: 44249
  misc_feature: Ceres CLONE 1502071

SEQ ID NO: 57078 - DNA, 625 bp, Zea mays
  misc_feature: Ceres CLONE 1502072
  misc_feature: Encodes the peptide sequence at SEQ ID NO. 57079
  misc_feature (583)..(583): n is a, c, t, g, unknown, or other
catagctggagctccccgcggtggcggccgctctagaactagtggatcccccgggctgcaggaattcgcacgagaccattacctagaacatcctaatcgaaaagagttcctgattgttgtattccagtttcttctgtgagttttgtgggatcgcgaggaagaactagaaggatgtcatgctgcggaggcaactgcgggtgcggcgccggctgcaagtgcggcagcggctgcggagggtgcaagatgtacccggacatggctgagcaggtgaccaccacccagactctcatcatgggtgttgcaccatccaagggcgggttcgaggcggccgccggagctgacaacggcgggtgcaagtgcggcgccaactgcacctgcgacccctgcacctgcaagtgagacgactgcggcgatgacgctgcatggtctgcagcctgcacggcgtgatgaggtcctcggaaggactctttatctctagctcagtgatgagctgatctactatataatatgctagcagtgtcgtatgatgtgttttgatcgagtcagtcatacagtcagcctcgtgccatgggacatggcatancatgacttgctctatctgctacatctgcatctacgcatgcct

SEQ ID NO: 57079 - protein, 75 aa, Zea mays
  misc_feature: Ceres CLONE 1502072
  misc_feature (1)..(74): Pfam Name: Metallothio_2 Pfam Description: Metallothionein
MSCCGGNCGCGAGCKCGSGCGGCKMYPDMAEQVTTTQTLIMGVAPSKGGFEAAAGADNGGCKCGANCTCDPCTCK

SEQ ID NO: 57080 - DNA, 708 bp, Zea mays
  misc_feature: Ceres CLONE 1502074
  misc_feature (227)..(227): n is a, c, t, g, unknown, or other
  misc_feature (252)..(252): n is a, c, t, g, unknown, or other
  misc_feature (359)..(359): n is a, c, t, g, unknown, or other
  misc_feature (401)..(401): n is a, c, t, g, unknown, or other
  misc_feature (402)..(402): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (708)..(708): n is a, c, t, g, unknown, or other
aacctggagctccccgcggtggcggccgctctagaactagtggatttcttgggctgcaggaattcgcacgagaccatacctagaacatcctaatcgaaaaagtcccacacggtggcggacgcgggcgtgctagggttgagcggctacacgagcgtgctatggttgagcggggctccgcgggcgtgctaaggtttcccgagcatggcggtggccggcgaacacgtaanggctctcccctctaattccctcccnacctcctcgaggggccaagcgtctgtgtgtgtcccttttcgcccaaccagagggccacccccccgcgcgctctttttttacaccagacggccgcacaaaaaacccanttttttttttcccccccccggggggaaaagaaaaaggggtcnnccccnnnttttctcctccccctttttttataaaaaaaaaacaacaaaaccctccccccgcggggggcggcgggcccccccccccccaaccccacgcccccccgcccccgggcggcccctccccccccccgcgccgcaacaccccctatgcttcccgcgcctgtccccccgtcggtcccccgcccccccgcccccgccctccccccggcgcaacgcccccccgcccccccaccacggaaggccgccccgccggcccccggggggcgcggcccccggcgcgctcgcgcgcccgcggggggcgcggtgn

SEQ ID NO: 57081 - DNA, 679 bp, Zea mays
  misc_feature: Ceres CLONE 1502077
  misc_feature (369)..(369): n is a, c, t, g, unknown, or other
catagctggagctccccgcggtggcggccgctctagaactagtggatcccccgggctgcaggaattcgcacgagaccattacctagaacatcctaatcgaaaaatcctcttactgtttttttttttgcatcgttggaagttgactggtggacgaactccgcgccgccgccgtcctggatgacgccgcacgcacgaggtgcaaacgaccgcgtccgagtccggatccgccaccaccgcgccctcgccacactacaggcacgtggagcccatcggcggtgagccggaggctggagcacgcgcggcggtggcggcagcggcagcgcttgcggcggaaggaagaaggaacggggtgggggattcgaatcgaangagcagcggcgatctactgttcccttgtattatgccccgcactttacttctcaaagccaaagtatatgttgaagaatggcttggagctaacggtactgacaccaacttttggttatgatcagaaccgactggagtgcaataatgaatctaattgtttgcaatattaggaccagatacctcctccaaagggttttttcatgttaccgattgggggccccaaaacaaaagaaaaccccccccgcctttggggggcccccccctttgttccccaaaaagaggcattggggaaaaggttcttttggggaagagc

SEQ ID NO: 57082 - DNA, 694 bp, Zea mays
  misc_feature: Ceres CLONE 1502090
  misc_feature: Encodes the peptide sequence at SEQ ID NO. 57083
  misc_feature (673)..(673): n is a, c, t, g, unknown, or other
  misc_feature (674)..(674): n is a, c, t, g, unknown, or other
aaagctggagctccccgcggtggcggccgctctagaactagtggatcccccgggctgcaggaattcgcacgagaccattacctagaacatcctaatcgaaaaatcgtctccaccgttctctcttcctctgctcttctctgcctgcctgagctcaccgcacctcgcctcctcaccgcgtttcctccgttaatccggtagaaaatggccgatgccgaggatatccagcccctcgtctgcgacaacggaactggcatggtcaaggctgggttcgctggcgacgacgccccgagggccgtcttccccagcatcgtggggcgcccgcgccacactggtgtcatggtcgggatggggcagaaggacgcctacgtcggtgacgaggcgcagtccaagaggggtatcctgaccctcaagtaccccatcgagcacgggatcgtcagcaactgggacgacatggagaagatctggcatcacaccttctacaacgagctccgcgtggctcccgaggagcaccccgtcctcctcaccgaggcgcccctgaaccccaaggctaacagggagaagatgacccagatcatgttcgagaccttcaacaccccggctatgtacgtcgccatccaggccgtgctctctctgtatgccagtggccgtaccacaggtatcgtgctcgactcgnngagatggtgtgagccacacc

SEQ ID NO: 57083 - protein, 164 aa, Zea mays
  misc_feature: Ceres CLONE 1502090
  misc_feature (4)..(162): Pfam Name: Actin Pfam Description: Actin
  misc_feature: SWISSPROT Homolog: EC 2.7.10.2 Non-specific protein-tyrosine kinase
  misc_feature (158)..(158): Xaa is any aa, unknown, or other
MADAEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNTPAMYVAIQAVLSLYASGRTTGIVLDSXRWCEPH

SEQ ID NO: 57084 - DNA, 729 bp, Zea mays
  misc_feature: Ceres CLONE 1502093
  misc_feature (120)..(120): n is a, c, t, g, unknown, or other
  misc_feature (125)..(125): n is a, c, t, g, unknown, or other
  misc_feature (126)..(126): n is a, c, t, g, unknown, or other
  misc_feature (139)..(139): n is a, c, t, g, unknown, or other
  misc_feature (140)..(140): n is a, c, t, g, unknown, or other
  misc_feature (268)..(268): n is a, c, t, g, unknown, or other
aaagctggagctccccgcggtggcggccgctctagaactagtggatcccccgggctgcaggaattcgcacgagaccattacctagaacatcctaatcgaaaaactggtctccgcttccgnctccnncgactcctttgtnnctcgtcctcatccatccaaccaggcgagccaacaagcaagcaaaagtaaacggggcgaggagctggagagacgccggcgacgcgaagcaaccgcccgatcggagccgcggctgagcaggagggagccngagatgggtggtctcgtcggcggcagcacgggcgcggcggagcacgtcgtcgccaacgccgggaggggagcagagtacgtgcgccgcatgcaccgccacggggcgaacggagcacagtggcaccttcaccctcgtcaagcaaattaagggcgcccgtccaccttcttttgggacctgggtccggaaggtcaaaccgacccgaagggtaaaaagcgtttcttaagggaactggcttcgtggccggggaacccacttcaaggggggggacctttgcaaaattaaaaattaaaaaaggggtttgcggggaaaaaaaaaaaccgaagcgccttggaagttttcaaaaaaacctcgccaaaccccgggaaaaaattctcgggggggggcacccccccccaaaaatttctccccttatatatttccccccccaaaatattttgggggggcgcgcgccccctttttat

SEQ ID NO: 57085 - DNA, 710 bp, Zea mays
  misc_feature: Ceres CLONE 1502105
  misc_feature: Encodes the peptide sequence at SEQ ID NO. 57086
  misc_feature (315)..(315): n is a, c, t, g, unknown, or other
  misc_feature (316)..(316): n is a, c, t, g, unknown, or other
  misc_feature (345)..(345): n is a, c, t, g, unknown, or other
  misc_feature (392)..(392): n is a, c, t, g, unknown, or other
  misc_feature (396)..(396): n is a, c, t, g, unknown, or other
  misc_feature (397)..(397): n is a, c, t, g, unknown, or other
ctggagctccccgcggtggcggccgctctagaactagtggatcccccgggctgcaggaattcgcacgagaccattacctagaacatcctaatcgaaaaagagaaaagaaaaccgctccaatccggaagctgaaaatagcagaagaatccagaggcgactccaggtttgttggcgatgctgcgagcgggaggcaggcggctcctcgccccggggctccgtcggctcggcctgggcacaggcgcctccggcgaggcgggccctgcggccgcggcggcgggggtgagggcgtaccacgagcgggtggtggaccactanncacacccgcggaacgtaggttccttcgancaggacgacccccacgtcggcactgggttggtttggcgcgccggccntgcnngcgacgtcattgaagctgcagatccggcgtcgacgaagactccgggcagaatcgtcgacccctgcttcaaaaatttttggcttgggggtcccgccatagggggcctccccccgtcgctacggaaggggggaagggaaaaaccagggggaaaaattttgaaaattcaaaacccgggaatccggaaaacctttttcccttcccccataaaattcccttttggaattgtttcccaaaaaagccatttaaaaccgcgttgaaaaaaacccccaccccccaatactcaaattgggggcaaaagggggaaaaacccccc

SEQ ID NO: 57086 - protein, 159 aa, Zea mays
  misc_feature: Ceres CLONE 1502105
  misc_feature (47)..(47): Xaa is any aa, unknown, or other
  misc_feature (48)..(48): Xaa is any aa, unknown, or other
  misc_feature (57)..(57): Xaa is any aa, unknown, or other
  misc_feature (73)..(73): Xaa is any aa, unknown, or other
  misc_feature (75)..(75): Xaa is any aa, unknown, or other
MLRAGGRRLLAPGLRRLGLGTGASGEAGPAAAAAGVRAYHERVVDHXXHPRNVGSFXQDDPHVGTGLVWRAGXAXDVIEAADPASTKTPGRIVDPCFKNFWLGGPAIGGLPPSLRKGGREKPGGKILKIQNPGIRKTFFPSPIKFPFGIVSQKSHLKPR

SEQ ID NO: 57087 - DNA, 701 bp, Zea mays
  misc_feature: Ceres CLONE 1502111
  misc_feature: Encodes the peptide sequence at SEQ ID NO. 57088
  misc_feature (610)..(610): n is a, c, t, g, unknown, or other
  misc_feature (611)..(611): n is a, c, t, g, unknown, or other
caagctggagctccccgcggtggcggccgctctagaactagtggatcccccgggctgcaggaattcgcacgagaccattacctagaacatcctaatcgaaaactctcgattcggaaaacctccaaggctccaaccctagccgcgatccgacaacgcctccatccctagccgactgctgcaagcttcagagctcaagagtcagggcgccatggcgacagagacggagaccttcgcctttcaggctgagatcaaccagctgctctcactcatcatcaacaccttctattccaacaaggagatcttcctccgggagctcatttccaactcttccgatccggagctgttcatccacattgtaccagacaaggcttcgaacacgctctccatcatcgacagcggcatcggcatgaccaagtccgaccttgtcaacaacctcggtaccatcgccaggtccgggaccaaggagttcatggaagcccttgctgctggcgctgatgtgtctatgattgggcagttcggtgtcggtttctactctgcctacctcgtcgccgagagggtcgtcgtgaccaccccagcatacgatgacgagcagtacgtgtgggaatcccanngcgggcgggtcgttcactggtactcgtgacacgtctggggagcagcttggcaggggtactaagattacaccttttctcaaggaagatcag

SEQ ID NO: 57088 - protein, 143 aa, Zea mays
  misc_feature: Ceres CLONE 1502111
  misc_feature (28)..(124): Pfam Name: HATPase_c Pfam Description: Histidine kinase-, DNA gyrase B-, and HSP90-like ATPase
  misc_feature (134)..(134): Xaa is any aa, unknown, or other
  misc_feature (135)..(135): Xaa is any aa, unknown, or other
MATETETFAFQAEINQLLSLIINTFYSNKEIFLRELISNSSDPELFIHIVPDKASNTLSIIDSGIGMTKSDLVNNLGTIARSGTKEFMEALAAGADVSMIGQFGVGFYSAYLVAERVVVTTPAYDDEQYVWESXXGRVVHWYS

SEQ ID NO: 57089 - DNA, 569 bp, Zea mays
  misc_feature: Ceres CLONE 1502316
  misc_feature (241)..(241): n is a, c, t, g, unknown, or other
  misc_feature (270)..(270): n is a, c, t, g, unknown, or other
aaagctggagctccccgcggtggcggccgctctagaactagtggatcccccgggctgcaggaattcgcacgagaccattacctagaacatcctaatcgaaaagtatcccatccatcgatccgaatctcggaatctgcaggaccctgcggcgcggcttcttcgtggagaagaggttgctgccgaagccaccgccaggtagccatgtcgtcctccgtgctgagggctgcggccgacagggccnattcgcaggcaggcccctcacgcctgacnaaaacgcgcggcgtcaggatccgggagctactcgcctagggaacggcatacctgcgctgggtggcaaggccccaggttcaaaggcctttcttaacccttaatttgccgatgaaaagggaatttcataaccttgccaggaaaaagtttaaatttttttcccccccaggttttttttctgtttttgggccccaaggggacctttgttgaaaccccttaaggccccgttgtggttctaaaacccctttttccaaggggggttgggcccccccgaaatttttttttaaacccccggccacaag

SEQ ID NO: 57090 - DNA, 673 bp, Zea mays
  misc_feature: Ceres CLONE 1502323
  misc_feature: Encodes the peptide sequence at SEQ ID NO. 57091
caaagctggagctccccgcggtggcggccgctctagaactagtggatcccccgggctgcaggaattcgcacgagaccattacctagaacatcctaatcgaaaaaattctgatctctagcccccctccttccggctcctgtcatcctgtgcatgccatcggggcgctcgccgggacaacatttacctggacagcgacgccgccgcgctccctcgacgagagctcgtagctgtgtccgcgcaaagctcacgcctttcttggccccgaccccttctccccgccgccggcgccgcgcttggcttgatgctcgacgtctgcgcgccacacgggcccgctaagctcccggctgcgtttgtcgccggcgtgcgagtcgcctgggtcgccggcaggtggtggtggcgatccgtggcggtgggggcggcgcgccatggcgtcaccacgcgggcgtcgttcttcgggctcgattcccaggttgcttcatttctgcatcatcaagaaaaaatgaatgttcttgtggaacctgatgttcatgatacatttgctagaattccaggttatggttttgtgcaaaccttctatactcaagataccagtgaccttcatgagagagttgattttgttacatgcttggggtggtgatggactcattttgcatgcatcaaacttatttagaac

SEQ ID NO: 57091 - protein, 111 aa, Zea mays
  misc_feature: Ceres CLONE 1502323
  misc_feature: SWISSPROT Homolog: EC 2.7.1.23 NAD(+) kinase
MLDVCAPHGPAKLPAAFVAGVRVAWVAGRWWWRSVAVGAARHGVTTRASFFGLDSQVASFLHHQEKMNVLVEPDVHDTFARIPGYGFVQTFYTQDTSDLHERVDFVTCLGW

SEQ ID NO: 57092 - DNA, 695 bp, Zea mays
  misc_feature: Ceres CLONE 1502325
  misc_feature: Encodes the peptide sequence at SEQ ID NO. 57093
caaagctggagctccccgcggtggcggccgctctagaactagtggatcccccgggctgcaggaattcgcacgagaccattacctagaacatcctaatcgaaaaaaaaagggaagccagagcacagagccagacctggcggcgctgggcatccagaaacgccgcctaggatccttctctctctctctctcttcgcgtccatcgacctgaccgcggaggcgcgtgcttcttcttcccgctctccactgcagtgtcatgaagattgagggaaacttgcatgtttgatatacccagctgctttctgtaacgaaaaactcttgtgatcaaatttgttgaattagtcactgtcagggagggatctacttgtcagttcttggtattaaggctgctggccttcccttgcagggtatctgtagaataaatgggagaagcacactcggatgaattttgccattgccaggggtgtgctggcaagtatgcactactcagagacgaagaaaacccacgattggcaatctttgagaggcggctgccttgctgtggttgtgggataggatggtcttcttttcttttaggtttcttgtgtcctttgatttggtactttgcagccatactttactgctgcaagtactacaacaaggatcctcgagagcgccctggtctagctgcatcagctgttgcggcactcatcttcaca

SEQ ID NO: 57093 - protein, 92 aa, Zea mays
  misc_feature: Ceres CLONE 1502325
MGEAHSDEFCHCQGCAGKYALLRDEENPRLAIFERRLPCCGCGIGWSSFLLGFLCPLIWYFAAILYCCKYYNKDPRERPGLAASAVAALIFT

SEQ ID NO: 57094 - DNA, 703 bp, Zea mays
  misc_feature: Ceres CLONE 1502337
  misc_feature (382)..(382): n is a, c, t, g, unknown, or other
  misc_feature (703)..(703): n is a, c, t, g, unknown, or other
tggagctccccgcggtggcggccgctctataactagtggatcccccgggctgcaggaattcgcacgagaccattacctagaacatcctaatcgaaaatgaatgaaaaaaaaatacaaaaaagaaagatgcagacttgccggactcatatccattattcagtttctctgcggatgagtggcttggatcgcactgtgccatctgcgcgtcgaacagatgcagtgatggatgggcgctcgtcgtcctccagctgtaccgctgtgcgctaggacctgcgtcggctatatacggctgttcggcagtgagctgccaggttgtacagtctgggtaacagcctaacagggtatgcttatacctctcggttttcgttctgtaatagaaacnaattatttgcgcttgccaggacactgtccttcccccgtgtgtatgtttgtagatggttgcacacttggcaaaaaaaaaagtacccctccggaatgtaaatttgtctccttggtaccgccccaaatagccgttggcggaggagcaggagaatcccccgttctccggaacctggaaccttctgaacccctggaaacttttttttgggccccaaaaaaccctcccttgggcctttgccctttcaccccgccgcacatcctacggattttatggctcctttcccttggggcccgcccccttcccccctgaaccccccttcatttn

SEQ ID NO: 57095 - DNA, 661 bp, Zea mays
  misc_feature: Ceres CLONE 1502343
ggagctccccgcggtggcggccgctctagaactagtggatcccccgggctgcaggaattcgcacgagaccattacctagaacatcctaatcgaaaagcttgcttcctctactactctcctccctcttggctcttgcagtgcaggcctctcctccgatccctcccacggtctcaccccaccgcctcgaccacacagctagcttaattagcttgcccctcctcacgctctcctcgcccgaatggggttcacggcgagctataggcggagtagctggccaatgtgcggcggcgacagaggaaaggtgcggctgcggctcgatggaaggcagcacacgcacaggtaggagaagggcgggcgtgcgaccgaccgtgcaccattggctcccactgcctgtcggctgaaactcttctgctcgctcgacccatgagctgagcgcgagggaggaaagacgacgacgcagatggttcgagctagcttccgtgggaaattgaggcttgagggtccggaaatatatataaatatctcttaggtatcttaactagcatgcagctgctttgactaatctaaattttcctagctagctacatcattttcatcttcttctcccccctttcttctctctcgttctcccctgcgcttcttttgtactgccattccgaaa

SEQ ID NO: 57096 - DNA, 686 bp, Zea mays
  misc_feature: Ceres CLONE 1502363
  misc_feature: Encodes the peptide sequence at SEQ ID NO. 57097
  misc_feature (600)..(600): n is a, c, t, g, unknown, or other
  misc_feature (601)..(601): n is a, c, t, g, unknown, or other
  misc_feature (613)..(613): n is a, c, t, g, unknown, or other
  misc_feature (614)..(614): n is a, c, t, g, unknown, or other
aaagctggagctccccgcggtggcggccgctctagaactagtggatcccccgggctgcaggaattcgcacgagaccattacctagaacatcctaatcgaaaatcgcttaaaagctgtagctcacacgagccgtgcgactgcgagcgagggaggtagagaaaaaggggagcccgatccaatcccaatcccctcccgccgcgtcacatcgccgccgtcctcgtgccccgttacctctaaaaccctagcggggagccggggatgaagatccagtgcaacgcgtgcggggccgcggaggcgcgggtgctgtgctgcgcggacgaggccgcgctctgcgtcgcctgcgacgaggaggtgcacgccgccaacaagctcgccgggaagcaccagcgggtgccgctcctgacggacgccgccgccgcagcggcggcagcggcgccggccgtgccccagtgcgacatctgtcaggtcaggcacccaggccccgaggcccgagccctcgtctccgctgcctctctctccattcctgtagctcgattgggttgggagtgagttggagttgtcgcgcggtagctgcctgccaggctggggaatttctactanncgtctgatcccnnagctacaggttagtctcgcctaatgatttggctcgcgaagtgataggcggctgaagcaagctgttgttgatg

SEQ ID NO: 57097 - protein, 96 aa, Zea mays
  misc_feature: Ceres CLONE 1502363
  misc_feature (1)..(47): Pfam Name: zf-B_box Pfam Description: B-box zinc finger
  misc_feature: The sequence is a functional homolog of SEQ ID NO 1023 in the 10/666,642 US patent application
  misc_feature: The sequence is a functional homolog of SEQ ID NO 1645 in the 10/374,780 US patent application
  misc_feature: The sequence is a functional homolog of SEQ ID NO 1671 in the 10/412,699 US patent application
  misc_feature: The sequence is a functional homolog of SEQ ID NO 465 in the 11/479,226 US patent application
  misc_feature: The sequence is a functional homolog of SEQ ID NO 236 in the 10/666,642 US patent application
  misc_feature: The sequence is a functional homolog of SEQ ID NO 908 in the 10/412,699 US patent application
  misc_feature: The sequence is a functional homolog of SEQ ID NO 1478 in the 10/666,642 US patent application
  misc_feature: The sequence is a functional homolog of SEQ ID NO 1890 in the 10/412,699 US patent application
  misc_feature: The sequence is a functional homolog of SEQ ID NO 2148 in the 10/374,780 US patent application
  misc_feature: The sequence is a functional homolog of SEQ ID NO 454 in the 11/435,388 US patent application
  misc_feature: The sequence is a functional homolog of SEQ ID NO 676 in the 10/225,066 US patent application
  misc_feature: The sequence is a functional homolog of SEQ ID NO 234 in the 10/666,642 US patent application
  misc_feature: The sequence is a functional homolog of SEQ ID NO 288 in the 10/374,780 US patent application
  misc_feature: The sequence is a functional homolog of SEQ ID NO 582 in the 10/225,066 US patent application
  misc_feature: The sequence is a functional homolog of SEQ ID NO 662 in the 11/435,388 US patent application
  misc_feature: The sequence is a functional homolog of SEQ ID NO 906 in the 10/412,699 US patent application
MKIQCNACGAAEARVLCCADEAALCVACDEEVHAANKLAGKHQRVPLLTDAAAAAAAAAPAVPQCDICQVRHPGPEARALVSAASLSIPVARLGWE

SEQ ID NO: 57098 - DNA, 682 bp, Zea mays
  misc_feature: Ceres CLONE 1502367
  misc_feature: Encodes the peptide sequence at SEQ ID NO. 57099
tccccgcggtggcggccgctctagaactagtggatcccccgggctgcaggaattcgcacgagaccattacctagaacatcctaatcgaaaaagcaacgtctcgccctcccagctcctcccaccaaacaaactgaaccactgtccgctgcgtgctttccttcctctcaacgccagccttgccgagagcccgagaccaatcgccgccatctcccggaatgacggggtgacgaaaccgcgccgcaccagacaagacagaggagccgccgccgcgacccacaggccaccgggtcgccgaggaggggatccagcgagccatgtcgaccgacgtgcccatgagccccgagctcgagcaggtggacggcgagatccaggacatcttccgcgcgctccagaatgggttccagaagatggacaagatcaaggactccagcaggcagtccaagcagctggaggatctcacggccaagatgagagagtgcaagcgcttgatcaaagagtttgaccgtatactcaaggatgaggagaaaaagaacacccctgatgtcaacaagcagctcaatgacaagaagcagttcatgatcaaagaactcaactcctatgtgaccttgaggaaaacgtaccagagccgccttggtaataagaggatcgaactattcgaatacggtaatgaccaggtggctga

SEQ ID NO: 57099 - protein, 122 aa, Zea mays
  misc_feature: Ceres CLONE 1502367
MSTDVPMSPELEQVDGEIQDIFRALQNGFQKMDKIKDSSRQSKQLEDLTAKMRECKRLIKEFDRILKDEEKKNTPDVNKQLNDKKQFMIKELNSYVTLRKTYQSRLGNKRIELFEYGNDQVA

SEQ ID NO: 57100 - DNA, 828 bp, Zea mays
  misc_feature: Ceres CLONE 1502371
  misc_feature: Encodes the peptide sequence at SEQ ID NO. 57101
  misc_feature (21)..(21): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (700)..(700): n is a, c, t, g, unknown, or other
tgtgggggccccccccccccncaccccccccctcactcggaggctcnnnccccctaagctggagctccccgcggtggcggccgctctagaactagatgatcccccgggctgcaggaattcgcacgagaccattacctagaacatcctatatcgaaaaaaagaaaaacacaagacctctctattcaccatggccgaccgtaagagggttccgaaggcggtggcgccgccggcagccggagccgtgggaaaagaagagctcgcaggcgcccgcaaagcctggagcgtgcggcgccgcaaagttcctcgcggggttgccgtcccgcggaaacttctcttccggctcccgccccctccaatctgggagggttcagggtttacgtctgcgagcccagtacagatccccccgaaggacaagttataaagatgggttctccgagtatttttaacgggggatctccagttgaacatgggggaagaatggagccccccccccccgcgactccagaaattggtcggggtgttaccagctgagggaaaaaaaatactgtctgcccagaacgttggggatgtgccaacaatttgacgtaaagagagggcgtagttggggggagaaatggtgtaggcttcgtccgttcgtgtgaggcaaaaattctctgggctgtgtgcccgagggcactacttgccgctcctgctttgccancgtaaaacaattggttgtgagggtattttaacagttcaaacctacgccctaccccacgcgaccgactaagaatagagtctaaccgcctcgcgctccactataaacggccagtgcgtcaaacgcccgca

SEQ ID NO: 57101 - protein, 77 aa, Zea mays
  misc_feature: Ceres CLONE 1502371
MADRKRVPKAVAPPAAGAVGKEELAGARKAWSVRRRKVPRGVAVPRKLLFRLPPPPIWEGSGFTSASPVQIPPKDKL

SEQ ID NO: 57102 - DNA, 477 bp, Zea mays
  misc_feature: Ceres CLONE 1502387
  misc_feature: Encodes the peptide sequence at SEQ ID NO. 57103
tgggctccccgcggtggcggccgctctagactagtggatcccccgggctgcaggaattcgcacgagaccattacctagaacatcctaatcgaaaaagaagacaatacaaagatgtccaagatggcggaggagaaggcggcggcagtgggcggactcggaggagcccgggggcgcggaacgcgcgcacacacactgcacagggagcgcggcgccggtgcgccttggaacctgctcccgcggcccctgggccctgctggccccattaccccctggtccctaaccccaaaaacaccggtaaggggcccctccccctattccccaccccgggggggggctccaaaaaaccccccccccaaaaccccaaaagggggccccccggggggggggcgcaaataaacccgggggggtgacccccggttttttaaaaacacccggcggggaaaaaaaacccccccccccccccgctgggtgtcgccc

SEQ ID NO: 57103 - protein, 94 aa, Zea mays
  misc_feature: Ceres CLONE 1502387
MSKMAEEKAAAVGGLGGARGRGTRAHTLHRERGAGAPWNLLPRPLGPAGPITPWSLTPKTPVRGPSPYSPPRGGAPKNPPPKTPKGGPPGGGRK

SEQ ID NO: 57104 - DNA, 774 bp, Zea mays
  misc_feature: Ceres CLONE 1502391
  misc_feature: Encodes the peptide sequence at SEQ ID NO. 57105
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (39)..(39): n is a, c, t, g, unknown, or other
  misc_feature (40)..(40): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (713)..(713): n is a, c, t, g, unknown, or other
  misc_feature (765)..(765): n is a, c, t, g, unknown, or other
tataaatcaccacgagtcgacccaacaaacaaaannnanntttnnnnttaaaaactggaactcaccgcggtggcggccgctctagaactagtggatcccccgggctgcaggaattcgcacgagaccattacctagaacatcctaatcgaaaaaacacttttcccgtctcccccttcctcgccgcctccactacagggctttgctcctcccaactctcgaaaccctacccacgcgatgagagatcgatcggtcgagcgcgaattccccagccgcgagcggggggatcggccgccgcccggggtgctgggtcccccgcgccgcgggccggcttacaagacgaagttgtgcgcgctgtggcagcgcggcggctgttcccgcgacacatgcagcttcgcgcacggacacgccgagctccgccggttccccggatcgcgcacctcgttcccaccccgcgccgggagaagagattacacacgcggtgactttagagataggtttgataggaggcgctcacctcataggaggcattcccctgatgggagattccaggggccatcgcctccttcgtgaacgacgaccaaattcccaagaaagggaatctagctattcccggtctcccagtaggaagaacggacatggggcatgataagaaaccctgatggacggagaaaccaaaccccatctaggaagtctccagagtcccccgacaatanatgatggacagaaacaaaaggaaacactcgcttcaagtggtagaatgaacanaaacaggaa

SEQ ID NO: 57105 - protein, 111 aa, Zea mays
  misc_feature: Ceres CLONE 1502391
  misc_feature (33)..(57): Pfam Name: zf-CCCH Pfam Description: Zinc finger C-x8-C-x5-C-x3-H type (and similar)
MRDRSVEREFPSRERGDRPPPGVLGPPRRGPAYKTKLCALWQRGGCSRDTCSFAHGHAELRRFPGSRTSFPPRAGRRDYTRGDFRDRFDRRRSPHRRHSPDGRFQGPSPPS

SEQ ID NO: 57106 - DNA, 756 bp, Zea mays
  misc_feature: Ceres CLONE 1502398
  misc_feature: Encodes the peptide sequence at SEQ ID NO. 57107
  misc_feature (6)..(6): n is a, c, t, g, unknown, or other
  misc_feature (29)..(29): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (115)..(115): n is a, c, t, g, unknown, or other
  misc_feature (158)..(158): n is a, c, t, g, unknown, or other
  misc_feature (430)..(430): n is a, c, t, g, unknown, or other
  misc_feature (607)..(607): n is a, c, t, g, unknown, or other
  misc_feature (656)..(656): n is a, c, t, g, unknown, or other
  misc_feature (658)..(658): n is a, c, t, g, unknown, or other
  misc_feature (659)..(659): n is a, c, t, g, unknown, or other
  misc_feature (694)..(694): n is a, c, t, g, unknown, or other
  misc_feature (695)..(695): n is a, c, t, g, unknown, or other
gggtgncccgacaaccgggatcttatacnacacgnnnacccacccgcatcaaattaaaatattnnnttgttgggaacctcgaatagtggatcccccgcgctcggagaattgcccnatacattaggtagaactcctattcgaaaaaagttccgcgccgncactccccccaacccgaccacgctgcgcctccgcttgacccccagccgagggagagatgggtttgggtacgggcagcttcggcaagcgccggaacaagacgcacacgctctgcatccgctgcggccgccgcagcttccacctccagaagagtacctgctcctcctgcggttaccccgccgcccgcatccgcaagtataactggagtgtgaaagccgtcaggcgcaagacaaccggcaccggaaggatgaggtagatggggcacgtgcctccncgtttcaagagcaacttccgagaagggactgtaccccccccccaacaacagtgctgccgctgccaacaaattccggctgttgcctatcaacactctgatacgcttaagcattggaacattttgccttgagcaggatttttggagctatttagacagcgctccccaacatccccctanttttccgcccccgcaggggaatttccccttgtccccccccccacgcacnannaaaacgaggtttacgcaagaaccggccgaccgttnngagagggggggcccagaagaccgcacttcggggcgtgttcactgagagtcactttttaccc

SEQ ID NO: 57107 - protein, 65 aa, Zea mays
  misc_feature: Ceres CLONE 1502398
  misc_feature (2)..(55): Pfam Name: Ribosomal_L37e Pfam Description: Ribosomal protein L37e
MGLGTGSFGKRRNKTHTLCIRCGRRSFHLQKSTCSSCGYPAARIRKYNWSVKAVRRKTTGTGRMR

SEQ ID NO: 57108 - DNA, 706 bp, Zea mays
  misc_feature: Ceres CLONE 1502399
  misc_feature: Encodes the peptide sequence at SEQ ID NO. 57109
  misc_feature (449)..(449): n is a, c, t, g, unknown, or other
ctggagctccccgcggtggcggccgctctagaactagtggatcccccgggctgcaggaattcgcacgagaccattacctagaacatcctaatcgaaaaagctactgctgctcgcctgcttcgggacggccgattgggtgccggtttgccaaggacatggaggatgcgagcggcagctcgtcgtctccagccgtcctacggaacaagtattgggtcctccgccacggccgcagcgtccccaacgagcgcggtctcatcgtctcatctctggagaacggcacgaagccggagttcgggctggccccgcagggggtcgagcaggcgcgcgcggccggcgaaaagttccggaaggagcttgacgagattggtgtgccggtgggttccgtcaagattcgttactcgccgttctcacggaccaccgagacggctagagtgtttcgccgtgtgctncgcatcccctttgaagctcctagtgcgaagcggtgcctggaatttcgtggacgctactttggggcatcatatgagttacttcccatgataagtttgcaaactttggccagtaaatgaaccccatcccttgattgcctcctgaaggggccaaaaaccccccaaaagttgcctaaaaattttccccgtgggtggtttccgcaaaaacaagtttcatggcctcgaaattctttttggcccccgtggggacccccttaaat

SEQ ID NO: 57109 - protein, 136 aa, Zea mays
  misc_feature: Ceres CLONE 1502399
  misc_feature (17)..(130): Pfam Name: PGAM Pfam Description: Phosphoglycerate mutase family
MEDASGSSSSPAVLRNKYWVLRHGRSVPNERGLIVSSLENGTKPEFGLAPQGVEQARAAGEKFRKELDEIGVPVGSVKIRYSPFSRTTETARVFRRVLRIPFEAPSAKRCLEFRGRYFGASYELLPMISLQTLASK

SEQ ID NO: 57110 - DNA, 872 bp, Zea mays
  misc_feature: Ceres CLONE 1502410
  misc_feature: Encodes the peptide sequence at SEQ ID NO. 57111
  misc_feature (744)..(744): n is a, c, t, g, unknown, or other
tggggcgccctacccaaacgcccgaacacaaaaaaaaagaagaaaccccaaactgagactcaccgcggtggcggccgctcttgaatagtggatcccccgggctgcaggaattcgcacgagaccattacctagaacatcctattcgaaaacgatcgggaccttccctcagccacaggccgacagcccacgccgtcgaacggccggggatccggtacctccgctccgcccccgactccctctcgccggacggctgcagatccggtcaggccgatccgtctcggacccggtggtatcaatggaggaatccactgccggtccttcgatcagaaaagatgcagcagcaacggggcggggtcgggggccgggaggagggaagatgacccggggcctcctcacaagagccgtgaaaaaggaggtgtagaattaaataaacccccgcggaatttaaaaatttttattagaaaatctttattccccccccgccccccattttctctttcaaggaacctgatgggaaaaagccctcaagagcgaagacagctcgatttgtgccatgaaaggggtgaatccttaaaataataaccccagggacgcttaaagaaagggttatctaaatagaagaggttgggggggaaaaaaatgggataaaaccccgaggaaactcagggatctattttatggtggaaaatagaatgttgggggggaatagtagttgttgtacccccgcggtgaatccacgcgganttggaggttgacaaaaaaatcggcggggggtggaaccctccctagtgcgagggtgtgacaaaacaactttaagacgacgagcgcgacctttggactacggcgcactaaacggggacaaacaaacacat

SEQ ID NO: 57111 - protein, 41 aa, Zea mays
  misc_feature: Ceres CLONE 1502410
MEESTAGPSIRKDAAATGRGRGPGGGKMTRGLLTRAVKKEV

SEQ ID NO: 57112 - DNA, 802 bp, Zea mays
  misc_feature: Ceres CLONE 1502412
  misc_feature: Encodes the peptide sequence at SEQ ID NO. 57113
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (481)..(481): n is a, c, t, g, unknown, or other
tttctccccccctcacccccccaaccaggtaggaattatatgnnnnnncaaaactggaactcccctcggtggcgggcgctctatactagtggatcccccgggctgcaggaattcgcacgagaccattacctataacatcctaatcgaaaaaccaaagcaaccatggccttttctgccgccctcacctgggccgccacgcaactcctccgcgggagcctccctcctgcccgcttcgccgctgccgtctcgcctctcacatacagcagcagccgccaactctgcagtacccccatcgccaacgattcctccgccgcaggaccgtgggacgaggccgagacggagatcctccgcgacgtcgagcccattgtgaatatagtctaggacatcatccactcccgcacgtataaaaatggtgaatttttaagcccagatgatgaaaaggttgtaaaaaaaaagcttatttatcatcccccccccgcanaaaaaaagaatggctgcgggccttgacggtataatgggttgacaagcacccctgaactcaagtcaaggaagtcttcttttgtaccttagaaacaaatgggcgaatgggaaggaattttcccagaccaaaaagtgggctccagaggatacccttccagaagaagaaatacctccctattccagaaaaaatttttcgggaaaaatcattccttggttaaaaaggaagattcaaatcctttttcccgtggttaaggaaaaaaaggccaatggcggggataccttttggcctagcaggcaaagatgaaacaggaatacaaaaaaa

SEQ ID NO: 57113 - protein, 72 aa, Zea mays
  misc_feature: Ceres CLONE 1502412
MAFSAALTWAATQLLRGSLPPARFAAAVSPLTYSSSRQLCSTPIANDSSAAGPWDEAETEILRDVEPIVNIV

SEQ ID NO: 57114 - DNA, 616 bp, Zea mays
  misc_feature: Ceres CLONE 1502417
  misc_feature: Translation starting site: 154
  misc_feature (371)..(371): n is a, c, t, g, unknown, or other
  misc_feature (386)..(386): n is a, c, t, g, unknown, or other
tgtggatcccccgggctgcaggaattcgcacgagaccattacctagaacatcctaatcgaaaatacgcgcgaggcacggcacggcacggcacgaccgagctccagtctgcccccgcccccgcccccatccgcacgtccgccttgatccggcaaatggcgtcgccggcgcggcggctcctgcagaccaactccgtgcagtacccgacgctccccgcggccgacccgccgagcgcgctggccgtcgactccgacgtggtggtcatcctcgccgcgctcctctgcgcgctcatctgcgtcgtggggctggcctccgtggcccggtgcgcgcgctcccgcgccgcgcccgccgccgccgccaggagggggctcangaagaaagccctcanggcgctgccgagcctcgcgtacgaggacgccgtggcggcccgggccggggccggtgacggagccggggacggggcggcggaggtcctggcggaatgcgccatctgcctgtcggagtcgcgccacgggaagaagtccgcgtgctgccgcattgcggccacgcttccacgtcgcctggatcgaaacttggttggcggccattcctcctggccctcgtggcgccggggccctg

SEQ ID NO: 57115 - DNA, 877 bp, Zea mays
  misc_feature: Ceres CLONE 1502541
  misc_feature: Encodes the peptide sequence at SEQ ID NO. 57116
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
atcatataccccctcatagnnngaacaaaaaacaaacacaccccccaaaaaacacacaaccaccggtggcggccgctctataactactggatcccccgggctgcaggaattcgcacgagaccattaactagaacatcctaatcgaaaaacaacaaaatccccgtcttctgtgactggctggctaggtatagctaggtaaccgtgcgtgcatgatcgagcagggcaagaagccgacgacgacaatgtccggctgcgggtcggcggccgaatcgcctgccaactcgtgcgtgtcgtcggacgcggaggacgaggtacagcaggcggtggcacctaagcctatggcggtggtggggtgcccgcaagtgcctcatgcacccgatggtgtcaggagaggagaagcaacccaagttgcccggggggggaaaaagcccagtagatgctgaaatatcttcgcggggggtaagggcagcccccgggccccagagtggggggggaggggggccccccacatttatgaccaatagacctcatttaagagcaagcgcctacagctatcaccaacccgggggggatttaaagagtaaattaaagtcggcgactggcgcatttttaaaaaaaaggcgcctcgccaactaagtttcgaggggggggtctcccgccccaatggcttgggagtccaaaaaactgtttttttcccgacgggtaatatagaagacatagggtaaagaacccgcaaccaggtaggtaaccgtccctagttttgttcttcgccacgcgcaatgccctaagaccaccaaagatatagtttaacctgttggaaaattcataggccacaactatttttaaccgcgggtcaggggtggtttttgtccactac

SEQ ID NO: 57116 - protein, 77 aa, Zea mays
  misc_feature: Ceres CLONE 1502541
MIEQGKKPTTTMSGCGSAAESPANSCVSSDAEDEVQQAVAPKPMAVVGCPQVPHAPDGVRRGEATQVARGGKKPSRC

SEQ ID NO: 57117 - DNA, 701 bp, Zea mays
  misc_feature: Ceres CLONE 1502547
  misc_feature: Encodes the peptide sequence at SEQ ID NO. 57118
  misc_feature (352)..(352): n is a, c, t, g, unknown, or other
  misc_feature (375)..(375): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
tggagctccccgcggtggcggccgctctagaactagtggatcccccgggctgcaggaattcgcacgagaccattacctagaacatcctaatcgaaaaattccactagattaccaccacctccacctcgtcgtctcccaccaccgccgagcgcgagccctagcccgatctagccggcggcaggcaccagatcccgccgcccgcggcgtcccgggacgcgccccgccgaatccgccgctcctcgcactgcaacacgcccggaccacggtgcatttgatccgtcccggccgcctacacgatggtccagtcgggagcgctggatcttgcttctggcctcggagggaagatcaacanggtggaggtcaagtccgcccccnatgagtatgagaatatcatggatactatggcacgcaggagggagcagggagtcccactatactgagattggtaataaaaactatgatcttgcccctagcttcctaggaaaatgggtggggggaaatctttcccctttgtccccgatgggatgggaaatcctttcctggaaacctttccgggactgggnnnnaaatcttgcctggaatttcggtgaacccgaatgaagggttttaaaaggggggcttggggaaaaaggggccccctcgaaaaaattcgaaaattaccccctttcccccccccgggttgaaaaccccaaccccctttt

SEQ ID NO: 57118 - protein, 47 aa, Zea mays
  misc_feature: Ceres CLONE 1502547
  misc_feature (19)..(19): Xaa is any aa, unknown, or other
  misc_feature (27)..(27): Xaa is any aa, unknown, or other
MVQSGALDLASGLGGKINXVEVKSAPXEYENIMDTMARRREQGVPLY

SEQ ID NO: 57119 - DNA, 738 bp, Zea mays
  misc_feature: Ceres CLONE 1502551
  misc_feature: Encodes the peptide sequence at SEQ ID NO. 57120
ggagctccccgcggtggcggccgctctagaactagtggatcccccgggctgcaggaattcgcacgagaccattacctagaacatcctaatcgaaaaaagatccaagaactcgctcgcgcgcacggacagggccggaacccagggatcgagactgaacagcagtccgagacgccatgaacgtggaggaggaggtcgggaggctcaaggaggagatccataggctcggccagcagcagcccgatggctcttacaaggtcaagtttggcgttctcttcaacgacgatcggtgtgcaaatatctttgaagcactagttggcaccttgagggccgccaagaagaggaagatcttgacctacgaaggcgagctgcttctgcaaggtgtccatgacaacgtggagataaccctgttgcccccacctgcagttgctgccgcttgaagcgaagagcaaccccagttctcgattcctaccactcgaatggctgaattctgcccgggcctaaataaaatccctcgaaccatttggggttccttgaaaactggtaccgggggatgaaggaaattggggggcccaaaaattgcctctgctgcaaaggggtgcggtgcttaaaaaaatcccaggtgggaaaacccttccggccaaaaaaaaaaaaaaaggtttttcgaaccccgccccccccgggggggccccgaaacccatttccctttaaggggggccttattccccccccccccgcccc

SEQ ID NO: 57120 - protein, 87 aa, Zea mays; identical to SEQ ID NO: 46334
  misc_feature: Ceres CLONE 1502551

SEQ ID NO: 57121 - DNA, 754 bp, Zea mays
  misc_feature: Ceres CLONE 1502554
  misc_feature: Encodes the peptide sequence at SEQ ID NO. 57122
  misc_feature (395)..(395): n is a, c, t, g, unknown, or other
  misc_feature (412)..(412): n is a, c, t, g, unknown, or other
  misc_feature (414)..(414): n is a, c, t, g, unknown, or other
ctggagctccccgcggtggcggccgctctagaactagtggatcccccgggctgcaggaattcgcacgagaccattacctagaacatcctaatcgaaaaacttcacgtatcgtctctctctcacacggtcacaccctgacctcccccctccccctcccagaaaagacccctcgaaaaacggcggcgctgcgacatggcggaggtcgaggctccagctactgcggtcgaggctccagctgctgcggtcgcgacgacgacccctgaggtggcggcgcccgaggccggagccgctacggaggcgaagggtcccgcacagcttcaccggcagtggaccttctggtacgacatccagacgaagaccagtccggggctgcgtgggggactccctcaaaaggnctaaactttcgacacgntnaaggattctgggacatgtatgatcaaatttttcctccagccgtttgctggggaatgtctattttcctctttctagggggtgggtaacccaaaggggaaaacccaaaggggcaatggggggaaaagggattgcccctggacaaaaaggcgccctttgaaaccctggggtttaaacctttagggcttttttggggggaattttttttaaacaacaaattttttggaaatttcccaccgccccccccaaaaaaaaaaacgttttttttaaaaaaacaccgcgccagagggccgcccaaaaatatttaaaaaagagggaggttttctccccctccccccccccc

SEQ ID NO: 57122 - protein, 67 aa, Zea mays
  misc_feature: Ceres CLONE 1502554
MAEVEAPATAVEAPAAAVATTTPEVAAPEAGAATEAKGPAQLHRQWTFWYDIQTKTSPGLRGGLPQK

SEQ ID NO: 57123 - DNA, 824 bp, Zea mays
  misc_feature: Ceres CLONE 1502561
  misc_feature: Encodes the peptide sequence at SEQ ID NO. 57124
  misc_feature (35)..(35): n is a, c, t, g, unknown, or other
gtcatattcccccacttccccccaacacacacggnaaaccccacaccaaaaaaaaagctttcatcgacgagggcgccactttaataatggatccccccccctgctggaattcgcccgagagcattacctataacgtcctattcgaaaacagagtccagaccatatcctgcagccttccatccacgaactcccgttctccatttccatacatggcggtgtcgatcgagctcaccaaggagtactgctacctcgtgctggtgctggcggcctatgtcttcttcccctttggatgggcttccagcgtcggcaaggcccgcagaaagtacaaggtgttctaccccaccatgtacgccatctagtccgagaacaaggacgccaagctcttccactgcgtgcagagggggcaccataactctctagagtgaatgcccgttttcttcatcatactgctgcatggggggtccaacccgttgctgacatcgccgccgggtctgggcggcatccacattcatcatgaggattcttctacgccaaggggatatcccaccggcgtttccccgaagaacgggtcttcagaatttggcgggggctccactaaccttgggcggttacttggggttttgctccttatgcagcaggcatttttttcggcaatttaacctgcatccttcacgggaaaaagcctcccctatatttgggggtcttattttgttaagcatcccgtccctcgctatccacccccccgcataagttaacgtccttgggtccttaagccttctcaaaacttatgcgccgaatacttacgggcgtattctgcgccgtct

SEQ ID NO: 57124 - protein, 49 aa, Zea mays
  misc_feature: Ceres CLONE 1502561
  misc_feature: SWISSPROT Homolog: EC 2.5.1.18 Glutathione transferase
MAVSIELTKEYCYLVLVLAAYVFFPFGWASSVGKARRKYKVFYPTMYAI

SEQ ID NO: 57125 - DNA, 750 bp, Zea mays
  misc_feature: Ceres CLONE 1502565
  misc_feature: Encodes the peptide sequence at SEQ ID NO. 57126
  misc_feature (694)..(694): n is a, c, t, g, unknown, or other
ggagctccccgcggtggcggccgctctagaactagtggatcccccgggctgcaggaattcgcacgagaccattacctagaacatcctaatcgaaaacccaaagagcacgcagcgcagcactgaagcaccacttcctgcactcactgctagctgctcacaccgtgctagtaacagtccatcaccagtcaccactaatggctcccaaggttgcgctcttccttgccctcggccttctcttcgctgccgccgcgaatggctgcgaaccctactgtcccggcccagtcgtcccaacgccgccagtcgtgccgacgccgtcgtcgcacagccacggccgctgcccgatcgacgcgctcaaactcaaggtgtgcgccaacgtgctaggcctcgtcaaggtcggcctgccccagcacgagcaatgctgcccactgctggaggggctggtggacctcgatgtcgcactgtgcctctgcaaccgcatcaaggcaacgttctcgggatccacctcaatatgccccttagcctaaacttaatcctaaaaatgtggggaaaaattgcccgaagaactcccctgccccccttaattggctgaaaatggaaaaaaaccccttccccgggagggccccctaaatttcaaccccccgatctaaatggaacttgaccccccccgggttttcctttttttttttttcccccntttttcaaaaaaaaaaaaaaattttttaaaccccccccccgggaggggcccccacc

SEQ ID NO: 57126 - protein, 109 aa, Zea mays
  misc_feature: Ceres CLONE 1502565
MAPKVALFLALGLLFAAAANGCEPYCPGPVVPTPPVVPTPSSHSHGRCPIDALKLKVCANVLGLVKVGLPQHEQCCPLLEGLVDLDVALCLCNRIKATFSGSTSICPLA

SEQ ID NO: 57127 - DNA, 741 bp, Zea mays
  misc_feature: Ceres CLONE 1502568
  misc_feature: Encodes the peptide sequence at SEQ ID NO. 57128
ggagctccccgcggtggcggccgctctagaactagtggatcccccgggctgcaggaattcgcacgagaccattacctagaacatcctaatcgaaaaaaggccgcaacgcctccgctttcattcttcttctcttttctcgttccccccgttggggttttgagctccgacgaaccctaataatcgccggggaccggcgaccgatcgcccgccggcatgcaccattagcagcggatgaagcaggcagcggcggccgcggccgcggcgcagcaggcactgctcctgcagcagcagtcgcagccgcccttgttccccgtgcaccacccgcaccccggcctcctcgccgcaccacagatagagcccatagtcagtggaaacctgcctcctggggtttgatcaagtacatgtcgcaccccccatgtttgcaatatccatctttcagtgaccgacgcagtactgcaggaagtcttccaaagctttgttcccgtaaaaaggttgcaagctcttccgaaagaaaaagcctcccttggggttccttggactaccctgaaccccaaattggtggcctaaccaatttattcttctatgggcaaaaaactggatgggccccccaataaagaccaatggggcattatcaaattcccccgagggggggccccccggggccttttaaatattttgggggggaattttttcccgggagatcccgggaggcccctttggtgggcattttttctcggggac

SEQ ID NO: 57128 - protein, 53 aa, Zea mays
  misc_feature: Ceres CLONE 1502568
MKQAAAAAAAAQQALLLQQQSQPPLFPVHHPHPGLLAAPQIEPIVSGNLPPGV

SEQ ID NO: 57129 - DNA, 867 bp, Zea mays
  misc_feature: Ceres CLONE 1502571
  misc_feature: Encodes the peptide sequence at SEQ ID NO. 57130
  misc_feature (737)..(737): n is a, c, t, g, unknown, or other
  misc_feature (776)..(776): n is a, c, t, g, unknown, or other
gggccccccgccgccggggcgtaacgcgttaccgtggggggatcgccctttaaaattggagctccccggggtggcggccgctctatactggtggatcccccgggctgcaggaagtcgcaagagaccattacctagaacatcctaatcgaaaaaaggagccctcagccagctaagccgacgcggccggcccggtcggagacgccgccgccgccgacaccgcggccggtggaaggaccgtggtaagcggaatcatggaagcaggcgcgctggcgctggggcgcgacggactgctcgccgaggaacggcgcgcgggagagggtggccgctggcgcctgccgagaacgagatggatgccgcggttacgagcgtgaagattacatatcaactacacgtaagaagcatccggtgctccgggtttgggcagagtacatccacgccccagattgacggaagggaggcgggggaggaaggggcccccaacccttctaggacactccggggaggggcggagaactgaagcgaacccgtgacaaaacagggatttgggggttgccgggcgctcccgtgacggaataagagatgctgcggctgaggggagctctttgcccacgggataggtccttcccgggagaggcgcaccatgatagtgtacagggttactaattaacctgcgcccgtagcagaggcgggggggggttaaaaagcgcgggctcggagcttggcggccggggacaaanggacagaggagaagtcgaaagggccgttcagcagcctcnagggggtgaagtacgacgcgcgccggccatttgtttccttattcgcgcgcgcgcccaataaaaacgccggcctacccccaggagtaccgct

SEQ ID NO: 57130 - protein, 39 aa, Zea mays
  misc_feature: Ceres CLONE 1502571
MEAGALALGRDGLLAEERRAGEGGRWRLPRTRWMPRLRA

SEQ ID NO: 57131 - DNA, 716 bp, Zea mays
  misc_feature: Ceres CLONE 1502576
  misc_feature: Encodes the peptide sequence at SEQ ID NO. 57132
  misc_feature (663)..(663): n is a, c, t, g, unknown, or other
ggagctccccgcggtggcggccgctctagaactagtggatcccccgggctgcaggaattcgcacgagaccattacctagaacatcctaatcgaaaaacacaggaaaagaaagggcatatcgaggaggtttttagggtggtggtggtgttgtgaggagctgctgccgctgctctccagtctccaccgatggcgatcaagaacatgacggtggcggcgacgacgcggtcgctggacgcggacatgacggtggacgagttcaaggagtggctgcggcggttcgacacggaccaggacgggcgcatcagccgcgacgagctgtggcgcgctctgcgtgccatccgctcccggttcacggggtggaggagcaggcagggcatcagttatgccgacactgacggcgacggctacatcgacgacagcgaggtcgatggcctcatcgagttcgcgcagaagaacctcggcctcaagatcgtcgcctactgatctcacatggggcgcggcgcgcggcggtcgggggggtgggacgcactagctcgccatgagctagctatagcgacaatgcaactcaccatcactctctccggctaaaataagagctgcttgatctatcatcgcttgtctgttaaaattgctttccatgtacttagtcaattcaagttcggnatcacgcactacctctctacgctgttggtgtgggatttaagaaggggtgtatg

SEQ ID NO: 57132 - protein, 98 aa, Zea mays
  misc_feature: Ceres CLONE 1502576
  misc_feature (23)..(51): Pfam Name: efhand Pfam Description: EF hand
  misc_feature: SWISSPROT Homolog: EC 2.7.11.1 Non-specific serine/threonine protein kinase
MAIKNMTVAATTRSLDADMTVDEFKEWLRRFDTDQDGRISRDELWRALRAIRSRFTGWRSRQGISYADTDGDGYIDDSEVDGLIEFAQKNLGLKIVAY

SEQ ID NO: 57133 - DNA, 713 bp, Zea mays
  misc_feature: Ceres CLONE 1502585
  misc_feature: Encodes the peptide sequence at SEQ ID NO. 57134
ccccgcggtggcggccgctctattaactagtggatcccccgggctgcaggaattcgcacgagaccattacctagaacatcctaatcgaaaaaggcccaccgctagtcatccgcagttcccccgcgcccgagacgcaaccccgcgccaggagtaaggttgttcttttatcgatattatcgatatggcgagggaggagaatgtctacatggtccagctggttgaccacgtccaccggtatgaagagatggttgagtatatggagaaggtggctaagactgtagatgtggaagagctcactgttgaggagcgtaacctcttgtcggtcgcatacaagaatgtgattggggctcgccgtgcttcatggcgcattgtctcttctattgaacagaaggaggagtcccgtaagaacgaacagcatgtgaaccttatcaaggaataccgtgcgaagatcgaggctgaactgagcaatatctgtgatggcatcctgaagctgcttgactcccacctagtgccttcttctactgctgctgaatcaaaggtcttctacctcaagatgaagggtgactatcacaggtatcttgcggaatttaagactggtcctgagaggaaggaatctgctgagagcacgatgatggcctacaaggctgctcaggacattgcgctggctgagctggcacctacccatccgaataggcttggggcttgctcttaac

SEQ ID NO: 57134 - protein, 176 aa, Zea mays
  misc_feature: Ceres CLONE 1502585
  misc_feature (3)..(177): Pfam Name: 14-3-3 Pfam Description: 14-3-3 protein
MAREENVYMVQLVDHVHRYEEMVEYMEKVAKTVDVEELTVEERNLLSVAYKNVIGARRASWRIVSSIEQKEESRKNEQHVNLIKEYRAKIEAELSNICDGILKLLDSHLVPSSTAAESKVFYLKMKGDYHRYLAEFKTGPERKESAESTMMAYKAAQDIALAELAPTHPNRLGACS

SEQ ID NO: 57135 - DNA, 871 bp, Zea mays
  misc_feature: Ceres CLONE 1502586
  misc_feature: Encodes the peptide sequence at SEQ ID NO. 57136
ggacgccccccccgcgtgttttatttttcttcccccacccacccccccacaaaaatggaactcccccccaaggaggacgctctttaacagatgaatcccccggcctgcgggagttcgcacgagaacattacctaaaaatcctaatcgaaaacttctggcgaccaaattctgccgtctccaccgccgccgcagccagcgtcaccggagggatctgccgtctcccttgctccacgcgatgaacaccgacatcaccgcctcaactaaacccgagtacccggtggtggatcggaacccggccttcaccacggtggtcggcaacttctctgcgctcgactacgtgcgcctctccaccatctctcccgtctccgacaccgcttggttacttctccggaatcaaaccagggatcccagggcccgtcagagggcccacctctatcgttttcaatagaaatgggaaggaattaaagtggcccaccccccaaaaaccggggcggggggaacaaatgggtgatctccttcggcaaagaacctccccacgtttgaccgccttaaaaataatataacgccctccgctgcagggattctctgctttccctttttccggccgtcacattttcttttcgcccgggttttacccccctggagcgctttttagatgaagggacgttgtataacatatccataacgccgccttaaatgtactcattaccccgagaacctctcgatttacactaccacctcggatacaccccccttaaatataaaccggcaaagcgccatgtattttaccgcccgcccctctctacgcctttctggggggagcaaccaccaactatccatttcaccccacaaactgtcgcgttgccaggat

SEQ ID NO: 57136 - protein, 70 aa, Zea mays
  misc_feature: Ceres CLONE 1502586
MNTDITASTKPEYPVVDRNPAFTTVVGNFSALDYVRLSTISPVSDTAWLLLRNQTRDPRARQRAHLYRFQ

SEQ ID NO: 57137 - DNA, 718 bp, Zea mays
  misc_feature: Ceres CLONE 1502590
  misc_feature: Encodes the peptide sequence at SEQ ID NO. 57138
  misc_feature (415)..(415): n is a, c, t, g, unknown, or other
  misc_feature (659)..(659): n is a, c, t, g, unknown, or other
ggagctccccgcggtggcggccgctctagaactagtggatcccccgggctgcaggaattcgcacgagaccattacctagaacatcctaatcgaaaaaattccccattccccatctccctccctcaccatggccgccgccgccgccgcttccatggcccgcaggctgctctcccccaccaccaccacctcctactcgaccaccgcccgcctcctcatctcccgccgcctcgcctccgccgcgtccgtcccgcgcgccccggcggcggcggcgaaggagatgctgcgcccggcggccgtcgcctcctcctctctattcttccgcggcgtcgggggcgccaggggcatggcgcggcggcccgggggcggcgacgggtacgcccccgcgcggggcgggggcggagggggcgcgcccacngagatggcgccgctgttccccgggtgcgactacgagcactggctgatcgtcatggacaagcccggcggcgagggcgcctccaagcaccagatgatcgactgctacgtccacaccctcgcccaaggtcctcggcagcgaggaggaggccaagaggaagatttacaacgtctcgtgcgagcgctacttcggggtcgggtgcgagatcgacgaggagacatccaacaagcttgaagggattcctggngttctctttgagctccctgattcctatgttgaccctgaacacaaggactacggagcgga

SEQ ID NO: 57138 - protein, 172 aa, Zea mays
  misc_feature: Ceres CLONE 1502590
MAAAAAASMARRLLSPTTTTSYSTTARLLISRRLASAASVPRAPAAAAKEMLRPAAVASSSLFFRGVGGARGMARRPGGGDGYAPARGGGGGGAPTEMAPLFPGCDYEHWLIVMDKPGGEGASKHQMIDCYVHTLAQGPRQRGGGQEEDLQRLVRALLRGRVRDRRGDIQQA

SEQ ID NO: 57139 - DNA, 705 bp, Zea mays
  misc_feature: Ceres CLONE 1502591
  misc_feature: Encodes the peptide sequence at SEQ ID NO. 57140
  misc_feature (472)..(472): n is a, c, t, g, unknown, or other
  misc_feature (485)..(485): n is a, c, t, g, unknown, or other
  misc_feature (705)..(705): n is a, c, t, g, unknown, or other
tccccgcggtggcggccgctctagaactagtggatcccccgggctgcaggaattcgcacgagaccattacctagaacatcctaatcgaaaagactagtcggactcgcagctccgccccaagtccaggtcgaagcatggaagtcgcggcggcgtcggcgaggcccgtcctgcgcgtggctgccatctgcggctccctccgcaaggcctccttcaaccgcggcctcctccgcgccgccgcggaggtgtgcgaggactccatcccggggctccgcatcgacgagctcgacatctccgacctgcccatcatcaacaccgacctcgagaccggcagcggcagcagcaccgtcttcccgcccgccgtcgaggccttccgcgccaaggtctgccaggccgactgcttccctctcggcgcgcccgagtacaactactccatcgccacctcgctgaagaacgcacttgactgggcctctanaggaaagactgtngggcagacaaacctgctgccatcgtgagtgcaggcggtgggctttggaggagggaggtcccagtaccatcttcgtccaggtggggtttttcctggatcttcatttcctcaacaagcccaaactggtggttccaagccttccagcagccccccaagttttgacggcaatgggaaatcttggtcaatgctgaaactccagaaggggcttccaaaaaaggctn

SEQ ID NO: 57140 - protein, 125 aa, Zea mays
  misc_feature: Ceres CLONE 1502591
  misc_feature (12)..(124): Pfam Name: FMN_red Pfam Description: NADPH-dependent FMN reductase
  misc_feature: SWISSPROT Homolog: EC 1.6.5.2 NAD(P)H dehydrogenase (quinone)
  misc_feature (113)..(113): Xaa is any aa, unknown, or other
MEVAAASARPVLRVAAICGSLRKASFNRGLLRAAAEVCEDSIPGLRIDELDISDLPIINTDLETGSGSSTVFPPAVEAFRAKVCQADCFPLGAPEYNYSIATSLKNALDWASXGKTVGQTNLLPS

SEQ ID NO: 57141 - DNA, 704 bp, Zea mays
  misc_feature: Ceres CLONE 1502592
  misc_feature: Encodes the peptide sequence at SEQ ID NO. 57142
  misc_feature (598)..(598): n is a, c, t, g, unknown, or other
  misc_feature (671)..(671): n is a, c, t, g, unknown, or other
ccccgcggtggcggccgctctagaactagtggatcccccgggctgcaggaattcgcacgagaccattacctagaacatcctaatcgaaaaatcacatgccgctgatgcttcgcgtctcctactccttcctgcttccacctattaatccaccccactctcttccctccccgttccacccgcctctaccgccgcgagatccggctccgcttccagaagcttctggaacgcccgttccatgagcgtctgatcggccgccgccatgggctgcgctggatccacccccaaagtcgacgagaacagcaagaaactgaaaaggcctaaggcttggaagcatacccaaccaattacaccggcacggctgaaacagatgcgtgatgagttctgggacacggctccgcactacggaggccaaaaagagatctgggatgctctgagggttgccgcggagtccgatctagcccttgcacagaccatcgtggacagtgctggaatcatcgtgtcgaaccctgacatgacgctctgctacgacgagagaggcgccaagtacgagctgcccaagtatgtcttgagcgagccagcgaacctgatccgcgacggntgaatctggaccccaaaggttttgcagcagcccgaaacaggggcccgtgaatttatgcgaaaggtaaatccgnccctggttctggattgaactttccgggaaggga

SEQ ID NO: 57142 - protein, 113 aa, Zea mays
  misc_feature: Ceres CLONE 1502592
MGCAGSTPKVDENSKKLKRPKAWKHTQPITPARLKQMRDEFWDTAPHYGGQKEIWDALRVAAESDLALAQTIVDSAGIIVSNPDMTLCYDERGAKYELPKYVLSEPANLIRDG

SEQ ID NO: 57143 - DNA, 801 bp, Zea mays
  misc_feature: Ceres CLONE 1502599
  misc_feature: Encodes the peptide sequence at SEQ ID NO. 57144
gtcctcccctcttccctttatttttatacattttccctaaacccccccaaagctgggactccccgcggtggcggccgctctatactagtggatcccccgggctgcaggaattcgcacgagaccattacctagaacatcctaatcgaaaaaaacctatttatattctgtccttaattcccgtgtttctcgtccgtctccgctcctccgcaaccccttcccctcctccgccgaagcctctcctccggccgccgaaaccctagcctccgccgctgccgtcatggcaagcagcaacgtctcgaccgtttacatctctgtcattgatgacgtcatctccaaggtccgcgaggatttcatcacctacggagtcggtgacgccgtcctaaacgagctccaggctctctgggagatgaaaatgctacactgtggagcgatctcggggaacatagaccgaaccaaggctgatgccgcccccctccgaggcaccacccggcacgacaccgcccgtgcacgacctgaacgtgccgtacgaggccacatctgaggagaacgccaccccgaccgctgatatgttgttcccgcccgacccattgcagacccccattcccgactcctctgccagggacagacacagcgaatgtacaacatacccaactggcccttcccgattatggcctcctcacccgatcagcgaatgtccggaaatggaatgcccataaaagggggcaagaacccaccaagctgggtcatcccaaatctctttaatgcccaccaccgttcccccttgggaggaaattcaaaggc

SEQ ID NO: 57144 - protein, 87 aa, Zea mays
  misc_feature: Ceres CLONE 1502599
MASSNVSTVYISVIDDVISKVREDFITYGVGDAVLNELQALWEMKMLHCGAISGNIDRTKADAAPLRGTTRHDTARARPERAVRGHI

SEQ ID NO: 57145 - DNA, 716 bp, Zea mays
  misc_feature: Ceres CLONE 1502602
  misc_feature: Encodes the peptide sequence at SEQ ID NO. 57146
  misc_feature (470)..(470): n is a, c, t, g, unknown, or other
  misc_feature (473)..(473): n is a, c, t, g, unknown, or other
  misc_feature (488)..(488): n is a, c, t, g, unknown, or other
  misc_feature (514)..(514): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
tggagctccccgcggtggcggccgctctagaactagtggatcccccgggctgcaggaattcgcacgagaccattacctagaacatcctaatcgaaaaaggtttctacccctcatcggtcctcgctccacggccatggtgaggatgaagcaggtaaagatctcggtaaagaaggacgtggattcgtacacaatccgcggcactaacaaggtcgtccatgtgggcgactgcgtgctgatgcgggcgtcggactcggacaagcagccgtatgtggcgcgggtggagaagatggaggccgacggacgcggcagcgtgcgggtgcaggtgcgctggtactaccgccctgaggaatccaagggcggtcgccggcagttccacggcgccaaggagcttttcctttccgatcatttcgacctacagagcgcctacaccatcgaggggaaaatgtgtgtccactcttttcagaactacnacnagcttgataatgtcnggcctgaggacttcttctcccgattngagtacaaggcggccacggnnntcgtcaccctgaccgcgtgccattgtatgcaaatgtgaaattgcatacaccccggaagaactcatgggcaaggcaaaccttgcaaggatggtcccatcatcttggagggttggacctttgaacaggcaaaaaactaaaatcctttttttggccaacttgttaaaaaaaatggttcaaaaa

SEQ ID NO: 57146 - protein, 146 aa, Zea mays
  misc_feature: Ceres CLONE 1502602
  misc_feature (25)..(137): Pfam Name: BAH Pfam Description: BAH domain
  misc_feature (113)..(113): Xaa is any aa, unknown, or other
  misc_feature (114)..(114): Xaa is any aa, unknown, or other
  misc_feature (119)..(119): Xaa is any aa, unknown, or other
  misc_feature (127)..(127): Xaa is any aa, unknown, or other
  misc_feature (134)..(134): Xaa is any aa, unknown, or other
  misc_feature (135)..(135): Xaa is any aa, unknown, or other
MVRMKQVKISVKKDVDSYTIRGTNKVVHVGDCVLMRASDSDKQPYVARVEKMEADGRGSVRVQVRWYYRPEESKGGRRQFHGAKELFLSDHFDLQSAYTIEGKMCVHSFQNYXXLDNVXPEDFFSRXEYKAATXXVTLTACHCMQM

SEQ ID NO: 57147 - DNA, 703 bp, Zea mays
  misc_feature: Ceres CLONE 1502603
  misc_feature: Encodes the peptide sequence at SEQ ID NO. 57148
  misc_feature (703)..(703): n is a, c, t, g, unknown, or other
tccccgcggtggcggccgctctagaactagtggatcccccgggctgcaggaattcgcacgagaccattacctagaacatcctaatcgaaaagaaccaaggttgcgtctcgaaggttcttgcctcgttgggaagggatggcgtcggaggtggaggacgaggcggcgacgccgctgctcgccaacggtgcagccgacgtccgccggaggagggaccaggcgaaggcaattctgtccacgcaggccgtcaggatcgccaccaaggccgagcagcatgagcgcttcatctttaaggtcacacacttgctgggtgttcttggatttgggggattttgctatctcttgggtgccagaccacaggatgtgccatatgtgtactgcctgttctatgtcatatttgttccgctccgctggatttactaccgctacaagaaatggcattactaccttctggacttctgctactatgccaacacctttctccttgtaatgattctcttctacccagaggatgaaaaactttttatggtttgcttctcgtttgcagagggtccgcttgcttgggcattatttgtgtggcgttgcaccttggttttcagttcatttgccaaacttggtagggtcctgatccatctcttaccggggaatggtcccttccctatcccggggtgggaatccacaaacttttggtgccgtggccccagan

SEQ ID NO: 57148 - protein, 189 aa, Zea mays
  misc_feature: Ceres CLONE 1502603
MASEVEDEAATPLLANGAADVRRRRDQAKAILSTQAVRIATKAEQHERFIFKVTHLLGVLGFGGFCYLLGARPQDVPYVYCLFYVIFVPLRWIYYRYKKWHYYLLDFCYYANTFLLVMILFYPEDEKLFMVCFSFAEGPLAWALFVWRCTLVFSSFAKLGRVLIHLLPGNGPFPIPGWESTNFWCRGPR

SEQ ID NO: 57149 - DNA, 898 bp, Zea mays
  misc_feature: Ceres CLONE 1502607
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (49)..(49): n is a, c, t, g, unknown, or other
  misc_feature (898)..(898): n is a, c, t, g, unknown, or other
taacttctctcttgcacccccaaaattcaaaaccannnaatatcccccncaaaactggagctccccgcggtggcggccgctctagaactagtggatcccccgggctgcaggaattcgcacgagaccattacctagaacatcctaatcgaaaaaggcatgagcacccctctcctccgccgtcccatggccgcgccctgttcctgggacacttccttccacgaaaaaaagcagcagcagcagcataagctctagctacctctactaccgacctggatccactcaacccgctacgctaagctcccctttcccgttcgacaagagaagagaagaggttattcatccatctgcgctgcatcctgccaagaatgagaaggaggagacagggcgcttgacatgggccagtacgtggagctgctggaattgggagagaacaacccccgcgcgctttaaaatacaaatggcccgaaaaacacccccccctcccaaaacaactcgacccgaccgcgggcctgggcggcccttataggcaacgcccccaagggggaataataccgtctatcggacggcatgtcgctcatcacacctattctatatccaattaaaaactggggagatcccgggttaacataacctcctttatagaaataatccccctcaccaagcgtttattttttaacccccaactattcctctaatcgccgcccgcctttaatattaagccattccggaatataacccggcgcggataattatccgcaccgccatacaacacttcttatatatcgcgagagaagaaacaaagcgctagttatcaactaatgatcgcgcccgccgccgattaatatcaaaatccccccgcctataaatgttttatttcacgcccgccgccctaaccccn

SEQ ID NO: 57150 - DNA, 765 bp, Zea mays
  misc_feature: Ceres CLONE 1503085
  misc_feature: Encodes the peptide sequence at SEQ ID NO. 57151
aaagctggagctccccgcggtggcggccgctctagaactagtggatcccccgggctgcaggaattcgtctcacccctagaaaaaagcctcatcacagtcatccacactaactaacgatctgaggtccacgacaactgatcgagcagctactatggctgatgtgctcatcagcgggaagacgccccacgtggttgccgtgctggtggcggcggcgctgctggcgtcgtccgattcggcggccatcacctgtgagcaggtgggggcgtccctcgctccgtgcatcccgtacgcgacgggaaggggcagcgcgctctccgcatcttgctgcaacggcgtcaaagcctccaccgcgcggcgcctattttttccccccccccagggggggggggggctggctcattatcctctcccaataccgtcccgatgcgttcctcattggggcaccgctctgcccctcctccccccggcgaggttctggccgtctccctctcggtattccccccattctagattgttcccccccgaactggcctccaaggcacccaacctaacttttttacctaccgacccctgcctaatattgcctctaccctgagaggtatcactggatcgtcccgccgccccgtttcaccttgttggatgcttccccctccgtcaagttaggttgtcttctatttcctacttgtgttgtctcctcgagtgttacggtgtttgatgttttctttgccaacatcaatagcgcttgtcaccttggccattcttcta

SEQ ID NO: 57151 - protein, 147 aa, Zea mays
  misc_feature: Ceres CLONE 1503085
MADVLISGKTPHVVAVLVAAALLASSDSAAITCEQVGASLAPCIPYATGRGSALSASCCNGVKASTARRLFFPPPQGGGGLAHYPLPIPSRCVPHWGTALPLLPPARFWPSPSRYSPHSRLFPPELASKAPNLTFLPTDPCLILPLP

SEQ ID NO: 57152 - DNA, 770 bp, Zea mays
  misc_feature: Ceres CLONE 1503086
  misc_feature: Encodes the peptide sequence at SEQ ID NO. 57153
  misc_feature (189)..(189): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
atagctggagctccccgcggtggcggccgctctagaactagtggatcccccgggctgcaggaattcgtctcacccctagaaaaagactcggctcccctcctccgccgtcgccggaggcgaagcaagtggggaccacagaagcattagctgggtgaacccactcaaagggggcagggaattgtgtgctantttgaatggctgctacaaagcttcaggccctttggaaccacccggctggccccaaaaccattcatttctgggcgccaacattcaaatggggcatcagcattgccaactcagccgactgtgctaaaccacctgaaaagatatcttatccctcagcaagttgctggttgcatgcactggatttttttcccccccctcccggggggggggagggggccnnnnacctttaacttttttccctttttattttttcaatgaagaaaaacacgccttgtttcgcgttttcgctggagaatacgccatcattacttttatctaggtgaaaagtagctgctttcccacctgtaaacgtttgatcctcgacaaccgcgcctccacaaaccgtaccgctaaaaccctgcagccctatgcaggttcacccctctgccttttttttcctggcgcaagaaaacgtcctctccccacccgtccattgctggctttccgccgctcaccccacctttcctccttcccccctccttcccccaacaacttcctcccccgcatcacctcaccactatcttttttcctttttttttttcttt

SEQ ID NO: 57153 - protein, 73 aa, Zea mays
  misc_feature: Ceres CLONE 1503086
  misc_feature (1)..(74): Pfam Name: UPF0041 Pfam Description: Uncharacterised protein family (UPF0041)
  misc_feature (71)..(71): Xaa is any aa, unknown, or other
  misc_feature (72)..(72): Xaa is any aa, unknown, or other
MAATKLQALWNHPAGPKTIHFWAPTFKWGISIANSADCAKPPEKISYPSASCWLHALDFFPPPPGGGEGAXXL

SEQ ID NO: 57154 - DNA, 808 bp, Zea mays
  misc_feature: Ceres CLONE 1503087
  misc_feature: Encodes the peptide sequence at SEQ ID NO. 57155
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (17)..(17): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
tggggggggggnnnntntnnnnttttttnnngnnnnnngctccnnnnnccaaactggagctccccgcggtggcggccgctctagaactagtggatcccccgggctgcaggaattcgtctcacccctagaaaagatgaagaagaccagttcccctctcctgatcgtcctgttcctcacagcagcagccatggcggccgagccggagaagcaggcggcccccgcggcacaggagacggccgtgcacatcgtgtacgttgaccgccccgaggacgccgaccctgaggagttccacatccgcaccctcacccccgtcctcggcagcgaacagaaggccagggacgcagtgctctaccactacaagaacgccgccagcggcttctccgcgaagctcaccccccagcaggtcaaggatctcaaggagcaaccaggtgttctccagggggtgccgagccacactttccagctacatggcccctgggtttggcacttcaccagtgctccaactcccacctctgggccttaatagtggaaggccgtacgcaccacccaacaagcactgacgtttaccctgggagtgaatgggacctggtcctaaccaaacgttgcatacaactacgtcctattccctggaacaacggaatactatcgcgatatgtaaccggttacaaccccatgataaatccccgacaacaaaaccacttgtaagggcaccaaaatcgctatgttcttctatttattagtccccatttcctccctccctctttggggagcgctcagacgtccgtcgcctacccccacccctaacccc

SEQ ID NO: 57155 - protein, 129 aa, Zea mays
  misc_feature: Ceres CLONE 1503087
  misc_feature (35)..(112): Pfam Name: Subtilisin_N Pfam Description: Subtilisin N-terminal Region
  misc_feature: SWISSPROT Homolog: EC 3.4.21.25 Cucumisin
MKKTSSPLLIVLFLTAAAMAAEPEKQAAPAAQETAVHIVYVDRPEDADPEEFHIRTLTPVLGSEQKARDAVLYHYKNAASGFSAKLTPQQVKDLKEQPGVLQGVPSHTFQLHGPWVWHFTSAPTPTSGP

SEQ ID NO: 57156 - DNA, 760 bp, Zea mays
  misc_feature: Ceres CLONE 1503089
  misc_feature: Translation starting site: 224
  misc_feature: SWISSPROT Homolog: EC 6.3.2.19 Ubiquitin--protein ligase
aaagctggagctccccgcggtggcggccgctctagaactagtggatcccccgggctgcaggaattcgtctcacccctagaaaaaaaacccaccactgcctccctccccgttccccagtccccaccccgaccggctggtcctcctcctttccccgcgccatcctcgaggcatcgccggcgccgcaacttcgttcaggaggaagcccgcacccggccccgatccgatggccaacagcaacctcccgcggcgtatcatcaaggagacgcagcgactgctcagcgagccagcgccggggatcagcgcgtcgccctcggaggaaaacatgcgctacttccacgttatgatcctggggccggcccagtcggcctatgaagggggaagttttaagcttgaacccctttttacccgaggaaatacccatggctcccccaaaaggttaggtttctgaaccaaaatttttcatccccaactttaacaaccttggaagaaattgcctccacatttccaaggaaaaagagggaccccacctctttaaataacaaaaaatttttttaggattaaacggccccaccgggggcccccaaccactaaaaacccttccccctctaaaaatttgcaaaaaactggtagaacccctggggaaaaaaatgtgtgtaacacccacagggggtgacccccccctttccaaatggcgcctcttcaacaacccctctgtcccctttggataacaaccctatattttttttttttttagtttttg

SEQ ID NO: 57157 - DNA, 735 bp, Zea mays
  misc_feature: Ceres CLONE 1503095
  misc_feature: Encodes the peptide sequence at SEQ ID NO. 57158
caagctggagctccccgcggtggcggccgctctagaactagtggatcccccgggctgcaggaattcgtctcacccctagaaaaaatctctagtcgtgttgtggccggaagagacagacacgcaaacgagaggactcgagagagattccgccgccaccaccgccggctcagatgccgccgccgcagtcgggcatgaccctctgccgccttcccaaggccacccttggccttcccctttctctcccctctttgctatatcgtcccagcctgtccctcgccgcacgtcgcaccaaggccgtctccgccagggcctcctcctcctctccatcaccggactcttccttcggttcgcggatggaggattccgtcaagaagacggtggccgataaccccgttgtcatctactctaagtcatggtgctcatattccatggaggtgaagtcactcttcaagcggatcggtgtgcagccccacgtcatcgagctcgacaatctcggagctcaaggaccacaactacaaaaggtattagaaaggctgactggacagtctaactgttcctaacgttttcatcggtgggaaacccgttggaggctgcacaaataccgtgaaactggatcgcaagggggaactagctagcatgctgtcggacctggatatcacctttgacaactcctgacaagctatgtttctgcaaggatggggcgaaacttggggctgccccgctttttgagtttct

SEQ ID NO: 57158 - protein, 68 aa, Zea mays
  misc_feature: Ceres CLONE 1503095
MEDSVKKTVADNPVVIYSKSWCSYSMEVKSLFKRIGVQPHVIELDNLGAQGPQLQKVLERLTGQSNCS

SEQ ID NO: 57159 - DNA, 722 bp, Zea mays
  misc_feature: Ceres CLONE 1503097
  misc_feature: Encodes the peptide sequence at SEQ ID NO. 57160
cacgctggagctcaccgcggtggcggccgctctagactagtggatcccccgggctgcaggaattcgtctcacccctagaaaaaatcctactgtcacacacacacagagagagacaagtggtttccaaagccaagtgtgtactagcagtctagcaaccagctagctcgggcggcagcaggcagccatcatgtcggaggagaagcaccaccacttcttcaaccaccacaagaaggacgaggagcagcccgccggcgagtacgggtactccgagaccgaggtggtcaccgccaccggcgagggcgagtacgagaggtacaagaaggaggagaaggagcacaagcacaagcagcacctcggcgaggccggcgccatcgccgccggcgccttcgcactctacgagaagcacgaggcgaagaaggaccccgagcacgcgcacaggcacaagatcacggaggaggtcgctgccgcggcggccgtcggcgccagcggctacgtattccacgagcaccacgagaagaagaaggaccaccaggaccccgaggaggctagccgcgagaagaaacaccaccacctcttcggctgaccgtaagacccggccggccccccacccaaagctaatctaactccggaggcacacaaccccaaacctggttaattccttaaccgcatgccggtggtatattgatggctcccaaaaaatggagccccccttcgggaccttg

SEQ ID NO: 57160 - protein, 131 aa, Zea mays
  misc_feature: Ceres CLONE 1503097
  misc_feature (41)..(120): Pfam Name: ABA_WDS Pfam Description: ABA/WDS induced protein
MSEEKHHHFFNHHKKDEEQPAGEYGYSETEVVTATGEGEYERYKKEEKEHKHKQHLGEAGAIAAGAFALYEKHEAKKDPEHAHRHKITEEVAAAAAVGASGYVFHEHHEKKKDHQDPEEASREKKHHHLFG

SEQ ID NO: 57161 - DNA, 804 bp, Zea mays
  misc_feature: Ceres CLONE 1503102
  misc_feature: Encodes the peptide sequence at SEQ ID NO. 57162
  misc_feature (1)..(1): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (20)..(20): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (804)..(804): n is a, c, t, g, unknown, or other
nttttttnnnnnnnnttttntttttttcttgttttttttnnnttatannnnnttcacactggagctccccgcggtggcggccgctctagaactagtggatcccccgggctgcaggaattcgtctcacccctagaaaaaataaaaaagtgtctatttactggacatatgttcatgttcacgcggcgcttcataaaatctgcataggatacatcgcacttctatctgacctactcaggtctggtgttcagcggttgccacacctaggatatcaaatggattacatctccaaaacggaacctttctatgtctgcatgaactcaagttccttggctgatccatatagaacgatgctacctactaccacaacattaccatctaagcaaattgtgttatttgttcatctacgtctgaaagcacatttgacctttttgggtgctcacacaagattctaaatgaaattcttggagatagagaccgtatctaatctctgtattctgagattcctgggagaaccacatgcaatgccagtttcctcccgaaagaacttctaaatttcagcgtgggacgccactgcgggatgaaaagccccttcctgttgaaacccacacaatttgtaaaactcgaacaaataccggcggtctattttaatcacaatgaagaagcttgcccctggaaaaaggcgtggcggacacgcaccagaaaacaaccaccccaggcccctctctgtcgcttgcccctacattctcccccccatctccccggctccctgtcctttacacgccgggcgcctacatgtgagtcccn

SEQ ID NO: 57162 - protein, 59 aa, Zea mays
  misc_feature: Ceres CLONE 1503102
MDYISKTEPFYVCMNSSSLADPYRTMLPTTTTLPSKQIVLFVHLRLKAHLTFLGAHTRF

SEQ ID NO: 57163 - DNA, 764 bp, Zea mays
  misc_feature: Ceres CLONE 1503103
  misc_feature: Encodes the peptide sequence at SEQ ID NO. 57164
  misc_feature (20)..(20): n is a, c, t, g, unknown, or other
  misc_feature (22)..(22): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
ttttgtttttggttttttgngnggnnnnnaannnnnnccactnnntttcaaactggagctccaccgcggtggcggccgctctagaactagtggatcccccgggctgcaggaattcgtctcacccctagaaaaaaccgaaatcttccgtctccaaatcctcctagcgaattcaccacagcttctcaccaccgctaccttcgatggcacccaaggcggacaagaagccggcggcgaagaagcctgcagaggaggagcccgcgacagagaaggcggagaaggctccggcggggaagaagcccaaggccgagaagcgcctcccggcgggcaagtccgccggtaaggagggcggcgagggcaagaaggggaaaaagaaagcgaagaagtccgtggagacctacaagatctacatcttcaaggtgctgaagcaggtgcaccccgacatcggcatctcgtccaaggccatgtccatcatgaactccttcatcaacgacatcttcgagaagctcgcgggcgagtccgccaagctggcgcgctataacaagaagcccaccgtagcctcccgcgagatccagacctcggtgcgcctcgtcctccccggcgagcttgccaagcacgccgtccccgaaggcaccaaggccgtcaccaagttcaccctcttcttaaggttcatactactaggttgggcggggttggtataacttgcctacatttacccgggaaggggcacgggatggttagatattgattcttggttctattttgaa

SEQ ID NO: 57164 - protein, 165 aa, Zea mays
  misc_feature: Ceres CLONE 1503103
  misc_feature (60)..(130): Pfam Name: Histone Pfam Description: Core histone H2A/H2B/H3/H4
MAPKADKKPAAKKPAEEEPATEKAEKAPAGKKPKAEKRLPAGKSAGKEGGEGKKGKKKAKKSVETYKIYIFKVLKQVHPDIGISSKAMSIMNSFINDIFEKLAGESAKLARYNKKPTVASREIQTSVRLVLPGELAKHAVPEGTKAVTKFTLFLRFILLGWAGLV

SEQ ID NO: 57165 - DNA, 909 bp, Zea mays
  misc_feature: Ceres CLONE 1503109
  misc_feature: Encodes the peptide sequence at SEQ ID NO. 57166
  misc_feature (1)..(1): n is a, c, t, g, unknown, or other
  misc_feature (2)..(2): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (22)..(22): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (35)..(35): n is a, c, t, g, unknown, or other
  misc_feature (46)..(46): n is a, c, t, g, unknown, or other
  misc_feature (682)..(682): n is a, c, t, g, unknown, or other
nnttttnnnggggnnnnnnttnggttnnngtttgngggggcaaccnacccaaaaactgagactccccgcggtggcggccgctctataacagtggatcccccgggctgcaggaattcgtctcacccctagaaaaagttgacacaaagagaattccacagccggggggcaaggatttaattgccccctctccctccctcgcctccttcaccatcccaccgagctttgcaacagctagtagcatgggcaagctgtgctgcagccaggaagacgactagccggcgttcaacctcctggggctgcttcacctccgtcgtcctcgccctgctcctgctcttgctgtgcacgcccgcccagacacaagcactgcgatcaacctactacccccgttactgctaattacacgaacaccagcagctggctgttggctctcccacgatcgaagccccagtccttacctcgagcgcatgggaccgaaaaggaatcaacccccccccccctcatagcaacttcgaatgggatcgcccgaatccatttctatctatacatccgataaactccatatatcaaagatacccaacgttggtggtgacagaacacaaatcaataaacccctctcccgtcgatacaatacacaatctaaagtaatagacaaacaatccaaatccacacaataattaaatancgtatcagaccatcttaatcgaacaaacctagccattaacttgccttgtctctcacttcttcttcaccctctcttctctttacacttattgtatctattattctcctacttaaaatcaatcagaaccaacactgaaaacgctctgttaaacacaggaaagaaaaagaaaaaaagattatcaagatgaaatttaactggaaataaatttactccaccaataaacatag

SEQ ID NO: 57166 - protein, 53 aa, Zea mays
  misc_feature: Ceres CLONE 1503109
MGSPESISIYTSDKLHISKIPNVGGDRTQINKPLSRRYNTQSKVIDKQSKSTQ

SEQ ID NO: 57167 - DNA, 804 bp, Zea mays
  misc_feature: Ceres CLONE 1503117
  misc_feature: Encodes the peptide sequence at SEQ ID NO. 57168
  misc_feature (804)..(804): n is a, c, t, g, unknown, or other
ccagctggagctcaccgcggtggcggccgctctagaactagtggatcccccgggctgcaggaattcgtctcacccctagaaaaaatccaatccatcagtacccaaccttcccctacaccagaaaaatccccagttctttggtccgcgtcagagaggcggcggcgatgtctgggcgcggcaagggcggcaagggtctgggcaagggcggcgcgaagcgccaccggaaggtgctccgcgacaacatccagggcatcaccaagccggcgatccggaggctggctaggaggggtggcgtcaagcgcatctcggggctcatctactaggagacccgcggcgtgctcaagatctttctcgagaacctcatcctgcgatgccgtccccctaccccgagggaggggcgccccctatactcctgaccgccatggaccccccctcaactcgcttcaagcgcccaggggccgccacccttctacgggcttcgagaggcctaagacctaagacgccctctttcgttagtcccgggaaactgttttaggcggaacctggtctccctgtgcagaatcctttcccctaagctaattatttccttatcattacccttgtttcatccccccctctctcatcatctgaaaacctcttttataactatgcatacgcttatcatactgtgctcgagaggttgaacctcgcttctcccccgctacaaatcagatgcattcttctccgagaatattgtgtacaaataataatgtgtaaaaccacacttattcgctccacaaacagattataaaaagcaccccgccn

SEQ ID NO: 57168 - protein, 52 aa, Zea mays; identical to SEQ ID NO: 11908
  misc_feature: Ceres CLONE 1503117

SEQ ID NO: 57169 - DNA, 825 bp, Zea mays
  misc_feature: Ceres CLONE 1503120
  misc_feature: Encodes the peptide sequence at SEQ ID NO. 57170
  misc_feature (12)..(12): n is a, c, t, g, unknown, or other
  misc_feature (17)..(17): n is a, c, t, g, unknown, or other
  misc_feature (18)..(18): n is a, c, t, g, unknown, or other
  misc_feature (22)..(22): n is a, c, t, g, unknown, or other
  misc_feature (23)..(23): n is a, c, t, g, unknown, or other
  misc_feature (47)..(47): n is a, c, t, g, unknown, or other
ggggggggtgtnggtgnngtgnntttgttttgtttgggggggggganagaacactggagctccccgcggtggcggccgctctagaactagtggatcccccgggctgcaggaattcgtctcacccctagaaaaaagcgccgcaccctcccgcccaccgccgtcgccgcccagccgcagtaaggaggaaggagcaggaagatgccggcggggcacgggctgcggtcgcggacccgcgacctgttcgcgcggcccttccgcaagaaggggtacatcccgctcaccacgtacctgcgcacctacaagatcggcgactacgtcgacgtcaaggttaacggcgccgtgcacaagggcatgccgcacaagttctaccacggccgcaccggcagcgtctggaacgtcaccaagcgcgccattggcgtccagatcaacaagcaggttaacggtcgcatcatcatgaagcggatccctgtccgcgtggaggattgggcagcccctcccgttgcacataggagtttcccctgagggaagccacagacggacccgatcatggccggattgccctggcccctcggttgaggttatctcctccatataggccttccctgctggtacccataccctggtcttctttagtccgaggcttgcctcccctcctaaggttgtctactccctcatttcctttttgtattgtgtgttcttactctcctctcatggtcccgtatacctgtgtagatttttttctctgttcgctctccctccatctccctcaccgacccttgtccaccccccctccctgtaggcctcctccctctacgcaagttgggc

SEQ ID NO: 57170 - protein, 107 aa, Zea mays
  misc_feature: Ceres CLONE 1503120
  misc_feature (2)..(95): Pfam Name: Ribosomal_L21e Pfam Description: Ribosomal protein L21e
MPAGHGLRSRTRDLFARPFRKKGYIPLTTYLRTYKIGDYVDVKVNGAVHKGMPHKFYHGRTGSVWNVTKRAIGVQINKQVNGRIIMKRIPVRVEDWAAPPVAHRSFP

SEQ ID NO: 57171 - DNA, 865 bp, Zea mays
  misc_feature: Ceres CLONE 1503129
  misc_feature: Encodes the peptide sequence at SEQ ID NO. 57172
  misc_feature (29)..(29): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (48)..(48): n is a, c, t, g, unknown, or other
ggggggggggggggggggtggtgggggtnttttttttnnnnttttgtnacatactggagctccccgcggtggcggccgctctagaactagtggatcccccgggctgcaggaattcgtctcacccctagaaaaagttgtccgttgtactctctctctctattcgttccccgcctcaccccgagccagccgtctcgctagggtttcgccgccgccgccgccatgcctcgccgcagctcaggaaggtctgccccacgcccagctccccgtgctgctccagtgaggaacccgccacagccagcacgccaggctcctcctccagctcctgttccagatggtggtggctccatgtttggaaggatttgggtccacctttgctcaaggtatgggagttttgaacagcgtatttgcacgtcctcccaggtctccttatcctgtattaaggcccccgggaccagtctacattgagactgtttgcctcccaaaaccttgcttgtttgctgccgccttgccccttcccccgtattcaaatggttgtatggtcttcccaccgaacacaccctaaagaggtttccccaggaaggctccccccaaaacatttgtggtatctataacctactttatatgagtcccttttttaccccctgtgtagagtgttaaaaataaaacccccccctggggtgcggtggttctcccccagtcttcccccctctgttgtactgcaacaatttcttcctggcggcgaacaaactcccacctctattctacaacccctcaaaaacatttttcacccatgtgtggttgtttttccctctctgttggttcgaccccgggcgggtgccgcgggcgcgctttcggtccactctcg

SEQ ID NO: 57172 - protein, 81 aa, Zea mays
  misc_feature: Ceres CLONE 1503129
MPRRSSGRSAPRPAPRAAPVRNPPQPARQAPPPAPVPDGGGSMFGRIWVHLCSRYGSFEQRICTSSQVSLSCIKAPGTSLH

SEQ ID NO: 57173 - DNA, 779 bp, Zea mays
  misc_feature: Ceres CLONE 1503131
  misc_feature: Translation starting site: 187
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (34)..(34): n is a, c, t, g, unknown, or other
  misc_feature (38)..(38): n is a, c, t, g, unknown, or other
nnnnnnnnnnnnnnnnnnnnnccttttttttctntttnttctctccctaaaaactgggactccaccgcggtggcggccgctctagaatagtggatcccccgggctgcaggaattcgtctcacccctagaaaaatcctctcccccgttgcgcaacgcgctttcccccacttcacccgcctcggcgccatggctaagctcgcgctggcgctcctcctcctggctggccgtggcggcgtccgcgtcggccagcagcgggagccacctggatctcgacctgtgcttcctctcctctggggaacgccggagggagtgccgcggcacggtggccgagtgcctcgccgaggagtcggatgaggagggccttgacctggctggatcccaccgccgcgcgctctacggcggcgggtacatcagctacggcgcgctgcggcgggacaacgtgccctgctcccgccgcggcgccagctactacaactgccgcccgggcggccaagccaacccctaccaccgcgtgctgctcccgcatcacccgcttggccgcggttgatgcggacgccagatccaccaaactgcctaggaaaggtctggtcccgtgtccccggcccttattaccgacaataatttccttttcgccttgttccgttcgggcgcaacccgccaaccgccaccgtctgttttcctatagcacccgaacccaccggattgaattgcatgctataggatttgtattgagccaaatccttctgtttctcgttgtaaaagaaaaggagcaggggaat

SEQ ID NO: 57174 - DNA, 705 bp, Zea mays
  misc_feature: Ceres CLONE 1503133
  misc_feature: Encodes the peptide sequence at SEQ ID NO. 57175
ccccgcggtggcggccgctctagaactagtggatcccccgggctgcaggaattcgtctcacccctagaaaaaaactccgtagagctccctgctttgttcagacttcagagcccttcctcttgtgtccgtgcaaattggtgatacttgaacagggatctcctccatattagtgagcaggatgtataatcctcccagtgggcaggacatgtcctactacgatcatgtgcagaagcgccatgaggagaagggctgcctatatgcatgcctgttcactgcatgctgctgcttctgctgcttcgagacctgagagtgctgcctcgaggccatctgctgctgctgctagttctgcttggagggcatggacgtccatcatcctggagatgtggccatgcaggacacccaccgccgaataaaatgctgtacttatatgcacgcacgttagaaatgcattagtgtctgtttgatgtgatctcgtgtgtgtgtcaaatgcatcagtgtctatctgatgagatcttgtgagtgtgcgcacacattttcatttgcacccaaaaaatgctgtgtgagggtctgcaaatctgttctatgtatcatggtcagatgagctctcttattgtgcccgaaaaaaaaaaaaaaaaacgaaaccctcgagggaccccattccgccctataaagaagccctattacgcgcgctcacttggccgtcct

SEQ ID NO: 57175 - protein, 42 aa, Zea mays
  misc_feature: Ceres CLONE 1503133
MYNPPSGQDMSYYDHVQKRHEEKGCLYACLFTACCCFCCFET

SEQ ID NO: 57176 - DNA, 916 bp, Zea mays
  misc_feature: Ceres CLONE 1503135
  misc_feature: Encodes the peptide sequence at SEQ ID NO. 57177
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (21)..(21): n is a, c, t, g, unknown, or other
  misc_feature (31)..(31): n is a, c, t, g, unknown, or other
  misc_feature (37)..(37): n is a, c, t, g, unknown, or other
  misc_feature (38)..(38): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (747)..(747): n is a, c, t, g, unknown, or other
  misc_feature (916)..(916): n is a, c, t, g, unknown, or other
nnnnnnnnnnnnttttttttntttttttttntttttnngaaannnnnacaaactggagctccccgcggtggcggccgctctagaactagtggatcccccgggctgcaggaattcgtctcacccctagaaaaacagcgagcgagcgaagtagacagacgctggctgagatacacacacacacacatcaactgaaaactcggaggagtttttgttcatcatgggggtacagagcagcgagggccagatgatgttctcctccatcgccctgctgcagcagatgttccaggagctggagaggatcagggagaaccgggaggagaggctactccacgtgctcgcccctcgccctgtggccaccacctccccgagggaaatccccatgaaggggttcttcccaccggagctgctcaacccctggacgcctctgcgggaaaaccgtggccggcctcttaattcccggccctgggaattgcaaaacctttcctgcttccaccgggaaataaagcaccccccacatgggagttgaaactggcgccccccaaacatggactctccaacttcccaaaccttgcctctccggcgcgaaatttataaatctttacaccacctctctgtcaacccctttaaacctaggttttcgcgtaacctccaaaaaaacacctctacccaaatgggccctataaaaccttcttctttgtatcacccccctcgcagtgcgcgcgctccctccccccacgcgtcttgttncttttgtttgtccgtgctccccattctacaccgcctcttctccctccttccctcctcttaattaaaaccacgggcaactactccacagaaggatgcaccatccccattgagatcttatacattatcccaccagagtagacgcacctaaaggcacctgttcttcttcccn

SEQ ID NO: 57177 - protein, 102 aa, Zea mays
  misc_feature: Ceres CLONE 1503135
MGVQSSEGQMMFSSIALLQQMFQELERIRENREERLLHVLAPRPVATTSPREIPMKGFFPPELLNPWTPLRENRGRPLNSRPWELQNLSCFHREIKHPPHGS

SEQ ID NO: 57178 - DNA, 683 bp, Zea mays
  misc_feature: Ceres CLONE 1503143
  misc_feature: Encodes the peptide sequence at SEQ ID NO. 57179
aatccagcttctctcgcctgtcggctgtcgcgtcgcatcgcatcgcatccatggcgggagcctccgcggtcgccgtgctgcccgtggccactccagccgcgccgcgccgaggaggcgccgggccgtgctcctgcttggcgcccggaggcagcagcttctaccgccgcatgaactgccggcgtgatagccccagcgcggccgcgcctacgaggcgacgcgtcgtcgcccgtctctccgggcgcgaccccggcgaggccgggaccgacgcgggcgtggggcaaatcctcaagggtgatgactccggctatctgtggacattggtgcttgggtcccttggtggcgccgcggttatcaagtacggaagcatcctgctcccggacatcacgaggccaaacattgtggtagctctgctgatggtgtccctgcccgtggtagccgcggtcttggctttgctcaaagcgagctcggtggactgatagtgatacgacgcgaggactccacgaaacctagaattcgagattactgaaacttgtttctaatgatagcttcattgtaagatgaaaatgtttgaactctgctgaatgatctttttttggcatcgctcgatgcaagctttgcagctccagaagaaatcagaaaaagaacgcccgttgatcttgaaaaaagaaaaaaaaaaaaaaaaa

SEQ ID NO: 57179 - protein, 141 aa, Zea mays
  misc_feature: Ceres CLONE 1503143
MAGASAVAVLPVATPAAPRRGGAGPCSCLAPGGSSFYRRMNCRRDSPSAAAPTRRRVVARLSGRDPGEAGTDAGVGQILKGDDSGYLWTLVLGSLGGAAVIKYGSILLPDITRPNIVVALLMVSLPVVAAVLALLKASSVD

SEQ ID NO: 57180 - DNA, 733 bp, Zea mays
  misc_feature: Ceres CLONE 1503144
  misc_feature: Encodes the peptide sequence at SEQ ID NO. 57181
aagctggagctcaccgcggtggcggccgctctagactagtggatcccccgggctgcaggaattcgtctcacccctagaaaaagtgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaagcggcggctcctgcggtggcgggcgccctgatggcggccgcggctacggcggtggctgcggccgctaccgtggcggcggcggctaccgtggggggtggccgccgctacggcggtggcaaccggtggcggcggccacggcaactccgaccggtaattggaaggaactgaaccggtggggcccccccccggccaagtttaccccggtccccttaccggtgttggttttacccttgccccaaaagggt

SEQ ID NO: 57181 - protein, 184 aa, Zea mays
  misc_feature: Ceres CLONE 1503144
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAASDVEYRCFVGGLAWATDDHSLHNAFSTYGEVLESKIILDRETQRSRGFGFVTFSTEEAMRNAIEGMNGKELDGRNITVNEAQSRGGRGGGGGGYGGGRGSGGSCGGGRPDGGRGYGGGCGRYRGGGGYRGGWPPLRRWQPVAAATATPTGNWKELNRWGPPPAKFTPVPLPVLVLPLPQKG

SEQ ID NO: 57182 - DNA, 756 bp, Zea mays
  misc_feature: Ceres CLONE 1503152
atagctggagctccccgcggtggcggccgctctagaactagtggatcccccgggctgcaggaattcgtctcacccctagaaaaaatcccctgcgcataggaagccagctccttcacgtcgcctcctccctaggcggcgatcctacagagcctcgccggtcatccctgctccctcggcgtctctcccatggcgccctccctgctccttcacatggtgtggacgccagccccctctcttgttgccatggatagcccctctcccatctccttccccaagcacaagtcccatggtcgcccaaccctagctcgccctgccccagccatggacgctgtcgagccgcccgtttcctatctcccctcgccttcatcctctggctgccgcccctccctggatgtcgccctctctactcgtcgatcttctctgttgcggcgcgcactggctgtcttccacctccatcggaacacgccgagctccctccttgctccagtcttctccatggtcgctcctctccttttccctgattaatactaggcgcagcagcaacatgccagaatctctgtagcccaggaaattttaaatgagaaaaaaagctttagcgaaggcgcttgccaaagtccttggttgaatcccccctcaacccgaatatggttgtcccatcctccccggaatccaaagcccgaatttaaacccccggccggcaatgttaactccccgaggggcggatagggcctctaacaccccccctagagacccccg

SEQ ID NO: 57183 - DNA, 707 bp, Zea mays
  misc_feature: Ceres CLONE 1503155
  misc_feature: Encodes the peptide sequence at SEQ ID NO. 57184
tggagctccccgcggtggcggccgctctagaactagtggatcccccgggctgcaggaattcgtctcacccctagaaaaaattcacgcacctagggttttcgcgccgccgccgcagccgcaacaatgccgtcgcacaagaccttccggatcaagaagaagctggcgaagaagatgcgccagaaccgccccatcccctactggatccgcatgcgcgctgacaataccatcaggtacaacgcctagcgcatgcactggcgccgcaccaagctcggcttctgagcgtcgggattggccggctgctgcgtcggaaggctagggtctaagagctatcttctgttttatcattggctctgtttctgtaagctagcaagtgatgctgcgatgctttcattaacattctgatgagtggcgacgttaagagaaaattggcagcactgtgttgcaccccaagattccttgcagcattgctatgctaagtaacgaaccctttatcttattatcctcggcggcggcgccctcctcgtctacaacaccagcgccctctccggctaaggatatccaatgcaatgcgcttcttgcgattcgtcatgtaaaatcagggtgtctgtctataatctagcctgcctggatgctcacccattcggcctgtaacagtaatcattgctactcctccttacgtaatttttatgccatctctgtaacagaag

SEQ ID NO: 57184 - protein, 39 aa, Zea mays
  misc_feature: Ceres CLONE 1503155
  misc_feature (9)..(40): Pfam Name: Ribosomal_L39 Pfam Description: Ribosomal L39 protein
MPSHKTFRIKKKLAKKMRQNRPIPYWIRMRADNTIRYNA

SEQ ID NO: 57185 - DNA, 755 bp, Zea mays
  misc_feature: Ceres CLONE 1503161
  misc_feature: Encodes the peptide sequence at SEQ ID NO. 57186
aaagctggagctccccgcggtggcggccgctctagaactagtggatcccccgggctgcaggaattcgtctcacccctagaaaaaaagcaaataagacgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacggctgcagctgcggtggcaactgcaagtgcgacccctgcaactgctgatcacatcgatcgacgaccatggatatgattattatctatctagcttgtggtggtggttgaaacataataagcgaggccgagctggctgcccatacatagaattgtggggggggtgtaaaaaaaaaaaaacaaaattcttcagtttgctatccccccccgccagtttggggccaaccttttgggcccaggcccaacctggggccccccgccagggtggtgaaccccaatgccaccccgcggaacccttatttaatatggccccccaaaaaaattggttggacccctttttttcccccacaccccgaaaaaaaaaaaaaaaaaaaaaaaacccccgggggccccccaccccccccacaaaggaggggcgata

SEQ ID NO: 57186 - protein, 76 aa, Zea mays; identical to SEQ ID NO: 8464
  misc_feature: Ceres CLONE 1503161
  misc_feature (1)..(76): Pfam Name: Metallothio_2 Pfam Description: Metallothionein

SEQ ID NO: 57187 - DNA, 930 bp, Zea mays
  misc_feature: Ceres CLONE 1503170
  misc_feature: Encodes the peptide sequence at SEQ ID NO. 57188
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
nnnnnnnnnnnnnnnnnnnnnntttttttttttttttttttnnnnnnccaaactggtgctccccgcggtggcggccgctctagaactagtggatcccccgggctgcaggaattcgtctcacccctagaaaaaatctcaagggaacttgagagatgcaaatttacttatggatgagatgaacgaacaactaaaatctgctaactcggaatttccgaaaacagatttgattcagttcatcaagtatcttttaccaacacttgagagagatgcttaccctctttttagaacacttcgacagaagtataagacaagtacagaccgcgatgctgtgtttcacgagttactggatgaaatagctgcaatattttacaggatacaacggccagaaccctttaggaaggacttcttccgcgaaatcgccttaaatataaccgccccgagaaaaagaattttagtgcccatgctcttcactctcaaccaacttggctgggtattatcaccactcgcgtcatacacaaagtcggcctggctaaggctatgcgaatccctcgccgggccatacaacattcttaacattcaatcgcctggttaataacaaaatataatacattaatgttcgtccaacaataaactctcccactaacataaccgtctctctacacggctccacctaagcccctcgtggtctatatcggaaactccttcgcttacttcgctgttcacttgttatttcatcccttatatctgcccgcacgccaccctctagacccgcaacgccctccacctcacctcccaacacccgcaacgcctaccgcctccatccctcccctctccctctctcccctccttctccaccacacgaaacttcaataattaattaatgatatttttcttctctacctctaccacccaacatctctacactaaccc

SEQ ID NO: 57188 - protein, 141 aa, Zea mays
  misc_feature: Ceres CLONE 1503170
MDEMNEQLKSANSEFPKTDLIQFIKYLLPTLERDAYPLFRTLRQKYKTSTDRDAVFHELLDEIAAIFYRIQRPEPFRKDFFREIALNITAPRKRILVPMLFTLNQLGWVLSPLASYTKSAWLRLCESLAGPYNILNIQSPG

SEQ ID NO: 57189 - DNA, 707 bp, Zea mays
  misc_feature: Ceres CLONE 1503174
aaagctggagctccccgcggtggcggccgctctagaactagtggatcccccgggctgcaggaattcgtctcacccctagaaaaaatcccaccccacccacctccttcctcttcccgcccgctaaaacccacgccaccgccgcgcgccgccggaagagcaagggacacacgatggccatagctgtggagagcaacctccaactaaagctgtactcctggcggaggtactagatctcgtgcttcccgtcccggttccagcccaaaactggcaccaactcccgctccacctacacgctgaacccggacggcactgtgaatgtggtgaacgacacctgagccgactggcgccgcggccacatcgagtgcacggcctgacgcgccgaccctgccagcgacgaggccaagctcaaggttcgcttctacgtgcaggccttcctccccctcatccccgtgacaggagactactgtgtgctccacatctacgccgactaccagtacgcgctcgtcgggcatgcctgcaggaactacctctggatcctttgcaagccgcctcatatgcacgagtccgtgtacaaggtactggcggagcgtgtcaagaacgcagggtacgacgtgtctaatctccgctagactgtgcaacctgacccgccgacagagagcgagcacatccccacgcacagctggtatgtcgcgggtctagaccatctt

SEQ ID NO: 57190 - DNA, 703 bp, Zea mays
  misc_feature: Ceres CLONE 1503175
  misc_feature (37)..(37): n is a, c, t, g, unknown, or other
  misc_feature (388)..(388): n is a, c, t, g, unknown, or other
  misc_feature (703)..(703): n is a, c, t, g, unknown, or other
ccccgcggtggcggccgctctagactagtggattctngggctgcaggaattcgtctcaccctagaaaaattctccggctctccgctgtagggttttctggtcctggtaggcgagctggggaagacgcaaggtactgcggctgctcgcgaggggtcgtcggacgaccgacgaggacgagcggcataggcgcgtgcatggcgctcacgaacttcatcctcacggtggtgggggtgggcccggccctcattctcctgcccaaagacctctagctgtctgccccccccgtgccgcggcagcgtggcccccctcctcttctgggctcgcggaggagcccgccgcccgcgcccatttttttttcccccccccgggggggaaagaaaggggccanccttccctctctccccctctccccgatgctgttcccttcctttcgcctctcccccgcgggcggggccgtccccccacccccgccgtcctgcccgccccgtttcccctcttcccaccccgtgctgccttggtaccccctacccccccccccaatctgctccccccctccggcctcccctcccccccccccgtccctaccctggtacccccccgcgcggctgtgccccgcgccgcggcgccctcccgccccccgccgctgccccccgcgcgcgcgcgctcgtctccccccacccccccccccgccgcctctcccatn

SEQ ID NO: 57191 - DNA, 790 bp, Zea mays
  misc_feature: Ceres CLONE 1503178
  misc_feature: Encodes the peptide sequence at SEQ ID NO. 57192
ccccgcggtggcggccgctctagaactagtggatcccccgggctgcaggaattcgtctcacccctagaaaaaaacaacagccctacaacttactgcttgctctagctagctagctgctcccggcccatatccactacacaagtaggctagcagcagcagcagcaatggcctcggtgacgaggttcccggccgtggccctcgtcctgctgctcgccgccagcgccttcctggtcagcgaggtggcggcctgccggcggctgccctaaacctactcctcctcctccatcgccaacaacggcgtcgcccaacagtacgccgtgccctccaccaccggtcgaggtggggggggcaagggtctcttttaccccccctcgtgggggggggggggggggccaactctcctctcttcttcttctacggggatcccttcatgtatatatatccactcccacttttttttcgtcccggctggtgtgtccggtccccttcccaaactcatacgtccaaccccatcatcacatcgttaaccacgtcttttcctgggctgcgccggcctctcgcgaccgaccgttgtcttctcagtcttctgcgctcgcttggataacccccctcccatctcctttttttgtcctgctttctctcttcttcgcgcccgtcgtggtcttcttccgctgtgctccttcctcttctctttacacatctctctcccccatcaccctctcctctgctctatgttctgccccacgctcatgtaactctctccctttctccctcccggtggctcgcgtta

SEQ ID NO: 57192 - protein, 33 aa, Zea mays
  misc_feature: Ceres CLONE 1503178
MASVTRFPAVALVLLLAASAFLVSEVAACRRLP

SEQ ID NO: 57193 - DNA, 819 bp, Zea mays
  misc_feature: Ceres CLONE 1503181
  misc_feature: Encodes the peptide sequence at SEQ ID NO. 57194
  misc_feature (819)..(819): n is a, c, t, g, unknown, or other
agagctggagctccccgcggtggcggccgctctagaactagtggatcccccgggctgcaggaattcgtctcacccctagaaaactccccacttcgagacttcctccattcgcggtttgcctctctgcctccctccctcagatcctccctaagattgccatggcggaccagctcaccgacgaccagatcgccgagttcaaggaagcattcagcctcttcgacaaggacggcgacggctgcatcaccaccaaggaacttggaactgtgatgcgctcgttggggcagaaccctactgaggctgagctgcgggacatgatcaacgagggtgatgcttatggcaatgtaaccctcgacttccctgagtttttttttcccccccccccccacgggggggggggggggggattttaaacaccatctcccccaccccctctccgcggggttccacaaagacccggatcggcttcgtcggggggcggcggagacacccgcacctggcagtgtgcctacactagggcgggcgaacgtcttcgtgaaccccgcgcggtccgccagaccacaacacggggcgtccccgagccggacaccgtgcgaagggacccacatgtggcccccgcacgatcgcccgcggccaatgtccgaggatcgggcgcacgccaatcttctgtacggggcgtttccgcagcagtgcgtcggtcaagattaacaaggggagtgggagtggacccatacggtcggccacgctgccgctgccgcctcctgctcccacgccacgttatctcacaccggccacaataccaagaaccaacaccccaatggn

SEQ ID NO: 57194 - protein, 83 aa, Zea mays
  misc_feature: Ceres CLONE 1503181
  misc_feature (12)..(40): Pfam Name: efhand Pfam Description: EF hand
  misc_feature: SWISSPROT Homolog: EC 2.7.11.1 Non-specific serine/threonine protein kinase
MADQLTDDQIAEFKEAFSLFDKDGDGCITTKELGTVMRSLGQNPTEAELRDMINEGDAYGNVTLDFPEFFFPPPPHGGGGGGF

SEQ ID NO: 57195 - DNA, 745 bp, Zea mays
  misc_feature: Ceres CLONE 1503188
  misc_feature: Translation starting site: 169
aagctggagctccccgcggtggcggccgctctagactagtggatcccccgggctgcaggaattcgtctcacccctagaaaaactagccgcctgcctctcctcctccagagctcgtcgccaccggccaccgccaccctcgatcacgccgtccgtcgaggtaaggtcagcatggtgagggtcagtgtgctcaacgatgcgctcaagtccatgtacaacgctgagaagatcggcaagaggcaggtcatgatcaggccgtcgtccaaggatcatcatcaagttcctgacggtcatgcagcgccacggctacattggagagttcgagtacgttgatgaccaccgatcgggcaagatcgtggtcgaactcaacgggaagctgaacaagtgcggcgtcatcagccctcgcttttgatattcgcgtgaaagactttgagggaatgactggcaggctgcttccggtccaggcagttcggaatacatcgtccctaaaacttcgggggggttctgggaacccaagaaggccccccgaaaaacctaagaagcaaggttcttggtttctttctttggaaaaaaccaaaaaatttttttatggccgggcggccttgtttattcccccaaaaaaaaaaaaccccgggtttttcctctaaaagggcccccccaaaaaaaaaaagccccttttttttctaaatatttggggcagcgtgttgggttttcctctttaaaaaggggggagggggttgttatacaa

SEQ ID NO: 57196 - DNA, 722 bp, Zea mays
  misc_feature: Ceres CLONE 1503194
  misc_feature: Translation starting site: 86
  misc_feature: SWISSPROT Homolog: EC 1.14.13.68 4-hydroxyphenylacetaldehyde oxime monooxygenase
  misc_feature (355)..(355): n is a, c, t, g, unknown, or other
  misc_feature (373)..(373): n is a, c, t, g, unknown, or other
aagctggagctccccgcggtggcggccgctctagaactagtggatcccccgggctgcaggaattcgtctcacccctagaaaaatcatggagaagctacagacggaggtgaggacgacgatgcgctcgccggacggcaagaagctggacatgctagcggaggaggacctcggcagcatgccctacctcaaggcgaccatcaaggagacgctgcgcctgcacccgccggcgccgttcctcctcccgcactactccaccgccgactccgagatcgacggctacttcgtccccgcgggacgcgcgtcctcgtcaacgcctgggcgctcgggaggacccgacgacgtgggagaagcccgnaagagtcatgccggagcngttcgtgcaagaacggggcgcccgtggacgtccacatgaagggcaaggacctcagttcatcccgttcgctccgggcggaagatctgccccggaataacttcggcttcccgaccagggaaaaatggctgccaaatccatggcccatttaaattggaagcccccggctctgaaaaagggtgccccagaaaaaaccctttggggtgacccccccccaaaaaaaaaacctcccccttgtccaaagagtgtccccaagaaccccccccatatgaaaaaaatttggtgtttgcgcccttcccccggaaaaaaaataaatagggggaaaaaggctcctttttctccccaaaaaata

SEQ ID NO: 57197 - DNA, 771 bp, Zea mays
  misc_feature: Ceres CLONE 1503195
  misc_feature: Encodes the peptide sequence at SEQ ID NO. 57198
  misc_feature (255)..(255): n is a, c, t, g, unknown, or other
  misc_feature (256)..(256): n is a, c, t, g, unknown, or other
aaagctggagctccccgcggtggcggccgctctagaactagtggatcccccgggctgcaggaattcgtctcacccctagaaaaagcagtcgcccccaaatttccccgaaccaaatcactcccaccgtctccacagcaaccagcacacatttccctttggcggatcgaaggaaggaaggaggagatgggtggcggcatggaggtgcacaaaaaccggtggatcgaagagtggaacgccggccgcgagaacctcganngtcatttccgctggggaccgcgcagcctcgccgtcgtcggcctcttcggcctcgctgtccccatcctcgtctacaagggcatcggtccgccgaattattatgcaagacgaggaagcaggcccgccatacaggaaagtccctgtaagcgggcttccagggccccagaaaacctccatccctcaacccggggctccaaagaagggagtttcccttcctttgggggccggattggtttaaaccaaaaccaatggaacattttggaagggtaaacattttggccccgaccccaagaaaaaagggggaaaaaccccccctttttaaattcggaaaaccgaaaatgtttgaaattttccggggcccctttgttggggaaaaaaaaaaaaaaaaaaaaaaaggcggcgggggccccacattccccccctaggagggggattaataaacccgccctccggggggcggttttttttaaacccgcgggggggggaaaaaaaaccggggggccccccaccattttg

SEQ ID NO: 57198 - protein, 113 aa, Zea mays
  misc_feature: Ceres CLONE 1503195
  misc_feature (24)..(24): Xaa is any aa, unknown, or other
  misc_feature (25)..(25): Xaa is any aa, unknown, or other
MGGGMEVHKNRWIEEWNAGRENLXXHFRWGPRSLAVVGLFGLAVPILVYKGIGPPNYYARRGSRPAIQESPCKRASRAPENLHPSTRGSKEGSFPSFGGRIGLNQNQWNILEG

SEQ ID NO: 57199 - DNA, 729 bp, Zea mays
  misc_feature: Ceres CLONE 1503196
tagctggagctccccgcggtggcggccgctctagaactagtggatcccccgggctgcaggaattcgtctcacccctagaaaaactcctcagtatgactcccctccccttatcccctcagttgcctagttgcgtgggttcccttccctgatccgcttcgtcgccccaggctggtacgtggcgtggaggacggtgctggtgcacgtgccgctggtgcaggagatcgccggcctgcgcccgaaaaagccctctaaacccaagccagccaaccgcggccgcttcgccaagttctaccagaaccaggccgaagccgcccaaaggaacagcaaatcagaaggggcatcatcttaagagaaatccgtcaccgccttgtaatgagtacctgccgcagactttattatgcagttctaattagaatgcaagtactaccagtgacggcgtctttttaggagagaatgtatatcagcatgtgatgggagcatccctgcctgcctgacgatacatcaggcttatgatagtagcgtatcaactgtttattgcatgaccttgtaaagttaggaccttatgattgtacatatatatacacctgtatacaagaaataaagagaagcccttgcctttgggaaaaaaaaaaaaaaaaaccagaccgctcgaggtacccaattccccctttaggggaggcgttttacccgccctcccggggccgccgttttacaccgcctggactggga

SEQ ID NO: 57200 - DNA, 697 bp, Zea mays
  misc_feature: Ceres CLONE 1503202
  misc_feature: Encodes the peptide sequence at SEQ ID NO. 57201
aaagctggagctccccgcggtggcggccgctctagaactagtggatcccccgggctgcaggaattcgtctcacccctagaaaaaatatcccatccatcacagctagctagcgtacagacgaataatctcttcttcacctcactagctaacaccagctagcagctcgatcgctctgtcctgcaataatggccgctcgctcctcctcccagcagctggtcgcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcggcggcggaccggcaggccacctgcaactgcctcaagagcatgacgggccggctcggcggcggcgtcagcatggcccacgccgccaacatccccggcaagtgcggcgtctccgtcggcgtgcccatcagccccaccgtcgactgcaccaagatcaactgatcgatggaaccatagtgggagggagctcgctcgctggatggcagccgaacttggccatcaccagcatgcagtcctcctcctaaccaaaaagtcccaaccacctggggggcatgcatcaaacctggccaata

SEQ ID NO: 57201 - protein, 126 aa, Zea mays
  misc_feature: Ceres CLONE 1503202
  misc_feature (36)..(122): Pfam Name: Tryp_alpha_amyl Pfam Description: Protease inhibitor/seed storage/LTP family
MAARSSSQQLVAAAVLAAALLLLAAGAGTASAAVSCGEVTSSVAPCLGYAMGSAASPSAACCSGVRSLNSRASSAADRQATCNCLKSMTGRLGGGVSMAHAANIPGKCGVSVGVPISPTVDCTKIN

SEQ ID NO: 57202 - DNA, 726 bp, Zea mays
  misc_feature: Ceres CLONE 1503204
  misc_feature: Encodes the peptide sequence at SEQ ID NO. 57203
  misc_feature (512)..(512): n is a, c, t, g, unknown, or other
  misc_feature (519)..(519): n is a, c, t, g, unknown, or other
  misc_feature (532)..(532): n is a, c, t, g, unknown, or other
aaagctggagctccccgcggtggcggccgctctagaactagtggatcccccgggctgcaggaattcgtctcacccctagaaaaactccccactcgagccagccagccagccagccagccgcttgggcgccatctctctagagcttcgtaccctcgaagagagatccggcgcggcccaataaacacccggctcactacagactcgcagatggccggcctcaggatgaagttcgtcgccgtcgccgccatggccgccgcgctcgtggcgtccgccgcagccgccgaggcccccgccccggctcccgcgtccgacgccgcggccgccgtacccctcgccgcggcctccctcgccgccgccgccttcggctacctcttctgctagatccgcgctggatacgtggttcctgctcaaaatatgattcgtctggtctggcgcgcgtgagtccagctcgtgtgtcgtgcgtgtctctgtgtgaggtgtcggcgggcgtgtgtatgtatggagtcggccgncgcggcngaagaggtctgcncgtggtggtggtggtacgtgcttcgacgcgccactgtttgtcgcggcgatcatgtactaccctgctgcgtttttcggtttatccatgagatgatttattttgattctttccaaaaaaaaaaaaaaaaacgagacgctcggaggtcccaattcccccctattagggagtcgtattaacccgcccctcccgggccg

SEQ ID NO: 57203 - protein, 57 aa, Zea mays; identical to SEQ ID NO: 43282
  misc_feature: Ceres CLONE 1503204

SEQ ID NO: 57204 - DNA, 701 bp, Zea mays
  misc_feature: Ceres CLONE 1503205
  misc_feature: Encodes the peptide sequence at SEQ ID NO. 57205
  misc_feature (512)..(512): n is a, c, t, g, unknown, or other
  misc_feature (516)..(516): n is a, c, t, g, unknown, or other
  misc_feature (701)..(701): n is a, c, t, g, unknown, or other
aaagctggagctccccgcggtggcggccgctctagaactagtggatcccccgggctgcaggaattcgtctcacccctagaaaaagacctgcagccaaccatctaccagcgactcagcgagcgagagcagcacacacgcagctagctaggagcagcagcagagcagcggcgatggcggcctccatgatctcctcgtcagctctggcggtggcgcctcagggcctgccgcccctcggccgccgcgcctcctccttcgccgtcgtctgctccaagaagaagatcaagaccgacaagccctacgggattgggggtggcctgaccgtcgacgtcgacgccaacgggagaaagggcaagggcaagggcgtgtaccagttcgtcgacaagtacggcgcgaacgtcgacggatacagcccaatctacaacgaggatgactggtctcccaccggcgacgtctacgtcggtggaaccactgggcttctgatctgggccgtcaccctcgctgggatcctcggncgcngcgccctcctcgtctacaacaccagcggccctctccggcttaaggattatcccatgcatgcgcttcttgcgattcggcatgtaaaatcagggtgccggtctataatctaggcttcctgggatggctcacccttcgtccaggaaacaaaaacaagggcaccccttctttccttaaaaaaaaaaaan

SEQ ID NO: 57205 - protein, 151 aa, Zea mays
  misc_feature: Ceres CLONE 1503205
  misc_feature (32)..(128): Pfam Name: PsbR Pfam Description: Photosystem II 10 kDa polypeptide PsbR
  misc_feature (116)..(116): Xaa is any aa, unknown, or other
MAASMISSSALAVAPQGLPPLGRRASSFAVVCSKKKIKTDKPYGIGGGLTVDVDANGRKGKGKGVYQFVDKYGANVDGYSPIYNEDDWSPTGDVYVGGTTGLLIWAVTLAGILGRXALLVYNTSGPLRLKDYPMHALLAIRHVKSGCRSII

SEQ ID NO: 57206 - DNA, 750 bp, Zea mays
  misc_feature: Ceres CLONE 1503207
aaagctggagctccccgcggtggcggccgctctagaactagtggatcccccgggctgcaggaattcgtctcacccctagaaaaatcacaattcacagcgctcaagttctcgcgcccacagccaaatttttctccactcaatcgcggcataagctgcactgcatccatggacgccagcggagccggtagcaaggcgaataatgaggccgctggccgcaacgctggctgccccaggaacaagtccgagtcccccttccgtcaaggccgggctgcagatccccatcgcccggatccgccgctacctcaagaaggggcagaacgcgacgccccgtgggcatcggcgcccccgcctatcccccccccgagcttttttttcccccccccccaggggggggggggggggcccccaacccccccccacaacccaccccgtagagggggatcaatcacccgacacttgctcacgggccgagtcggacgccactccaatcatcgccaagcctactggcgggggcctccccattcccgcaccggcgccgaaacttccccaagccacaaacccggcctctccccgcccccaaaccggggcggcaaaaaaagcgccttaccgtggcctccccaacgagaaatccaccccccctgctcacagccgccccgcttccctcggaggagggcgccccgccaaccccccacacacacaaccgcgctgcccacccgacccctcgccatacggctgtccacccccaccccg

SEQ ID NO: 57207 - DNA, 780 bp, Zea mays
  misc_feature: Ceres CLONE 1503208
  misc_feature: Encodes the peptide sequence at SEQ ID NO. 57208
  misc_feature (780)..(780): n is a, c, t, g, unknown, or other
atagctggagctccccgcggtggcggccgctctagaactagtggatcccccgggctgcaggaattcgtctcacccctagaaaaacacatctatctcaactccagagttcatccgccaatctccagacgccatacgatgacacattttcgttcctaccacctaacctgctgacagggtctgcaaacgatgccatgggtctggaactgggccagttgcaccaagtaatttctcagggccagccaattcagccagcaaacgtgggatacgttgactggcccaggaaccgcgacaagcagtacgccgacgacttcacagaggacattcgcgtgaagagccaccagatggcccaaagcgaggacatgccacatcttgttgagggccttcccccaggggtgggagccccccggaatttttccaaaaaacccttcaatttcccgccctaaatggcctcctcccttgccaaccccggggttaaaaacaagccccccctttttctcggaaaatttttctctcgcggggctaaaaaaaaaggggcaccaaaaagggggggtcactccccccaaaaaaaaaacttcccacaaacagggccccactctccacaacagagaaataccacccccggaggctttctaaaaacgacagagggtggcttataataatacagacatcctgcggggccccccccaccccctctgggagacacaggtgaaaaaaggtggcgtcacccagtcctcaacaacccctctcactggtgcttctttctttattgcgtctaacccn

SEQ ID NO: 57208 - protein, 83 aa, Zea mays
  misc_feature: Ceres CLONE 1503208
MGLELGQLHQVISQGQPIQPANVGYVDWPRNRDKQYADDFTEDIRVKSHQMAQSEDMPHLVEGLPPGVGAPRNFSKKPFNFPP

SEQ ID NO: 57209 - DNA, 669 bp, Zea mays
  misc_feature: Ceres CLONE 1503211
  misc_feature: Encodes the peptide sequence at SEQ ID NO. 57210
aagctggagctccccgcggtggcggccgctctagaactagtggatcccccgggctgcaggaattcgtctcacccctagaaaaagctcaagccacctacaccaccaccccgccggccacactcgtctttctcacgagccacaggcacaggcaggctctcgagctcagtccacccagcgcaggggatggcgtcgtcgttcgccgtggcaacggtcccgtcgctggcggccccggcggccaagaagcggtccggcggcgtcacgtacgtggagggcatgaacgcctacagcggcctcaaggggctcaacaaggtgaacatgctcggggtgcgcaagaccgccgactactccttcgccaaggtcgtggcgtcgctcagccccgcgggcaggaagcggcgcggcggcgcgttcggcgcccagatgaacgccgccgccgagatcttcaggatcgccgccaccatgaacggcctcgtgctcgtcggcgtcgccgtcgggttcgtgctgctccgggtggaggccgccgtcgaggagtccgagtagggtgcgtggggcctgcactgtcggctgtcgccccgggccccagtctgcttcaaaaaccgtgatatatatataaccagatgtacgctttcgaaatcaatttactttgggatgtatccctgaccaattggtgag

SEQ ID NO: 57210 - protein, 117 aa, Zea mays
  misc_feature: Ceres CLONE 1503211
  misc_feature (79)..(115): Pfam Name: PetM Pfam Description: PetM family of cytochrome b6f complex subunit 7
MASSFAVATVPSLAAPAAKKRSGGVTYVEGMNAYSGLKGLNKVNMLGVRKTADYSFAKVVASLSPAGRKRRGGAFGAQMNAAAEIFRIAATMNGLVLVGVAVGFVLLRVEAAVEESE

SEQ ID NO: 57211 - DNA, 856 bp, Zea mays
  misc_feature: Ceres CLONE 1503213
  misc_feature: Encodes the peptide sequence at SEQ ID NO. 57212
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (29)..(29): n is a, c, t, g, unknown, or other
  misc_feature (38)..(38): n is a, c, t, g, unknown, or other
tttttttttttttttttttttttcnnntnccccacccngattttagttctccaagctggagctccccgcggtggcggccgctctagaactagtggatcccccgggctgcaggaattcgtctcacccctagaaaaagctcttctgtctccacgagattgttgaattcatctctgccctagcaccagccatggcgaagccgcagcttcttctctgtttcctactcgccgcctccgcgccgctaatcgtcgcctcggccaagaaatccggggacgtgtcggagctccagatcggcgtcaagtacaagccggaatcatgcagcattcaagctcacaaaggtgacaaggttaaagttcactaccgtcggaaacttactgatggaacggtttttgattcaagctatgaaagaggtgaccccgattgaatttgaattggggcacgggacaaagtgatcaaagggatgggaatcatggggtctccctgcaaaatgtgccgtttgggtgaaaaaccggaaagttgaaagatccccatccaaaggctttggcctatggggccctcaaaggcttcaacccaccattcctttttcccgggggtggaagccaacccttccttatatttgaacaccggaagcccttgttcgccttgtccattgggaaaaaccctaccctaacccgattcttgaacaagggcttttagtattcccttcaacaccaaaggaaattccctttcgccccttttgttaacttcgagaaactcaaacacgaatgtataatgcctttcccagaagaaaaagagaatcctttcatttgtccctggccaatatttccataagattctctttccgagtgggtcacacaag

SEQ ID NO: 57212 - protein, 77 aa, Zea mays
  misc_feature: Ceres CLONE 1503213
  misc_feature: SWISSPROT Homolog: EC 5.2.1.8 Peptidylprolyl isomerase
MAKPQLLLCFLLAASAPLIVASAKKSGDVSELQIGVKYKPESCSIQAHKGDKVKVHYRRKLTDGTVFDSSYERGDPD

SEQ ID NO: 57213 - DNA, 844 bp, Zea mays
  misc_feature: Ceres CLONE 1503216
  misc_feature (1)..(1): n is a, c, t, g, unknown, or other
  misc_feature (10)..(10): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (50)..(50): n is a, c, t, g, unknown, or other
ngggggggangggggggggnnngggggaatttttcttggttgtctccttntcttaaactgggactccccgcggtggcggccgctctagaactagtggatcccccgggctgcaggaattcgtctcacccctagaaaaaaccgcgctcaggagcattcgagaagccgaagaaaattcgaagacgaggagcagctacactgcggacggacttcgggcatggagggccagttccaggttggcaaggaggaggtcatccaagcttggttcgtggacgacagttgaagaggaccagagggcttcctcattcatcgcgagcccaaagagttcatccctctcgacagacttttccgaactaggagattattagggtgggcgcctaaatggctgatgatggggagaactgatgagaccctcaggaaaattcatgaaaccccagaggtctgctctttaccatggacaattttggggggccgggcccaaaaagaaatcggcgaaaaggggcaaaggtatatgatcaaaaaaattgggcttgtaaggaaaactttgcgtgactgaatggaaagaaaaatcccagaatatttgcccttctcagggtgggcggcaataagtttgggatggggagggggaccaaagatgggcccagggggaatcccttggtaacgggtaaaaataagggggggggctggattcatttttgcccggccagaaaaggtatgcaccccctttgtactggcggagatgccgccccccctccatccggcggcagatgcggcccatttcaaggggcccacccctggcaagggcacgcaataaaaacgcgtcgcggaacaacccgtcttcgggggc

SEQ ID NO: 57214 - DNA, 754 bp, Zea mays
  misc_feature: Ceres CLONE 1503218
  misc_feature: Encodes the peptide sequence at SEQ ID NO. 57215
aagctggagctccccgcggtggcggccgctctagaactagtggatcccccgggctgcaggaattcgtctcacccctagaaaaacaaccgcacagcagcagctggggtgctgacgtgctgtgggtggttctgttgtccatggcgcggaagcatcagcatgttgccatatttaccacagcgtgcttgccgtggatgactgggactgcggtaaacccactgtttcgggctgcataccttgccaaggctggagattgggaggtcacgctggtggtgccttggctgtccaagggggatcaggagctcgtttatccaaacaagatgaggttcagtttgccggcagaacaggaaaaactatgtgcggccggtggcttgaaggacggactggggctgttgcccaaatttggacaaaaaagtcctacccggggaaggtttccacctgaaaaaaaaaattttcccaccctggtggaaaaatttcctcccaaacaatatccgaatgaaaaaaccggaaattttcccgggccttaaaaaaaccaaaaacttcttttcttggccccccccggggacggggggggaaaaaacaatctcccaaaaaagtttaagggggggtcccacacaccttttgtaaaacgcggaaaaaaaaaaaaaaaaaaaaccccccggggccccccttccccccataggagggagttattaccccgcccccccggcccctcttttaaaccgggtagggggaaaacaccgggttccccctattt

SEQ ID NO: 57215 - protein, 128 aa, Zea mays
  misc_feature: Ceres CLONE 1503218
  misc_feature: SWISSPROT Homolog: EC 2.4.1.241 Digalactosyldiacylglycerol synthase
MARKHQHVAIFTTACLPWMTGTAVNPLFRAAYLAKAGDWEVTLVVPWLSKGDQELVYPNKMRFSLPAEQEKLCAAGGLKDGLGLLPKFGQKSPTRGRFPPEKKNFPTLVEKFPPKQYPNEKTGNFPGP

SEQ ID NO: 57216 - DNA, 668 bp, Zea mays
  misc_feature: Ceres CLONE 1503397
  misc_feature: Encodes the peptide sequence at SEQ ID NO. 57217
aaagctggagctccccgcggtggcggccgctctagaactagtggatcccccgggctgcaggaattcgtctcacccctagaaaaaaccaaactgctagcagcgtcagcgcccgaccaaatttcccccctcacctccccctctcccgtcgtcggcatggccaccgacgtgctgcgcgcgcgcaacatcctcttgccggcgccgccgcagaggatccgggcggcggcggcggcgcgccggagggcagctggtagcgacagccaccaccccggcgccaccgccaccaggaggaggtcgccggcggccgggacatcgtcccccgcggcggggcgaagacaccccggcggcaggagggcgaggcctgcggcggaggtgtacgccggcccatcgttctcgacgtcccccgacccgagcttgctgccgctaccgcagtttgctgccaggaaggccgtggccgtggccatgacgaccgccgtcgatgccgccgccgcgacgcgcgacctcaggcttatcctgcggctggagtagccatcaagacacatagctcgtctgctagctctaacgctggcttcgatttctctaattaattcttccttctttattagctcctactcctagtctttgtccacgcatcatcaatcgagctgcatgttaagtttggctggctctcc

SEQ ID NO: 57217 - protein, 123 aa, Zea mays
  misc_feature: Ceres CLONE 1503397
MATDVLRARNILLPAPPQRIRAAAAARRRAAGSDSHHPGATATRRRSPAAGTSSPAAGRRHPGGRRARPAAEVYAGPSFSTSPDPSLLPLPQFAARKAVAVAMTTAVDAAAATRDLRLILRLE

SEQ ID NO: 57218 - DNA, 667 bp, Zea mays
  misc_feature: Ceres CLONE 1503401
  misc_feature: Encodes the peptide sequence at SEQ ID NO. 57219
aaagctggagctccccgcggtggcggccgctctagaactagtggatcccccgggctgcaggaattcgtctcacccctagaaaaaagccaagcaaataagacgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacggctgcagctgcggtggcaactgcaagtgcgacccctgcaactgctgatcacatcgatcgacgaccatggatatgattattatctatctagcttgtggtggtggttgaacaataataagcgaggccgagctggctgccatacataggtattgtgtggtgtgtgtgagagagaagaaacagagttcttcagtttgctatctctctctgcatggttggcgtcagtctttgtgctcatgtacgtccgtgtgtccacctgcatgttgggtggatcccaatgcatctgccgaaaccataaattatttggcccccaatgaaatgaatttgaa

SEQ ID NO: 57219 - protein, 76 aa, Zea mays; identical to SEQ ID NO: 8464
  misc_feature: Ceres CLONE 1503401
  misc_feature (1)..(76): Pfam Name: Metallothio_2 Pfam Description: Metallothionein

SEQ ID NO: 57220 - DNA, 646 bp, Zea mays
  misc_feature: Ceres CLONE 1503402
  misc_feature: Encodes the peptide sequence at SEQ ID NO. 57221
aaagctggagctccccgcggtggcggccgctctagaactagtggatcccccgggctgcaggaattcgtctcacccctagaaaaaaccttgccatcacctcctcgcctagcctgccactgccagcaggtgccaccgccatctctgctctgctctcgcaacgcaagcacacgcccggccgcctgccacagttgccatggcgaccatagccacgatggcgctgctgaagcccgccgccaaggccgcggcgcggtcggcgccgtccaccagcagcggcagcgtctcgctgcgcgtccggacggggcaggccgccaagaaggctgcggtgtccgcgtccgcgtcgtccacgctggcgggcgccttcttcgcggcgctggcgtcgtcgcccgacgctgcgctggcggacgtcgtggcggcggcggacgccggcggcgacagccgcggccagctgctgctcgtcgtggtggcgcccgccatcgggtgggtgctgtacaacatcctgcagccggcgctgaaccagctgaaccgcatgcgcagcagccaagccgtggccgctggcctgggcctcggcgccgccgccgcccgggatggccgcccccgcccgaggcctccgccgcccgtgtgcaggacctcgcagcaatcgccgccg

SEQ ID NO: 57221 - protein, 151 aa, Zea mays
  misc_feature: Ceres CLONE 1503402
  misc_feature (80)..(114): Pfam Name: PsbY Pfam Description: Photosystem II protein Y (PsbY)
MATIATMALLKPAAKAAARSAPSTSSGSVSLRVRTGQAAKKAAVSASASSTLAGAFFAALASSPDAALADVVAAADAGGDSRGQLLLVVVAPAIGWVLYNILQPALNQLNRMRSSQAVAAGLGLGAAAARDGRPRPRPPPPVCRTSQQSPP

SEQ ID NO: 57222 - DNA, 666 bp, Zea mays
  misc_feature: Ceres CLONE 1503403
  misc_feature: Encodes the peptide sequence at SEQ ID NO. 57223
  misc_feature (666)..(666): n is a, c, t, g, unknown, or other
aaagctggagctccccgcggtggcggccgctctagaactagtggatcccccgggctgcaggaattcgtctcacccctagaaaaagtgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccctgatggcggcggcggctacggcggtggcggcggcggctacggtggcggccgcggctaccgtggtggttgcggcggctacggcggtggcaaccgtggcggcggctacgggcactcccaacgggacttggaggaacttgagcgggggggn

SEQ ID NO: 57223 - protein, 161 aa, Zea mays
  misc_feature: Ceres CLONE 1503403
  misc_feature (10)..(81): Pfam Name: RRM_1 Pfam Description: RNA recognition motif. (a.k.a. RRM, RBD, or RNP domain)
  misc_feature (48)..(151): Pfam Name: GRP Pfam Description: Glycine rich protein family
  misc_feature: SWISSPROT Homolog: EC 5.2.1.8 Peptidylprolyl isomerase
MAASDVEYRCFVGGLAWATDDHSLHNAFSTYGEVLESKIILDRETQRSRGFGFVTFSTEEAMRNAIEGMNGKELDGRNITVNEAQSRGGRGGGGGGYGGGRGGGGYGGGGRPDGGGGYGGGGGGYGGGRGYRGGCGGYGGGNRGGGYGHSQRDLEELERGG

SEQ ID NO: 57224 - DNA, 667 bp, Zea mays
  misc_feature: Ceres CLONE 1503410
  misc_feature: Encodes the peptide sequence at SEQ ID NO. 57225
aaagctggagctccccgcggtggcggccgctctagactagtggatcccccgggctgcaggaattcgtctcacccctagaaaaatgggcgagcccgttcgtgctccgggcgcgcatcgcgctcagcctcaaagggctcacctacacttactccgaggagaacctcgacgacaagagcgagcttctcctcagctccaaccccgtgctcgagaaggtgcccgtgctcatccgccacggcaagcccggctgcgagtcccagatcatcgtgcagtacgtcgacgaggctttcccggccgccacatctaattgccttccatccgacccctacgaccgcgccattgatcgcttcagggcctcctacgtcgacaactagttctacagcgcgtggatacccgtgttcaggggaaggaccgcggaggagatggcggaggccgcgaggcaagacgtcgcggcgctggagacgctggaacatgcgtacaaggagtgctccatggggaaggccttcttcagaggggacagcggggggctcgtctacatcgagctcggcggccttgttgggtggctgtacgccaccgaggccatctgcggggtgaacgccctccaaacctgcaggacccccctactggcggcgggtgggaagcggttctacgccctggacggtgtaaaggg

SEQ ID NO: 57225 - protein, 82 aa, Zea mays
  misc_feature: Ceres CLONE 1503410
MAEAARQDVAALETLEHAYKECSMGKAFFRGDSGGLVYIELGGLVGWLYATEAICGVNALQTCRTPLLAAGGKRFYALDGVK

SEQ ID NO: 57226 - DNA, 697 bp, Zea mays
  misc_feature: Ceres CLONE 1503415
  misc_feature: Translation starting site: 179
  misc_feature (337)..(337): n is a, c, t, g, unknown, or other
  misc_feature (411)..(411): n is a, c, t, g, unknown, or other
  misc_feature (422)..(422): n is a, c, t, g, unknown, or other
  misc_feature (426)..(426): n is a, c, t, g, unknown, or other
  misc_feature (445)..(445): n is a, c, t, g, unknown, or other
  misc_feature (452)..(452): n is a, c, t, g, unknown, or other
  misc_feature (518)..(518): n is a, c, t, g, unknown, or other
aaaactggagctccccgcggtggcggccgctctagaactagtggatcccccgggctgcaggaattcgtctcacccctagaaaaagaagcttatcgcttatcatccgcgcctctacatttcttctctctctgctcctccgcctccgcctccgcctgatccatccaagacagggatcgccatgtcggactcggaggagcaccacttcgaatcgaaggccgacgctggggcgtccaagacctacccgcagcaggctggcaccgtccgtaagaacggcttcatcgtcatcaagaaccgtccctgcaaggttgtggaggtttctacctccaaaactggtaancatggccacgccaaatgccactttgtcgccatagacatattcaatggggaaaaagcttgaagatattgttcctncatcacacacntgtnacattccccatgtgaaccntactgantatcacctgattgatatttctgaagatggatttgtgagccttcttacttcaaatggcaaccctaangatgatcttaagactccccacttaataaaacctcttgtggcccccaaattaaagaaaggggttccaaaaccgggaaaggattcttgtttttaaactgtcccaggcctcccaatcgggggaaagaaaaaaaattttcccccccctaaaaggaatgttgggccccccaaggaaacgttgcg

SEQ ID NO: 57227 - DNA, 762 bp, Zea mays
  misc_feature: Ceres CLONE 1503419
  misc_feature: Encodes the peptide sequence at SEQ ID NO. 57228
ggagctccccgcggtggcggccgctctagaactagtggatcccccgggctgcaggaattcgtctcacccctagaaaacaccctcgccaccaaccgcccccgcaccacggccagaaccctagtcacttctccgccgcccactccatggaggacgacgccatctcgacgctcatggacatcgacgactcgccgctcagcgctgcgggggccgggttcctcgacgaggaggacggggaaggcgagatgttcttcgccccgcaccgcgcggcccgcggccgtgctggcgatgcccgcggggcccctcccctttttccgggttcttcaacagcttcgacggcgcccatttttgacgacgaatttcctcccctccccggaagggcgggcgcggggcgcggtaaccggacgtcgcctcctgggatttgggaaaccgtgatactgctctcaccacccccccccggggtccctcctcacgacagcccccatagccatcccaacacatcccccccggggccctgccctcccgtgagtcgttccggcccgaaccaccatctcaccctcccgcatgtaccgtgccgcggggacctcaacgcgttacctctgcataaccccccccggcggccgacgtgcccaccgcccgcctcggcgcgccccggctgctcatcgcgccccccccctcccgccttcgcgcatatcctttcgcactcccacacagcgcaactctcgcgcccctccctcccacgccacccctgctacactccctcct

SEQ ID NO: 57228 - protein, 206 aa, Zea mays
  misc_feature: Ceres CLONE 1503419
MEDDAISTLMDIDDSPLSAAGAGFLDEEDGEGEMFFAPHRAARGRAGDARGAPPLFPGSSTASTAPIFDDEFPPLPGRAGAGRGNRTSPPGIWETVILLSPPPPGVPPHDSPHSHPNTSPPGPCPPVSRSGPNHHLTLPHVPCRGDLNALPLHNPPRRPTCPPPASARPGCSSRPPPPAFAHILSHSHTAQLSRPSLPRHPCYTPS

SEQ ID NO: 57229 - DNA, 645 bp, Zea mays
  misc_feature: Ceres CLONE 1503420
  misc_feature: Encodes the peptide sequence at SEQ ID NO. 57230
aaagctggagctccccgcggtggcggccgctctagaactagtggatcccccgggctgcaggaattcgtctcacccctagaaaaaatctcatcattgacgaactcgaagcttgcgttccttgtactagaggtcggcagcaagcggtggtacaccgagaggtcgataagatgaagagcagcactctgttggcgatcctagttctccaggcccttctggtctctgcggccgtggccaaaggacctgcagggcctaccaccaaaaagcactgctggtgcgccgagagcaccatctggtccgggagtgtgcacctgcgacgacctcctaaccaagtgcgcctgcacctgcaagaactgcttcaccgtgtaccacgaacaagggggccatcaagtacatgagccgcgactatctccccgaaaactgcggctgcaagatccactacagactcatccaattccacataggccgcgcgccacagcggcacagccgatcgatccttccatgtttctccgtccgtccgccttgctacaagcaggcagccacaccaataagctagctcttgctgctgttttcgatgtttgaatgggggtccctttccagtctagatggaataaaataattcatcacgcgtcaaaaaaaaaaaaaaag

SEQ ID NO: 57230 - protein, 75 aa, Zea mays
  misc_feature: Ceres CLONE 1503420
MKSSTLLAILVLQALLVSAAVAKGPAGPTTKKHCWCAESTIWSGSVHLRRPPNQVRLHLQELLHRVPRTRGPSST

SEQ ID NO: 57231 - DNA, 628 bp, Zea mays
  misc_feature: Ceres CLONE 1503421
  misc_feature: Encodes the peptide sequence at SEQ ID NO. 57232
  misc_feature (85)..(85): n is a, c, t, g, unknown, or other
  misc_feature (195)..(195): n is a, c, t, g, unknown, or other
  misc_feature (212)..(212): n is a, c, t, g, unknown, or other
aaagctggactccccgcggtggcggccgctctagactagtggatcccccgggctgcaggaattcgtctcacccctagaaaaaagnccgcatcccttctttcattcgccgccgccgcctgctctctgctgccgtcgccatggggagaaggcctgcgagatgctatcgccagatcaagaacaagccatacccccaangtccaggtactgccgtnggtgttcccctgacccccagatcaggatctacgatgttggcatgaagagaaagggtgttgatgagttcccctactgtgtgcaccttgtctcttgggagaaagagaatgtctccagtgaggctcttgaagctgcccgtattgccctgcaacagtacatgaacaagtctgcaggaaaagatgcctttccaccttccggggcggggtttcaccccttccaatgtcctttcgaaaccaacaagaaatgcttttcccgggggcctggggcgttgaaaaaggtcccccaaactggaaaaaaagggggggcctttttggaaaagcccccgggggacccctttgtcttagggggggaaatattgtggaaaaggcccccccccttttttgtggttcgaggggggggggaaaaaaaaaatgggttc

SEQ ID NO: 57232 - protein, 157 aa, Zea mays
  misc_feature: Ceres CLONE 1503421
  misc_feature (13)..(13): Xaa is any aa, unknown, or other
  misc_feature (19)..(19): Xaa is any aa, unknown, or other
MLSPDQEQAIPPXSRYCRXCSPDPQIRIYDVGMKRKGVDEFPYCVHLVSWEKENVSSEALEAARIALQQYMNKSAGKDAFPPSGAGFHPFQCPFETNKKCFSRGPGALKKVPQTGKKGGAFLEKPPGDPFVLGGEILWKRPPPFFVVRGGGEKKNGF

SEQ ID NO: 57233 - DNA, 655 bp, Zea mays
  misc_feature: Ceres CLONE 1503424
  misc_feature: Encodes the peptide sequence at SEQ ID NO. 57234
  misc_feature (569)..(569): n is a, c, t, g, unknown, or other
  misc_feature (584)..(584): n is a, c, t, g, unknown, or other
  misc_feature (593)..(593): n is a, c, t, g, unknown, or other
aaagctggagctccccgcggtggcggccgctctagaactagtggatcccccgggctgcaggaattcgtctcacccctagaaaaagcctcgtcacctctatcctccggtctctcaccgcctaacacggccgccatggccgccgcctccacctcccttccccttggcttctcctctcaccaccgcccaactcccagaatccggccgcagccccagtcccagtcgcaaccactgaaggcaaaaccccttaacccccttcgcttcagcctagccctcaccccggcgaccgcgaagccccgcctcgctgcgatgcccgacgatgtcgctgtcgccaacttcgtggagaaggactggtcgttcctcgagtccgcgggcgcaaacctccagcgcgctctcgcgtcgggggcgctctcgccggcgtcgcgggtgttggcattgacgcccacggcgtccttcgtgaggtcgctcctcgcgtcctcgccctgcgagctactggtggccgcgcatgagtcgatgtacgtgctggcaggggtcaaggaggcgcacgacgaggtgaggtgcttccaccctcnagggtgggggcggcngcaaaagcngcgggcttgttggaaggcctgccagagaagttccaccaactcgatggtgtggttcgtgtgca

SEQ ID NO: 57234 - protein, 174 aa, Zea mays
  misc_feature: Ceres CLONE 1503424
  misc_feature (146)..(146): Xaa is any aa, unknown, or other
  misc_feature (151)..(151): Xaa is any aa, unknown, or other
  misc_feature (154)..(154): Xaa is any aa, unknown, or other
MAAASTSLPLGFSSHHRPTPRIRPQPQSQSQPLKAKPLNPLRFSLALTPATAKPRLAAMPDDVAVANFVEKDWSFLESAGANLQRALASGALSPASRVLALTPTASFVRSLLASSPCELLVAAHESMYVLAGVKEAHDEVRCFHPXGWGRXQKXRACWKACQRSSTNSMVWFVC

SEQ ID NO: 57235 - DNA, 830 bp, Zea mays
  misc_feature: Ceres CLONE 1503425
  misc_feature: Encodes the peptide sequence at SEQ ID NO. 57236
  misc_feature (20)..(20): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
ccccgcggatttatcccacncccccnnnnnnnnnnnaatggccnnnnnacccgtggggccccccccggtggcggccgctctaaactagtggatcccccgggctgcaggaattcgtctcacccctagaaaaagtcgcccacaaaaacccagtaactcgcatcttcctccgtgatccaagttctagcagcgcagcgctcggtttcggtaatgtcggggcgcggcaagggcggcaagggtctgggcaagggcggcgccaaacgccaccgcaaggtcctgccccaccaactccagggcatcaccaagccggcgatccggaggccggctccgaggggcttccctccgggcgggggccggggctcatctccaaggagtctctccctgggggtcccggatctttgtagaacaaagtttttttttttcccccccccccccgggggggaagacgggggggcgcctcctttccccctcccccccctttttggggtgtatggtttccagaaacattatagtacaatttgaacggggccgtgtgcggggaggtatctccgcacccaccgccgcgccccctcgcgcctgcccggggcgaggccaccaccgacttccttctttctgccgccctggtgtcgcccccgcatgtgttgcgccggacgtatacctcaacccttcccacctccccccgtctacgccgccccccgacgcctataggtggaggggcggtgtggcgtcccccctgtccccgctccctcatattctccgttcgccatgccccatccccacgcggcaccgccgccctccacctctacccccccccttgcacatgccccccgccc

SEQ ID NO: 57236 - protein, 103 aa, Zea mays
  misc_feature: Ceres CLONE 1503425
MSGRGKGGKGLGKGGAKRHRKVLPHQLQGITKPAIRRPAPRGFPPGGGRGSSPRSLSLGVPDLCRTKFFFFPPPPGGEDGGAPPFPLPPLFGVYGFQKHYSTI

SEQ ID NO: 57237 - DNA, 728 bp, Zea mays
  misc_feature: Ceres CLONE 1503540
  misc_feature: Encodes the peptide sequence at SEQ ID NO. 57238
  misc_feature (682)..(682): n is a, c, t, g, unknown, or other
  misc_feature (728)..(728): n is a, c, t, g, unknown, or other
cgattgggtaccgggccccccctcgagcactgcagtggtaaagggagagcagcgcagcgcagcgcgcggggtgggagtgggagtgggagccgcggcatggcgtccggcgtgtcgccgagcatggcgctggcgctggcgggcttctgcttcagcctcatcttcatcgccttcgtctgctcccgcctcgcctgcgcgctcctccgccgccaccgccgccgggcccgctcgcgcctcctcgccctcccgcgctactacaccgactactccttcgccgcccaccaccccgcgcccggcggaggcggcggactcgggcccgccgccgtcgcagccctccccacccgcgccttcgccgcccgccacagcggatccaccggcgtccgatgccaactcacaatgcgataattgccacgaacaatacgaaaaaagggacttgttacctgtatttccctacagtgcggcaaaggactttcggcatggaaaagaaaaacagacaaggccgggaacgtaaaaatcaacctgccccggttggacaaaacctcgaaagcatcaatgacccctcatttcccaagcaacaaggcaccctcaggctaaacgatcaaccccactaacctcgtgaaagcctttacactaagaacgttcttccatggataccccctaaaacccaaaagatatttctgacccngaagaacggttatactggctcaaacagagggcaaagcagaaaacan

SEQ ID NO: 57238 - protein, 101 aa, Zea mays
  misc_feature: Ceres CLONE 1503540
MASGVSPSMALALAGFCFSLIFIAFVCSRLACALLRRHRRRARSRLLALPRYYTDYSFAAHHPAPGGGGGLGPAAVAALPTRAFAARHSGSTGVRCQLTMR

SEQ ID NO: 57239 - DNA, 621 bp, Zea mays
  misc_feature: Ceres CLONE 1503547
  misc_feature: Encodes the peptide sequence at SEQ ID NO. 57240
  misc_feature (249)..(249): n is a, c, t, g, unknown, or other
  misc_feature (285)..(285): n is a, c, t, g, unknown, or other
  misc_feature (295)..(295): n is a, c, t, g, unknown, or other
  misc_feature (296)..(296): n is a, c, t, g, unknown, or other
  misc_feature (363)..(363): n is a, c, t, g, unknown, or other
  misc_feature (408)..(408): n is a, c, t, g, unknown, or other
cgattgggtccggccccccctcgagccctgcagtggtaaagggttcgctctcgcccaagtcatcgtctggtcgtcgcccgcagaggcgcagacgcccaaagccggaaggggcgccatggccgcgtcggatctggagagcaaggccaaggaggccttcgtcgacgacgacttcgagctggccaccgagctctacagccaggccatcgacgccgggcccgccaccgccgaactctatgccgaccgcgcccnagcgcacatcaagctcggcaactacactgaggctgntgcggatgcnntacaaagcattgagcttgatcctatgatgcataaagcttactaccgggaagggtgctgcatgcattnagcttgaaaaataccaaactgcaaaggctgctccttgaattgggntccttctattgcatcaggcgaatccaggtttgctcgtcctattgaaaggatgggattaaccccctccctaaaggaacttagcccggcccccgttaaaaaaagttaaagcctccttggggctccccccttttggggaacaaggggggtttccccaatatttgggaaaaacccccccccggggataaaaaccccccaagaaaaacccaaataagg

SEQ ID NO: 57240 - protein, 84 aa, Zea mays
  misc_feature: Ceres CLONE 1503547
  misc_feature (37)..(70): Pfam Name: TPR_2 Pfam Description: Tetratricopeptide repeat
  misc_feature: SWISSPROT Homolog: EC 3.1.3.16 Phosphoprotein phosphatase
  misc_feature (45)..(45): Xaa is any aa, unknown, or other
  misc_feature (57)..(57): Xaa is any aa, unknown, or other
  misc_feature (61)..(61): Xaa is any aa, unknown, or other
  misc_feature (83)..(83): Xaa is any aa, unknown, or other
MAASDLESKAKEAFVDDDFELATELYSQAIDAGPATAELYADRAXAHIKLGNYTEAXADAXQSIELDPMMHKAYYREGCCMHXA

SEQ ID NO: 57241 - DNA, 743 bp, Zea mays
  misc_feature: Ceres CLONE 1503551
  misc_feature: Encodes the peptide sequence at SEQ ID NO. 57242
  misc_feature (382)..(382): n is a, c, t, g, unknown, or other
tcgagccctgcagtggtaaaggggtcgccgcctctcactcttacagtcgcactcgttccacttgcattcccagtgaccccgcccgcccggaggcgtcgcacctgaacgccgcggaagcagccaagcctctctcgtctcgtgcggcaagagccacacagacgcccgatggcggctcctgctgatgcgcggctgcgccgcaccgcccgacgtccacgcggcaccggcggcgtcccggctgctccctccgatgctgccacggcagcggctcgtggccggcgaatcatgcgcctcttccgctacgtcggaagaggaggagtcatcgtcccatcacggccgaggatatggaaaagaaggtgggtgactgacggctaagaccaatcgntccggtccacaacacatcaggaatcgcccgacgggcgaaaaaaaaccgttcgaaagagggggcctccctgtcgaacttaccggtatcttggggaagttccttagaacgctacgccccggaggcaaggccggatggtgtccccgacccgggttccgtcccacacctgcgagtggacttccttccgcccaaacaaaggaaagacccttgtttaagctgtgcaacaacatggttaaatccggagggtctcttccccggggcataatggaacttcccacgctttttccaacgccacccccaccagaatgtttttttttctctagcaaaaaaaacgccccctaaactaggggtaggcgccttcccg

SEQ ID NO: 57242 - protein, 59 aa, Zea mays
  misc_feature: Ceres CLONE 1503551
MRGCAAPPDVHAAPAASRLLPPMLPRQRLVAGESCASSATSEEEESSSHHGRGYGKEGG

SEQ ID NO: 57243 - DNA, 641 bp, Zea mays
  misc_feature: Ceres CLONE 1503553
  misc_feature: Encodes the peptide sequence at SEQ ID NO. 57244
cgattgggtacgggcccccctcgagccactgcagtggtaaaggagttggagggggccgggagaggcgtctctggttattgctgggagtggacgggccgggaaggagacgagaagataagggcgccgcgcgcggccatggctggaagtgcgccggcgacggcgatggacaagaccagctttgccaccacgtgcagcctgctgagccagtatgtcaaggagaagaagggcggcctgctgcagggtcttggtggcctcgccatggcgccagcagctggaaaagaaggagctttccggccgccgaccaccatgaacttgctgtcagcgctcgacgacgcgccggccgaggagcgcagcgagaaggccaccgccggggagccaaaacaccaggacaaatgcaccggcggaaatccaagggaggaggcagccggagaggatgaggaggaggcgcagcagctgaccatcttctacgagcggcacagtggtcgtcttcgacatgttcccctccgccaaggacaaggacctgctgcagatcatgagccctggcggcgaccgcgtggacacggcagccggtgccactgtccctacgcggagtctgcataggccttcacacgacagcctctctgatctgccgattgcgagga

SEQ ID NO: 57244 - protein, 154 aa, Zea mays
  misc_feature: Ceres CLONE 1503553
MAGSAPATAMDKTSFATTCSLLSQYVKEKKGGLLQGLGGLAMAPAAGKEGAFRPPTTMNLLSALDDAPAEERSEKATAGEPKHQDKCTGGNPREEAAGEDEEEAQQLTIFYERHSGRLRHVPLRQGQGPAADHEPWRRPRGHGSRCHCPYAESA

SEQ ID NO: 57245 - DNA, 843 bp, Zea mays
  misc_feature: Ceres CLONE 1503560-R
  misc_feature: SWISSPROT Homolog: EC 1.1.1.39 Malate dehydrogenase (decarboxylating)
ccccgcggtggcggccgctctagaactagtggatcccccgggctgcaggaattcccagagctctggttttttttttttttttttagggcagtaatgaaccgagtccatattaaaaacttattttggaaatacatattccttcacaaaatggggctgttcatctttaaaaaaaaatagtaacctcacaatgtatcatgcttataaaagccccatgtacaaaattagacagtaccacttcaactaagcttgccccctcacttaggccctggtgaccaagctcactctttcttctagcaaaaggccgtgcatctggatcgatatcttctcggtcttctgttattaggccatgggcatccactatccaaaattgactcctcgcactctcaaaagcaacgtctttgtttcccaacattcttgccatggttctgcttgcagcattcaccactccaataccagcactgccagcgccagcaacaacaatcctttgctttggaaaatctatcattggcctcccttgtgcccgtacagctcctaaaaggcctgctattgcgacaccagcagttccctgaacatcatcattaaacatgcgataagtctttctgtaacgctgcaacaacctaaaggcccatttactttggaaatcttcaaactgtacaataacattaggccagcgagtaaaaacagcttccatgaattcatcaataactgaaacatattcatctcccctcaagacagttgctcttgtaggccaaaataaagaggatcctttaaggagctttctcgtttgttcgttccacctcattcttaaccgggaaagaccccttttgaggattttttccaccc

SEQ ID NO: 57246 - DNA, 795 bp, Zea mays
  misc_feature: Ceres CLONE 1503563
  misc_feature: Encodes the peptide sequence at SEQ ID NO. 57247
  misc_feature (47)..(47): n is a, c, t, g, unknown, or other
  misc_feature (48)..(48): n is a, c, t, g, unknown, or other
ggttgttagtaagataaaaaatacaacccaaaacaaaaaaatttttnnttcgattgggtacgggccccccctcgagccactgcagtggtaaaggggcttgcatagttgcatgtacacaatttctcgcgctcctaccgccgccgcttcgttctctaaccttggctcccgctccctccgcaggagcatctcaacaccgccttgaggaccccccaactcgccggctgcagccatggtgaaatattcaacggagccaaccaaccccaccaagtcaaccaaggccatgggccgtgacctacgtgttcacttcaagaacacccgtgagacagcttttgcccttaggaagttgttactcaccgaggccaaaaggtaccttgaggatgtgattgcccactagcaggccatccccttccgcaagtattagtggcactgttggacgtcctgctcatgataagtctcgtccattcaaatggaccccgcaccctggacctgtacaatctgctagatttattctagcaccctatcttcaacaaatgcttgaaaccaattgtttcgacggtaaaagggtccttgaaggtcgaatacccctcctatggtggtcacacaatccgaagtggaccccaggcttcagaaagcaggcggtctccaggaaccttacctgcggctccaagggtgcccccattaaacccttcaaattgttccatccccccgtgggccaacatccaaaaaatccattccttggcccccaaataaatggaaagaaaccccctgattaaaataaaacaaacgcctccaacc

SEQ ID NO: 57247 - protein, 54 aa, Zea mays
  misc_feature: Ceres CLONE 1503563
MVKYSTEPTNPTKSTKAMGRDLRVHFKNTRETAFALRKLLLTEAKRYLEDVIAH

SEQ ID NO: 57248 - DNA, 706 bp, Zea mays
  misc_feature: Ceres CLONE 1503567
  misc_feature: Translation starting site: 130
  misc_feature: SWISSPROT Homolog: EC 3.4.22.1 Cathepsin B
  misc_feature (303)..(303): n is a, c, t, g, unknown, or other
  misc_feature (368)..(368): n is a, c, t, g, unknown, or other
cgggccccccctcgagccctgcagtggtaaaggaattggcgttggccgaagaagaggagaagcgaagcaagcaggcttcgagaacaagggggagggggaggaccaagcgaaagggggaactagagcaagatgggcggcgaactgctgcttgcgctcctcctcgtctttgctgctgccgcccctcaggtacttggagttggcaatggagacaatcacatgagaatcatccaggaggacatcattgagacagtcaacaaccatcccagtgctgggtggacagcctcacgtaatccttacttttcnaactataccattgcgcaatttaagcacatacttggagtgaaaccagcaccacagaatgcactaangcatgttcctgtcaaaacttattcaagatcactggaacttccaaaaggagtttgacgctagatctgcatgggccccgtgcagccaaattgggaacctaactgatcaagggcactggggcccttgttgggcttttggggcttgggaagggcccccagacctttttgcattcccccccacaaggactttttattttcccccaaggacctaggggagtgtgggggtttttttcccccacaaggggttttaagagctctcttcattaaggggggggccctcttttttaaaaaggggtgtttttccacaaaggtgggccttccttttccccccgcggggggaa

SEQ ID NO: 57249 - DNA, 662 bp, Zea mays
  misc_feature: Ceres CLONE 1503582
  misc_feature: Encodes the peptide sequence at SEQ ID NO. 57250
tcgagccctgcagtggtaaaggttttggatcagaggagatgaagcatcatgaggactcgaggaagatatatccatccacccacccacacacattacacatatactttattctccggagtttcttggcctccggaaatctcctccccctggttgtaagcatgggtggggttcagccttaccggcgctaccagtttcgtggcgtaccgtgaggaataagacgatgagctgttatagacgtcgtcttcgatctatggcgactacgacgacgaggggcgccagatctccgatggataggggggcgcctatgatgtgtcttatgtgatggaacagctccctgtgaagaaagggctatcccgatactaggacggcgagttccagtcattcgagtagatgtcgcccctgccaagccaggaagatcttggaatgaatgagacggcccaccagaagatcaagacttcagggagtatcgctgcgttacacgaagagcacgactgtaatacgcccggttaatagtatctgaagtcaagcgcatcggaagttgtaagcagaaaccatggtggttccggaacaacggaaaataagttggtggacagaacttcccccatctacagggcaaaacaaaggggatttaggaacctatggtttttgggacctttattgga

SEQ ID NO: 57250 - protein, 39 aa, Zea mays
  misc_feature: Ceres CLONE 1503582
MSPLPSQEDLGMNETAHQKIKTSGSIAALHEEHDCNTPG

SEQ ID NO: 57251 - DNA, 642 bp, Zea mays
  misc_feature: Ceres CLONE 1503586
  misc_feature: Encodes the peptide sequence at SEQ ID NO. 57252
cgattgggtaccgggccccccctcgaggatcgatcctcgagccactgcagtggtaaagggaagcagcaacatatcaagctcagagcctcagagcgccagccaagtcttgcggtcgcgaagagcaacgcaacaagatggtgaagctcgcattcgtaagcgtcggcgactccttcagcgtcacctccatcaaggcctacgtggcggagttcatcgccaccctcctcttcgtcttcgccggcgtgggttccgccatcgccttcgggcaactgacgaatggcggcgcgctggaccctgcgggactggtggcgatcgcggtggcgcacgcgctggccctcttcgtgggcgtctccgtggccgcgaacacctccggcggccacctgaaccccgccgtgacgttcggcctggccgtgggcggccacatcaccgtcctcaccggcctcttctactgggtggcccagctgctgggcgcgtccgtggcgtgcctgctcctcaggttcgtgacccacggcaaggccatcccgacgcacggcgtctccggcggcaccaccgagctggagggcgtggtgttcgagatcgtcatcaccttcgcgctcgtctacaccgtctacgccaccgccgccgaccccaagaagggctccctcg

SEQ ID NO: 57252 - protein, 169 aa, Zea mays
  misc_feature: Ceres CLONE 1503586
  misc_feature (11)..(169): Pfam Name: MIP Pfam Description: Major intrinsic protein
MVKLAFVSVGDSFSVTSIKAYVAEFIATLLFVFAGVGSAIAFGQLTNGGALDPAGLVAIAVAHALALFVGVSVAANTSGGHLNPAVTFGLAVGGHITVLTGLFYWVAQLLGASVACLLLRFVTHGKAIPTHGVSGGTTELEGVVFEIVITFALVYTVYATAADPKKGSL

SEQ ID NO: 57253 - DNA, 675 bp, Zea mays
  misc_feature: Ceres CLONE 1503596
  misc_feature: Encodes the peptide sequence at SEQ ID NO. 57254
  misc_feature (477)..(477): n is a, c, t, g, unknown, or other
  misc_feature (478)..(478): n is a, c, t, g, unknown, or other
  misc_feature (481)..(481): n is a, c, t, g, unknown, or other
  misc_feature (511)..(511): n is a, c, t, g, unknown, or other
cgattgggtaccgggccccccctcgagccctgcagtggtaaaggagtttaaagcagcgcctcgccaccagacgaacacacagatcgctacagcccgcatgaccaacctctccgccatggcagcgaaccaatcctacgtgatccgattcgacggccacttcgacgagccgtcgccgagctccgcgggcgccgagccgccgggcccgcagccgccgttcgcagggaggatgatctcgctcgagcgggagcaccaagtcattgtcgccgccctgctgcacgtcgtctccgggtacgccacgccgccgccgcaggtcttcacgccgccgccggcagcggcgcgctgccaggtgtgcgggatggagcggtgcctcggctgcgagttcttcgccgccggggagggcgcattgggcggcggcgcggaaaaggcagccgcgacaggagggcgcggcgcgccggcggcggggcaaaggaggcggannganaagaagaacaagtaccgcggcgtgcggcancggccgtgggggaagtgggcggcggaaatccgcgacccgcgccgcgcggtgcgcaagtggctgggcacgttcgacaccgccgaagagggccgcaggggctacgaacaggccgccatcgagttccgcggcccgcgcgccaagctcaacttccgttccccgagcag

SEQ ID NO: 57254 - protein, 192 aa, Zea mays
  misc_feature: Ceres CLONE 1503596
  misc_feature (131)..(182): Pfam Name: AP2 Pfam Description: AP2 domain
  misc_feature (127)..(127): Xaa is any aa, unknown, or other
  misc_feature (128)..(128): Xaa is any aa, unknown, or other
  misc_feature (138)..(138): Xaa is any aa, unknown, or other
MTNLSAMAANQSYVIRFDGHFDEPSPSSAGAEPPGPQPPFAGRMISLEREHQVIVAALLHVVSGYATPPPQVFTPPPAAARCQVCGMERCLGCEFFAAGEGALGGGAEKAAATGGRGAPAAGQRRRXXKKNKYRGVRXRPWGKWAAEIRDPRRAVRKWLGTFDTAEEGRRGYEQAAIEFRGPRAKLNFRSPS

SEQ ID NO: 57255 - DNA, 658 bp, Zea mays
  misc_feature: Ceres CLONE 1503597
  misc_feature: Encodes the peptide sequence at SEQ ID NO. 57256
  misc_feature (1)..(1): n is a, c, t, g, unknown, or other
ncgattgggtaccgggccccccctcgagccactgcagtggtaaaggagaaactgagccggtgatccagctcggcgactccgaggtgctcacggagctgtccgggacgatcggcatcgtcgacggccacaccgtcataacctccatcaagttcgtcacaagcctcaagacctacggccctttcggagcatggggggacgggagtgacactccgttcgcgatccccgtgcagcaagggagtgccatcgttggcttcttcgcacgagctggggtctacctcgacgcccttggcgtttacgtgcgatccctgtgatgatgactctgacgacagaggcagctagctgctctgctagctccaccggcttcatcgcgtcaccctccgttttatttcctactgctacttgttgtgtcttgaataatttcgataaataaaggactccgccagagattggcacttgaatcgatccataaatgcttgtgtgaattagtgctacaagtttccaactccattaattgtccattaaatttacaaaaaaaaaaaaaaaaaaccagagctctggaattcctgcagcccgggggatccactagttctagagcggccgccaccgcggtggagctccagcttttgttccctttagtgagggttaatttcgagcttgg

SEQ ID NO: 57256 - protein, 102 aa, Zea mays
  misc_feature: Ceres CLONE 1503597
  misc_feature (1)..(101): Pfam Name: Jacalin Pfam Description: Jacalin-like lectin domain
DWVPGPPSSHCSGKGETEPVIQLGDSEVLTELSGTIGIVDGHTVITSIKFVTSLKTYGPFGAWGDGSDTPFAIPVQQGSAIVGFFARAGVYLDALGVYVRSL

SEQ ID NO: 57257 - DNA, 679 bp, Zea mays
  misc_feature: Ceres CLONE 1503598
  misc_feature: Encodes the peptide sequence at SEQ ID NO. 57258
  misc_feature (1)..(1): n is a, c, t, g, unknown, or other
ncgattgggtaccgggccccccctcgagccactgcagtggtaaagggtcaaaagcgagagagctaagctaagccgagctaagaagcacagcaagtctcaccagactagcggctagcgcgagaatggccaaggacatcgaggccgcggcgcacgagggcaaggactactcggacccgcctccggcgccgctggtggacgcggaggatctgaccaagtggtcgctgtaccgcgcggtgatcgccgagttcgtggccacgctgctcttcctctacatcacggtaggcacggtgatcggttactagcaccagacagacgcggcggcttccgaccccgacacgtcgtgcgagggcgtcagcatgctcagcatctgctgaacctacggcggcatgatcttcatcctcgtctactgcaccgcgagggtgtccggaggcactatcacccggacgtcatctctcggcctcttcttggcccgcaagggctctcttggtgcgggccctgcttaacaactttcgggaggtgcccgggcccctactgcggagacgggctcggccaaggggttccaagaacgcccttcaacgtgggcgttcgggggggtggaaccaaaaatcttaggggcgggtatttccaagggggcaccggctcttcccggggaaaattttcgggacccttttgggcctgt

SEQ ID NO: 57258 - protein, 59 aa, Zea mays
  misc_feature: Ceres CLONE 1503598
MAKDIEAAAHEGKDYSDPPPAPLVDAEDLTKWSLYRAVIAEFVATLLFLYITVGTVIGY

SEQ ID NO: 57259 - DNA, 828 bp, Zea mays
  misc_feature: Ceres CLONE 1503606
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (454)..(454): n is a, c, t, g, unknown, or other
  misc_feature (478)..(478): n is a, c, t, g, unknown, or other
  misc_feature (828)..(828): n is a, c, t, g, unknown, or other
tcgggagnnnnnntatttttataaatnnnnnnnnnaaaaaaannnaaaaaaaaaaaaaaaaaccccctcaaacactgcaatggtaagggggctttcttagaggtgggttggcttctcctccccctccggttcgggttcgggttcgtgaggttctccggggttcggtttcctgggagagcggatccacatggccccttcttatgttcaatagggggggttcatccgccgccttcccagcaccactaaccacaattccctccacaaaacctttcaaaacctaacgaaaaattatacaagttccaaacacctccaacggataaaaccaaaagttcttcccacaaaaggagaggaaaaaccactccccacatttatcttaaccataacaccccaccccgtataacaaaccccccttttttttttccccccccccccagggggggggggggggaccccntcccctccccacacccccccctanaattttttttttaataaaaaaaaaaaaaaaaacccaaaccaaacccccagagccaacccccctctaccaccccccccccaaaatcaccaacgcacaaccgaaaaccccgcgggccccgcacccaaccgtaccaaaccacgatgaccctccacattaacatatgatatcccacccgataccacaaaataaaaccgccacaataacctccccggacaccttgttatctggacccggataagcgacataatagtatggcgaacagaactagaaatagaaaaaaagagaacaattccaaaaaatagtaccgaccggcgccagacgcgagcaacgccaagcaccaacagtacaan

SEQ ID NO: 57260 - DNA, 713 bp, Zea mays
  misc_feature: Ceres CLONE 1503608
  misc_feature: Encodes the peptide sequence at SEQ ID NO. 57261
  misc_feature (713)..(713): n is a, c, t, g, unknown, or other
tcgagccctgcagtggtaaaggagagaaggtgagtgctttgacaagggaaaaaaaaccaggtctgtgtgtgtgtgagagagagagagaggcgaaggcaactcaggcgacgcgatggcgatggcggcgctgcgacgcgaggggaggcgcctcatcctctcctccaccgtccccaacccgtctctggcggccgcttcctctgcggtgacgcgatcctccgccgtctcgcaaccggagatggctccacttggtgcacggtctatttcaactcaaatcgtgaggaaaccggatgaagagtgtcaggaatatccagaagatcacaaaggctatgaagatggttgctatatccccccctcccgggcggggggcgggagcgaggactgaaaattcacgtggccctggtggcaccccccctcccccccctctctgggggatggctcctaggtggttgaccgtccagaaacattgtgattggtggcccatttacctcctgaaacaggggactctggtggggggtattaatttccaccttcagtcgaaaagttaatcagggcccccttccccaaatttgacctcctgggtgtccaaaaaaaaggaaacccaatgttttttttttattatgtgaaaaaaagggccaaaaggtcaacctgtgttacgttgacctccaccgggcccccctttgacaattgatctggccacccgccaactgcccaan

SEQ ID NO: 57261 - protein, 89 aa, Zea mays
  misc_feature: Ceres CLONE 1503608
MAMAALRREGRRLILSSTVPNPSLAAASSAVTRSSAVSQPEMAPLGARSISTQIVRKPDEECQEYPEDHKGYEDGCYIPPSRAGGGSED

SEQ ID NO: 57262 - DNA, 676 bp, Zea mays
  misc_feature: Ceres CLONE 1503609
  misc_feature: Encodes the peptide sequence at SEQ ID NO. 57263
  misc_feature (541)..(541): n is a, c, t, g, unknown, or other
  misc_feature (660)..(660): n is a, c, t, g, unknown, or other
tgggaccgggccccccctcgagcactgcagtggtaaaggtcttcgtcggcctcctcctctccgtcgccggcatggccgtggccgcgctcgtcgagcgccaccgccaggtggcctccggccacggggccacgctcacggtgttcctgctcatgccgcagttcgtgctcgtcggcgcgggcgaggcattcacgtacatgggccagctcgccttcttcctgcgcgagtgccccaagggcatgaagaccatgagcacgggcctgttcctcagcacctgcgcgctcgggttcttcttcagcaccctgctcgtcaccatcgtgcacaaggtcacggcccacgccggccgtgacggttggctcgccgacaacctcgacgacgggaggctcgactacttctactggctgctcgccgtcatcagcgccatcaacctcgtcctcttcacgttcgccgccaggggctacgtctataaggagaagcgcctggccgacgccggcatcgagctcgcagacgaagagtctattgccgtcggccactgatgctgctngcagtgccacaaccctgcatgcatgcgtctttccttctcttttttttttaaatatgttttgaaactttgatgacttgttttggcctgaaattcgtggggcccgccaggggggccatgcntgatgtattttggcac

SEQ ID NO: 57263 - protein, 176 aa, Zea mays
  misc_feature: Ceres CLONE 1503609
GPGPPSSTAVVKVFVGLLLSVAGMAVAALVERHRQVASGHGATLTVFLLMPQFVLVGAGEAFTYMGQLAFFLRECPKGMKTMSTGLFLSTCALGFFFSTLLVTIVHKVTAHAGRDGWLADNLDDGRLDYFYWLLAVISAINLVLFTFAARGYVYKEKRLADAGIELADEESIAVGH

SEQ ID NO: 57264 - DNA, 677 bp, Zea mays
  misc_feature: Ceres CLONE 1503614
  misc_feature: Encodes the peptide sequence at SEQ ID NO. 57265
  misc_feature (332)..(332): n is a, c, t, g, unknown, or other
cgattgggtccgggccccccctcgagccctgcagtggtaaaggagagcaagcatagtcacctgcctatctatctagcgagagagagagaggaaagctagctagctagcatggagtgcggcagcaagaaggcagcaggcggtgtgttggcgctgctgcttctccagctggtgttagctccgacgacggcgacggcccgcctcctgcaggcggatacctccaccgtggttggcctggacatcatcgcgagggagtttggccatccagtgagaagcatcctctgtggtgaaacctgtgtcttcctaccatgctatacggcagccatgggttgccnatgcattgggcaaatctgcatgatgtgatatctggactagcgctatttgtaattttgtgtgggaaaacccaagaccggaccgtggtgttcaactttatgccagtggttggtgatctcataagtaaagataattaaaaagggatttgtttggattgttaaaaaaaaaaaaaaaaacccgaagctccggggaattcctggccggcccgggggaatccctaattctttaagcgggcccccccccgcgggggaacccccccctttttttccctcttttagaggggggttaattttttaaattgggggaaaaccaggggcccaaaacgggttttccccgggggaaaaatg

SEQ ID NO: 57265 - protein, 83 aa, Zea mays
  misc_feature: Ceres CLONE 1503614
  misc_feature (55)..(84): Pfam Name: Cyclotide Pfam Description: Cyclotide family
  misc_feature (75)..(75): Xaa is any aa, unknown, or other
MECGSKKAAGGVLALLLLQLVLAPTTATARLLQADTSTVVGLDIIAREFGHPVRSILCGETCVFLPCYTAAMGCXCIGQICMM

SEQ ID NO: 57266 - DNA, 676 bp, Zea mays
  misc_feature: Ceres CLONE 1503617
  misc_feature: Encodes the peptide sequence at SEQ ID NO. 57267
cgattgggtaccgggcccccctcgagccctgcagtggtaaggtcttccctcgcccgaacaccatctgctctgctctgctctctccctctgtctgcccttccgccttcccaggaactccattgcactatttccaccccaggaacacagcacagagtcggatccgaatccgcaggagaggcagaagcacaactcactccccactccctccacccatcagctagccatgggcaaggactgcggcaaacacggcgacgacgacctccggcgctcgtgcaggcgcctgctagccatcctcgtggtcctcgcgctgaccgttggcgtcgtcgcgctgatcgactacctggtgctccgccccacgcacccgcgcttctacctgcaggacgcgtcgctccggcagctggacctctccaacgccaccaccggcaccagcaccagcaccctgctctccaccgcgatccaggtgacgctagcgtcgcgcaacccgaacgagcgctgctgggtctactactaccgcctcgacgtgtacgcgtcgtacaagtaccagcagctcacggtggcggcgtctctgccgcccgagtaccagggccacggggacgacggccccttggtcgcgggtgctggaccggtccaaacgtgccccttgagcccctacctcgggggacgtgcttcggccagg

SEQ ID NO: 57267 - protein, 151 aa, Zea mays
  misc_feature: Ceres CLONE 1503617
  misc_feature (39)..(151): Pfam Name: Hin1 Pfam Description: Harpin-induced protein 1 (Hin1)
MGKDCGKHGDDDLRRSCRRLLAILVVLALTVGVVALIDYLVLRPTHPRFYLQDASLRQLDLSNATTGTSTSTLLSTAIQVTLASRNPNERCWVYYYRLDVYASYKYQQLTVAASLPPEYQGHGDDGPLVAGAGPVQTCPLSPYLGGRASAR

SEQ ID NO: 57268 - DNA, 657 bp, Zea mays
  misc_feature: Ceres CLONE 1503619
  misc_feature: Encodes the peptide sequence at SEQ ID NO. 57269
  misc_feature (1)..(1): n is a, c, t, g, unknown, or other
  misc_feature (601)..(601): n is a, c, t, g, unknown, or other
ncgattgggtaccgggccccccctcgagccctgcagtggtaaaggagacgcagaacaagcagagcgagaaaccgagcaaagctagtaagagcagagagctgcaagtgacctgcggtgttgcatcacatctgcagcagcagcacgccggcaagatggtgcagcaagccgcgaaggaggtgatcccgctgctgacgccttacaagatggggcagttcgagctctctcaccgggtggtgctggcgccgctgacgaggtgccgctcctacggcaacgtgccgcagccacacgccgccgtgtactactcccagcgcgccaccagaggtggcctgctcatcgcggaggccacggaggtgtcggccaccgcgcaggggtacccggagactcctggcatctggacgcaggatcaggtcgaggcgtgtaagcccatcgtcgacgccgtccgccgcaagggcgccatcttcgtctgccagatctggcatgtgggcagggtctccaccaacgagctccagccgaacggcgatgcgcctatctcgagcacggactatcagatctccccggacgccgagtccggaatcgcgtactcaaagccgcgctggctgcngaccgacgaggtctccgggatcgtcgacgacttcaggctggccgcacggaacgcga

SEQ ID NO: 57269 - protein, 168 aa, Zea mays
  misc_feature: Ceres CLONE 1503619
  misc_feature (11)..(167): Pfam Name: Oxidored_FMN Pfam Description: NADH:flavin oxidoreductase / NADH oxidase family
  misc_feature: SWISSPROT Homolog: EC 1.3.1.42 12-oxophytodienoate reductase
  misc_feature (150)..(150): Xaa is any aa, unknown, or other
MVQQAAKEVIPLLTPYKMGQFELSHRVVLAPLTRCRSYGNVPQPHAAVYYSQRATRGGLLIAEATEVSATAQGYPETPGIWTQDQVEACKPIVDAVRRKGAIFVCQIWHVGRVSTNELQPNGDAPISSTDYQISPDAESGIAYSKPRWLXTDEVSGIVDDFRLAARNA

SEQ ID NO: 57270 - DNA, 671 bp, Zea mays
  misc_feature: Ceres CLONE 1503626
  misc_feature: Encodes the peptide sequence at SEQ ID NO. 57271
  misc_feature (574)..(574): n is a, c, t, g, unknown, or other
  misc_feature (575)..(575): n is a, c, t, g, unknown, or other
cgattgggtacgggccccccctcgagccctgcagtggtaaaggatgcgataaaataaaatctttcagttagctgcttccggcagcggtacgatggccgctgcgagaatggcgctcgtctcttgcgcccgccgcctcccgtccttaccctctccgctcaccctctctaggccccgcgcgggcgccgtctcattcctggctgcccaaccgtcgccggcgacggcaccgagatccggcaggaatcttgctctcttctgctctttatcaccgtcgtcgccatcgctaactgaggccgccgtagaactgccgccaccgaaggctgcggtggaagagacgaagccccctgtgccgagcggggacgagaagggggaaccgaccgtggaggagctagcgggtctgctggacgtccgggtgggccgagtggtgaaggcgtggaggcacccggaggcggacaccctctacgttgaggaggtggacgtaggtgaggcggagccccggaccatctgcagcggcctcgtcaacttcctccccatcgaagagctccagaacagaaacgtcattgttcttgctaacctnncaacaggaacatgcgtggcatcaagtcaaatggcatgctcatggctgcctctgatgcttcccatgagaatgtggagctgctcatcccttcagaagg

SEQ ID NO: 57271 - protein, 193 aa, Zea mays
  misc_feature: Ceres CLONE 1503626
  misc_feature (105)..(190): Pfam Name: tRNA_bind Pfam Description: Putative tRNA binding domain
  misc_feature: SWISSPROT Homolog: EC 6.1.1.1
  misc_feature (162)..(162): Xaa is any aa, unknown, or other
MAAARMALVSCARRLPSLPSPLTLSRPRAGAVSFLAAQPSPATAPRSGRNLALFCSLSPSSPSLTEAAVELPPPKAAVEETKPPVPSGDEKGEPTVEELAGLLDVRVGRVVKAWRHPEADTLYVEEVDVGEAEPRTICSGLVNFLPIEELQNRNVIVLANLXTGTCVASSQMACSWLPLMLPMRMWSCSSLQK

SEQ ID NO: 57272 - DNA, 676 bp, Zea mays
  misc_feature: Ceres CLONE 1503628
  misc_feature: Encodes the peptide sequence at SEQ ID NO. 57273
cgattgggtaccgggccccccctcgagccctgcagtggtaaagggagcaacaggcaggccgcacgctcttccttagcttgcctgaattctgtagtcacgcacactagtctcagatatggatacttgtcatcaatccatagagaccgcagatggcaagaaggactacagtgaccctgtcccagcaccattcgtgaacgccggcgagctgggcaagtggtccctgtaccgcgccgtcatcgccgagttcgtggccacgctgctcttcgtgtacgtcacgctggccaccgtcatcgggcacaagcgcgaggccgagtcccagccgtgcggcagcgtcggcgtgctgggcatcgcctggtccttcggcggcatgatcttcgggctcgtcaactgcatcggcggcatctccggcggccactttaacccggggggtcactttcggcctgttgctgggccccaagcctgttccctggtgcccccccccctctacttggtcccgcaaggcctggggccccttgtggggggcccgcccttttaaagggtttcccagggccccctgtggtaccttttttaggggggggaaaacaaaaaatccccccccggttatccaaaagaaaccgtttgggggcccaaaaatgtggggcccttttctcctccttaaaacggggttttctccccc

SEQ ID NO: 57273 - protein, 139 aa, Zea mays
  misc_feature: Ceres CLONE 1503628
  misc_feature (30)..(136): Pfam Name: MIP Pfam Description: Major intrinsic protein
MDTCHQSIETADGKKDYSDPVPAPFVNAGELGKWSLYRAVIAEFVATLLFVYVTLATVIGHKREAESQPCGSVGVLGIAWSFGGMIFGLVNCIGGISGGHFNPGGHFRPVAGPQACSLVPPPLYLVPQGLGPLVGGPPF

SEQ ID NO: 57274 - DNA, 673 bp, Zea mays
  misc_feature: Ceres CLONE 1503630
  misc_feature: Encodes the peptide sequence at SEQ ID NO. 57275
  misc_feature (416)..(416): n is a, c, t, g, unknown, or other
  misc_feature (417)..(417): n is a, c, t, g, unknown, or other
  misc_feature (426)..(426): n is a, c, t, g, unknown, or other
cgattgggtaccgggccccccctcgagccactgcagtggtaaaggagggtcataagccaggtcagactaggttaggatttacctgtgaggcctccttctcccctgccgccgccgccatgggacactccaacgtgtggaactcgcaccccaagaactacggccctggatctagggtttgccgtgtgtgcgctaacccccacggcttgatccggaagtacgggctcatgtgctgcagacagtgcttccgcagcaacgccaaggacattggcttcatcaagtaccgctgaaacttggggagctccaaagcacggcaataatggaggcacggatggggacctcaaagatagcatgtactcttattttctatataaaaccatgtatgaattgtttggctttgtgtggacaaagttgtgaanntctgatggnactctgaatctgaagcttccctgcttaggcagctgaacatggccacccgttttggttaaaaaaaccgttttctttgttcccaaaaaaaaaaaaaaacccaaactttggaatttcccgcccccgggggaatccttatttttaaagggccccccccccggggaacccccctttttttcccttttggagggggtaatttcaagagtggggaaaaagggaaaaaaattttttcggggaaaaaattttcccc

SEQ ID NO: 57275 - protein, 56 aa, Zea mays; identical to SEQ ID NO: 1999
  misc_feature: Ceres CLONE 1503630
  misc_feature (3)..(56): Pfam Name: Ribosomal_S14 Pfam Description: Ribosomal protein S14p/S29e

SEQ ID NO: 57276 - DNA, 647 bp, Zea mays
  misc_feature: Ceres CLONE 1503635
  misc_feature: Encodes the peptide sequence at SEQ ID NO. 57277
  misc_feature (636)..(636): n is a, c, t, g, unknown, or other
cgattgggtaccgggccccccctcgagccactgcagtggtaaaggcatcgcacgccatcagcagctagcgcgctcctcgagcccagcagagaaaggccggcagcgctaatcgtaatagccatgggctccaccgccggcgacgtggccgcggtggtggacgaggaggcgtgcatgtacgcgatgcagctggcgtcgtcgtccatcctgcccatgacgctgaagaacgccatcgagctgggcctgctggaggtgctgcagaaggaggccggcggcggcaaggcggcgctggcgcccgaggaggtggtggcgcggatgcccgcggcgcccagcgaccccgccgccgccgcggccatggtggaccgcatgctccgcctgctcgcctcctacgacgtcgtccggtgccagatggaggaccgggacggccggtacgagcgccgctactccgccgcgcccgtctgcaagtggctcacccccaacgaggacggcgtgtccatggccgccctcgcgctcatgaaccaggacaaggtcctcatggagagctggtactatctcaaggacgcggtgctggacggcggcatcccgttcaacaaggcgtacgggatgacggcgttcgagtaccacgggacggacccgcgncttcaccgcgt

SEQ ID NO: 57277 - protein, 175 aa, Zea mays
  misc_feature: Ceres CLONE 1503635
  misc_feature (31)..(87): Pfam Name: Dimerisation Pfam Description: Dimerisation domain
  misc_feature: SWISSPROT Homolog: EC 2.1.1.68 Caffeate O-methyltransferase
MGSTAGDVAAVVDEEACMYAMQLASSSILPMTLKNAIELGLLEVLQKEAGGGKAALAPEEVVARMPAAPSDPAAAAAMVDRMLRLLASYDVVRCQMEDRDGRYERRYSAAPVCKWLTPNEDGVSMAALALMNQDKVLMESWYYLKDAVLDGGIPFNKAYGMTAFEYHGTDPRLHR

SEQ ID NO: 57278 - DNA, 734 bp, Zea mays
  misc_feature: Ceres CLONE 1503640
  misc_feature: Encodes the peptide sequence at SEQ ID NO. 57279
  misc_feature (211)..(211): n is a, c, t, g, unknown, or other
  misc_feature (734)..(734): n is a, c, t, g, unknown, or other
cgaattgggtaccgggccccccctcgagccactgcagtggtaaagggcacacaacgcgcaggtgcacgcggcggtgtccgtagcggcagtgggcggccgccgtggccgccgtggcggcggcgacggccgcggcctcggcgtccggcagggacgaagcggcccgcccgcactggacatggccgtggcgtcggcggcgacgctcgtggccgcncagtgcgtggaggcggccgagtccatcggcgccgagcgggagcacctggaggccgtggtcgggtcggccgtcaacgtcaggacgcccggagacatcgtccccgtcaccgctgctgcggccaccgcgttgagaggcgcgccccctctgaaagcgagggttctgaaggaggtgtggaacatcgcggccgttatccccgtaaaaaaaggccccggtcggcggcggctgccgccgctgccgaagaaggccacaccaggaagcccggcgcgtccaagcagcaccagcttcgcaagttggagaccaacgggcagcacctcagccaacttgtcccttggagaagaaaaaaaactttctttcggaattttggcagcccaggaatttttttcgtttcgggggccccgtaatttctttcaaaaccccaccccggaaaaggcccccttcttgcccctgggaaagggcccttatccggggggtaccactcaacccgcgggaatggcgccccttggttttgtatttttaacaaaan

SEQ ID NO: 57279 - protein, 186 aa, Zea mays
  misc_feature: Ceres CLONE 1503640
MAVASAATLVAAQCVEAAESIGAEREHLEAVVGSAVNVRTPGDIVPVTAAAATALRGAPPLKARVLKEVWNIAAVIPVKKGPGRRRLPPLPKKATPGSPARPSSTSFASWRPTGSTSANLSLGEEKKLSFGILAAQEFFSFRGPRNFFQNPTPEKAPFLPLGKGPYPGGTTQPAGMAPLGFVFLTK

SEQ ID NO: 57280 - DNA, 680 bp, Zea mays
  misc_feature: Ceres CLONE 1503645
  misc_feature: SWISSPROT Homolog: EC 2.5.1.6 Methionine adenosyltransferase
  misc_feature (349)..(349): n is a, c, t, g, unknown, or other
  misc_feature (363)..(363): n is a, c, t, g, unknown, or other
  misc_feature (422)..(422): n is a, c, t, g, unknown, or other
  misc_feature (444)..(444): n is a, c, t, g, unknown, or other
cgattgggtaccgggccccccctcgagccactgcagtggtaaaggttgcgctgcggacgggtcggatctgagacgaggcgagacgaccccccctcccctcaaccggaacttgttttaccccatctcatcccactgactccacccacccgcccgctgcctccgccggatctcgtcggactcggatccgcccgaccaccccgcgccgccgccgcgcagcagcagcagcagatcagagaagatggccggactcgacaccttcctcttcacctcggagtccgtgaacgagggacacccctgacagctctgcgaccaggtctcagatgctgttctggacgcttgccttgctgangaccctgacagcanggttgcttgcgacacctgcaccaagaccaacatggtcatggtctttggtgagatcacancaagggccatgtccactaccanaagattgtcagggagacatgccgccacattggtttcgtgtccaacgatgtcgggcttgacgctgaccactgcaaggtgcttggtgacatggagcacccgtcccctgatattgctcagggtgtgcaccggccctttcaccagcccccccgaagagattgggagctggtgaccaggggcccatgttttgggtttgcaactgaccaaacccctgagctgatgccccttcagccttggcc

SEQ ID NO: 57281 - DNA, 660 bp, Zea mays
  misc_feature: Ceres CLONE 1503648
  misc_feature: Encodes the peptide sequence at SEQ ID NO. 57282
  misc_feature (289)..(289): n is a, c, t, g, unknown, or other
  misc_feature (342)..(342): n is a, c, t, g, unknown, or other
  misc_feature (424)..(424): n is a, c, t, g, unknown, or other
cgattgggtaccgggccccccctcgagccctgcagtggtaaaggtggcctcgccaccaaggtcgagatcatcgagatcgatctcgccgaggaagacgctggctcctcgtcccacggctccccctcctcgtccccgtcggtcgaggcggtcgggatccggcgcctggaggaggcctccacggcgtcatggtgcgccgcgccgcgcccgactggctccccttcgtgccgggagggtccttctggggtgccccgctgcgccgcccgcacggggtcgccgagctcgttggccngatcgcggctgctgggggcaccgaagggggcgccggggccgttggtggcgcgntcaaagtcttggagctcgacgccccatgacggaggagcaggtgttttgtttctcccacacgcgcggctggcccctcgcctcntttcttcgtcgaaggggaatctacacatttgaggaaatcgaggaaaggtgcaactcaaactgatgatgaagaaagctgattcgtttgtgctatggtgcaaggggctccctacagaaacacagtgcaaagtttgatgactgccaaatcaatgtagatatggatgcaaggaccctattgctggtaaaccatgccacctgctaccgttgatgctgcctcatccgtctgggaagataatt

SEQ ID NO: 57282 - protein, 61 aa, Zea mays
  misc_feature: Ceres CLONE 1503648
  misc_feature (35)..(35): Xaa is any aa, unknown, or other
  misc_feature (53)..(53): Xaa is any aa, unknown, or other
MVRRAAPDWLPFVPGGSFWGAPLRRPHGVAELVGXIAAAGGTEGGAGAVGGAXKVLELDAP

SEQ ID NO: 57283 - DNA, 686 bp, Zea mays
  misc_feature: Ceres CLONE 1503650
  misc_feature: Translation starting site: 159
  misc_feature (1)..(1): n is a, c, t, g, unknown, or other
ncgattgggtaccgggccccccctcgagccactgcagtggtaaagggtgcatcgtcatccaccacgatcgataaagctaattaagctgctactgctacgctagcctcgatcgatcaagcaagcagctcacagacccaccggcccacccacccacccacatggcggcgtcccgttccgctctgatcacgctgctcgtccttgtgagctccgtcgcggcggcctcggcgaccacgttcaccgtcggcgacagtagcggctggagtcgtagcgtcaactacgacaactgggccagtggcaagaccttcacggatggagatcagctagtgttcaacttcgccaccgggaaccacgacgtggtggaggtggacaagagcggatacgacggctgctccaccaccaacgccgccaacacaatccaaaacggcccggccaccgtcaacctcacctccggcacccattactacatctgcggcttcaccggccactgcagccgccgggatgaaacttcgctgtcaccgtccggctccggctccggtttccgggtcccccaccccccgggggcgggtttcgccaagaaaacccacaacaaaccacccccgagtgccccccaccccccaaaaccccgggtcaagcgcgtctcgtggcccctcaacgggccggccccaagtgtttccccagggcgcccc

SEQ ID NO: 57284 - DNA, 681 bp, Zea mays
  misc_feature: Ceres CLONE 1503657
  misc_feature: Encodes the peptide sequence at SEQ ID NO. 57285
  misc_feature (250)..(250): n is a, c, t, g, unknown, or other
  misc_feature (263)..(263): n is a, c, t, g, unknown, or other
  misc_feature (333)..(333): n is a, c, t, g, unknown, or other
  misc_feature (339)..(339): n is a, c, t, g, unknown, or other
  misc_feature (533)..(533): n is a, c, t, g, unknown, or other
cgattgggtaccgggccccccctcgagccactgcagtggtaaaggagagaccctaccgggcgggagagagccaggaagaggagggcgacgatggcgtccggctggggcatcaacgggaacaagggccgctgctacgacttctggctggagttcagcgagtgcatgagccgctgccgccagccctccgactgcggcctcctccgcgaggactacctcgagtgcctccaccactccaggagttccagcgcanggacaggatctancaggaggagcaacgtcagatcagagctgctgctcgtaaggccaaggaggaagctgagggtgcccctgctngtgcancacaccattagcctccctgtctattttttggcgtggtgttttctggtaactcatctttggttcacgtatgaagctaagggcaaggcaataatctccagctgttggactacacagattttttcccccatgacttaaatatcaagactcattttgtgctaaaaaaaaaaaaaaaaaaccagagctcttgggaattncctgcagcccggggggatccactagttctaggagcggccgcccaccgcggggggaactccagctttttgtttccttttagggaagggttaatttccgaggcttggcgaaatcatgggccataacctggtttcctggggtaaaatttgt

SEQ ID NO: 57285 - protein, 127 aa, Zea mays
  misc_feature: Ceres CLONE 1503657
  misc_feature (54)..(54): Xaa is any aa, unknown, or other
  misc_feature (58)..(58): Xaa is any aa, unknown, or other
  misc_feature (83)..(83): Xaa is any aa, unknown, or other
MASGWGINGNKGRCYDFWLEFSECMSRCRQPSDCGLLREDYLECLHHSRSSSAXTGSXRRSNVRSELLLVRPRRKLRVPLLVXHTISLPVYFLAWCFLVTHLWFTYEAKGKAIISSCWTTQIFSPMT

SEQ ID NO: 57286 - DNA, 653 bp, Zea mays
  misc_feature: Ceres CLONE 1503660
  misc_feature: Encodes the peptide sequence at SEQ ID NO. 57287
  misc_feature (252)..(252): n is a, c, t, g, unknown, or other
  misc_feature (375)..(375): n is a, c, t, g, unknown, or other
cgattgggtccgggccccccctcgagccctgcagtggcgacagagagcgtgcagccagccaccgaccacccgcgcagcgcaggacttggggagcaagcaaggcgaagcggcctgccatggattccttctcgtcctcgccgtcgtcgtcaggtcccggcgctaacccggacgttgttatggaacagatcaagacgcagctcgcacaggcttacgcgcaggagtttctcgagaccgtcgggaaacagtgctttngaaagtgcgtgaccaagccagggatcagcttgagtggaagcgagagcagctgcatatcacgttgtgttgaccgctacattgaggccactggtattgtcagccgcgcattgttcacttcccagncgctagatcacatgaataaggagatggtttcgaagatcgctcgtgagagtaatgtcgccatgagttttttgacttgtcggaaacaatgacatttgatgcttgggtatcaaaaaaaagtctgcctatagactcaggtttcttgtaaaaaaaaaaaaaaaaaccagagctctgggaattcctgcagccggggggatccactagttctagagcgccgcccacgcgggggaacctccactttttgtccctttagggagggttatttcgagcttggctaatca

SEQ ID NO: 57287 - protein, 115 aa, Zea mays
  misc_feature: Ceres CLONE 1503660
  misc_feature (21)..(85): Pfam Name: zf-Tim10_DDP Pfam Description: Tim10/DDP family zinc finger
  misc_feature (46)..(46): Xaa is any aa, unknown, or other
  misc_feature (87)..(87): Xaa is any aa, unknown, or other
MDSFSSSPSSSGPGANPDVVMEQIKTQLAQAYAQEFLETVGKQCFXKCVTKPGISLSGSESSCISRCVDRYIEATGIVSRALFTSQXLDHMNKEMVSKIARESNVAMSFLTCRKQ

SEQ ID NO: 57288 - DNA, 685 bp, Zea mays
  misc_feature: Ceres CLONE 1503661
  misc_feature: Encodes the peptide sequence at SEQ ID NO. 57289
  misc_feature (331)..(331): n is a, c, t, g, unknown, or other
cgattgggtccgggccccccctcgagccctgcagtggtaaaggggatccgatcaggcggtcgatgctacggccggtggcgggcgtcgtcggggcatggctagccaggctgcgcggcgaggaggcgcgatgaggccaccgagcagcggcgtgcgcacggcagccgcgcggccgccggccgcctcgttcctgctggccacggcggccgcggcggcgctcgtcggagggttctacttctggttggtggtctcgtcgttccggctccccgactcggccaccgtcgggtgccgcctcgacggcgaggggtcgtgggcggtcggcatgttctacggnagcagccccctcgcgctccgtcccatcgagctggaagggaagagcaatggcaacagctcggcgtggccggtggcaaacccgtcctgacctgcgggactgcgacggaggcggggtacccgagcactttgtcgccgatccgtcctctacgtcgagggggaacactattttatttctttgaaacaaaaaacacaacctccatgcaaggtgaatattgaaggttgaaagaagcttccaaccaaggggcaaacgtggggaattttcttgccatttgcactagaaagaagggatggcaatccgggccaaaacccttttgggggtccaaggtatgaagaacccaaaattttttttgaatgc

SEQ ID NO: 57289 - protein, 107 aa, Zea mays
  misc_feature: Ceres CLONE 1503661
MASQAARRGGAMRPPSSGVRTAAARPPAASFLLATAAAAALVGGFYFWLVVSSFRLPDSATVGCRLDGEGSWAVGMFYGSSPLALRPIELEGKSNGNSSAWPVANPS

SEQ ID NO: 57290 - DNA, 642 bp, Zea mays
  misc_feature: Ceres CLONE 1503666
  misc_feature: Encodes the peptide sequence at SEQ ID NO. 57291
  misc_feature (423)..(423): n is a, c, t, g, unknown, or other
  misc_feature (474)..(474): n is a, c, t, g, unknown, or other
  misc_feature (504)..(504): n is a, c, t, g, unknown, or other
  misc_feature (546)..(546): n is a, c, t, g, unknown, or other
  misc_feature (580)..(580): n is a, c, t, g, unknown, or other
cgattgggtccgggccccccctcgagccctgcagtggtaaaggacggaagtttcggcggcgccggcgtgctcgtgatctcaacccaaggcgtgcctccgctccggtcacccgtcgctccacgcaaccatgtcgaggaggaagaccagggagcccaaggaggagaacgtcacccttggacccactgtccgtgaaggagagtatgtctttggtgtcgctcacatctttgcatccttcaatgacaccttcattcatatcactgatttgtctgggagggaaactctggttcggatcaccggtggcatgaaggtgaaggctgactgtgacgagtcgtcaccttacgctgctatgcttgctgctccagacgtcgcacagcgctgcaaggagcttggtattactgcactgcacatttagcttcgcgccanccggagcaacaagaccaagacccctggacctggtgcccagtctgccctcanggcgcttgctcgttcccggatgaaaatcgnacgcattgaggacgttaccccggctcccactgacagcactcncaaaaaaggcggtaagaagggaaaggagctgtangcgtctcgtctgccttgcatttgccggctcttggccggtggcattatgaacctaccctcctg

SEQ ID NO: 57291 - protein, 94 aa, Zea mays
  misc_feature: Ceres CLONE 1503666
  misc_feature (28)..(95): Pfam Name: Ribosomal_S11 Pfam Description: Ribosomal protein S11
MSRRKTREPKEENVTLGPTVREGEYVFGVAHIFASFNDTFIHITDLSGRETLVRITGGMKVKADCDESSPYAAMLAAPDVAQRCKELGITALHI

SEQ ID NO: 57292 - DNA, 687 bp, Zea mays
  misc_feature: Ceres CLONE 1503670
  misc_feature: Encodes the peptide sequence at SEQ ID NO. 57293
cgattgggtaccgggccccccctcgagccactgcagtggtaaagatatggtttgtgccaagcacaaaagagaagggacggacattgtgcaggagccctgaggccttggacatcggcatccatgaagtgctcccccgtatattcaaggaggcagcttaagcccaataatggaggactgtccatggattcctgatcctgcacagcgcttgctggatgttctccctgggacctgggaggaggaaagagctcgcccgacatacatttgtgtaaccagtggaatcggctacgctggcagacgcagactcgaaagattgatgctgtcactgtgctatgcaatgagcgtgttgtgtttcaagtggcaccgtctcgtggttagtgcgggtgttttgtttccatttttcttttgattatctacctatttaccaaaagattcctgtaaagaactaagctccttttttttttcttccttccccgaagggaaaaaaatcccttgttgggtcccccctgggggaatggcaaacccccccgaaagaaagggggggttgtatattaaaggcgggaaaaaaccttttattcccctgggggggtttggggaaaaaaaaaaaaaaaaaaaaccccaagcctttggagattttcctccccccccggggggaaactccccttattttttaaagccgcgccccccccg

SEQ ID NO: 57293 - protein, 51 aa, Zea mays
  misc_feature: Ceres CLONE 1503670
IGYRAPPRATAVVKIWFVPSTKEKGRTLCRSPEALDIGIHEVLPRIFKEAA

SEQ ID NO: 57294 - DNA, 686 bp, Zea mays
  misc_feature: Ceres CLONE 1503683
  misc_feature: Encodes the peptide sequence at SEQ ID NO. 57295
cgattgggtaccgggccccccctcgagccactgcagtggtaaagggcttcaagggcaccgagatcgccatggcctcctactgctccgagctccagtacctgggcaaccccatcaccaaccacgtgcagagcgcggagcagcacaaccaggacgtgaactccctgggcctcgtctcggccaggaagaccgccgaggcgatcgacatcctgaagctcatgtcgtccacctacatcgtggcgctgtgccaggccgtggacctgcgccacctcgaggagaacatcaaggcgtcggtgaagaacaccgtgacccaggtggccaagaaggtgctgaccatgaacccctcgggcgagctctccagcgcccgcttcagcgagaaggagctgatcagcgccatcgaccgcgaggccgtgttcacgtacgcggaggacgcggccagcggcagcctgccgctgatgcagaagctgcgcgccgtgctggtggaccacgccctcagcagcggcgacgcggagcgggagccctccgtgttctccaagatcaccaggttcgaggaagagctccgcgcggtgctgccccaggaggtggaggccggccggcgtggcggtcgccgagggccccccccccgtggcgaaccggattcggggaaagccggtccttcccgggtgacccgcttcgggcgggaagagctc

SEQ ID NO: 57295 - protein, 228 aa, Zea mays
  misc_feature: Ceres CLONE 1503683
  misc_feature: SWISSPROT Homolog: EC 4.3.1.5 Phenylalanine ammonia-lyase
IGYRAPPRATAVVKGFKGTEIAMASYCSELQYLGNPITNHVQSAEQHNQDVNSLGLVSARKTAEAIDILKLMSSTYIVALCQAVDLRHLEENIKASVKNTVTQVAKKVLTMNPSGELSSARFSEKELISAIDREAVFTYAEDAASGSLPLMQKLRAVLVDHALSSGDAEREPSVFSKITRFEEELRAVLPQEVEAGRRGGRRGPPPRGEPDSGKAGPSRVTRFGREEL

SEQ ID NO: 57296 - DNA, 660 bp, Zea mays
  misc_feature: Ceres CLONE 1503687
  misc_feature: Encodes the peptide sequence at SEQ ID NO. 57297
  misc_feature (209)..(209): n is a, c, t, g, unknown, or other
  misc_feature (272)..(272): n is a, c, t, g, unknown, or other
  misc_feature (356)..(356): n is a, c, t, g, unknown, or other
  misc_feature (498)..(498): n is a, c, t, g, unknown, or other
cgattgggtaccgggccccccctcgagccactgcagtggtaaaggaggctccatcagtacagatccaccgccaccaccaccaccaagcactccagtcccgcagcagcatggccggcagcgcgtcccgcctcgccatcctcttggtgctcctggcggcgtcaccgctgcttggcgcgacgcagaaggccgcgccagggccggcgtcgtcntcgggctcgggcgcgggcgcggcggacgccgcgccgccgacggacgtgaacaaggcgctgaangacgagcagttcagcgagtcccggcagctgctgcacgacacgcgcgtggacacgcagatcaacgcgcagctgacggacagctancacgggctgaccatcatggcgcccaccaacgccgccttcgacaagatgaaggcgggcgtgctgaacgggctgtcgccgcaagagcagatccagatggtgctctactgcgtgctgccccggttctacagcctgtccatgctcngcaccctcagcggcaaggtcacacgcaggggttcggccacgacgggccctacaggtacgacatcagcggtccggggacaacgtcaacgtgtccaccggggtgaactggatgctgcttgcccaccccctaagaaagaacttcccgtccccatctacccggaag

SEQ ID NO: 57297 - protein, 184 aa, Zea mays
  misc_feature: Ceres CLONE 1503687
  misc_feature (55)..(55): Xaa is any aa, unknown, or other
  misc_feature (83)..(83): Xaa is any aa, unknown, or other
  misc_feature (131)..(131): Xaa is any aa, unknown, or other
MAGSASRLAILLVLLAASPLLGATQKAAPGPASSSGSGAGAADAAPPTDVNKALXDEQFSESRQLLHDTRVDTQINAQLTDSXHGLTIMAPTNAAFDKMKAGVLNGLSPQEQIQMVLYCVLPRFYSLSMLXTLSGKVTRRGSATTGPTGTTSAVRGQRQRVHRGELDAACPPPKKELPVPIYPE

SEQ ID NO: 57298 - DNA, 703 bp, Zea mays
  misc_feature: Ceres CLONE 1503688
  misc_feature: Translation starting site: 92
  misc_feature: SWISSPROT Homolog: EC 2.5.1.18 Glutathione transferase
  misc_feature: SWISSPROT Homolog: EC 4.4.1.5 Lactoylglutathione lyase
cgattgggtaccgggccccccctcgagccctgcagtggtaaaggagttgcagcaccagcagcagaagagcagcgccagagctccagcaataatggccgagaagggcgtgaaggtgttggggatgtgggcgagccctatggtgatcagggtggagtggccgctgcggctgaggggcgtcaagtacgagtacgtcgacgagcacctcgccaacaagagcgccgacctgctccgccacaaccccggtgaccaaggaagtgcccgtgctcgtccacgaccgcaagcccggtcgcggaatcccccatcctcgtcgagtacctccacgaggtctggaaggggggctaccccatcatggcgggcgacccctacgagcccgccagggaaggttctgggccaagttccctgaaaacaagtggcaccttgctctgtacccaatcttccccgcaaccggcaaggcccacccccaggcggttcacccaagccccacaatgccttcaagaccctggaaaacggccttggacgggaaaaatttccttccgcggggaaccccgtgggcttacctcaaaatccttcatccgggggtgttcgccccctctgctcccccttttttagagggaaggggcccggcgtccctcgttccttttcccaaacaaagaacctctcccttataaaaaaagccccggttttccccccgttttccccgccg

SEQ ID NO: 57299 - DNA, 722 bp, Zea mays
  misc_feature: Ceres CLONE 1505010
  misc_feature: Encodes the peptide sequence at SEQ ID NO. 57300
  misc_feature (215)..(215): n is a, c, t, g, unknown, or other
  misc_feature (219)..(219): n is a, c, t, g, unknown, or other
  misc_feature (221)..(221): n is a, c, t, g, unknown, or other
  misc_feature (223)..(223): n is a, c, t, g, unknown, or other
  misc_feature (227)..(227): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (706)..(706): n is a, c, t, g, unknown, or other
cgaattgggtaccgggccccccctcgagccactgcagtggtaaaggggtgctttctcacccggggaacggaagcgaatccagacgatggagaagaagaaggtggcgataccgctggtgtgccacggccactcgcggccggtggtggacctcttctacagccccgtcacacccgatggctacttcctcatcagcgccagcaaggatacaaatccanatgncntntcgntaaaatgggtgaagaaactggcgaactggaattggggactttttcaaggtcataaaggagctgtttggagctgttgccttgacaggaatgccctgagggctcgaatttgcttctgcggaacttttccccttaaagattggggaaacgccccttttctgggggaaacgaaccccacccctctcttttttccaaaacaacaccataaatatcgggggggtggggtttttttttaaaaaaaacccacccctttctttttacccttggggcggctctgtagaaaaaaaaaccctctttcccccccgnnnntaagaagagagggggaccccccgtagaagagcccccccaaaaaaagaactttctaaaaaaaaccctcgctgtttcccccccccaaagggaggggctgtgttggtctttctcctttctgccccccaaacccctttttttgtacgccctcctctcccccccactaaaaagaggancggggtacaaaaaccc

SEQ ID NO: 57300 - protein, 124 aa, Zea mays
  misc_feature: Ceres CLONE 1505010
  misc_feature (44)..(44): Xaa is any aa, unknown, or other
  misc_feature (45)..(45): Xaa is any aa, unknown, or other
  misc_feature (46)..(46): Xaa is any aa, unknown, or other
  misc_feature (48)..(48): Xaa is any aa, unknown, or other
MEKKKVAIPLVCHGHSRPVVDLFYSPVTPDGYFLISASKDTNPXXXSXKWVKKLANWNWGLFQGHKGAVWSCCLDRNALRARICFCGTFPLKDWGNAPFLGETNPTPLFFPKQHHKYRGGGVFF

SEQ ID NO: 57301 - DNA, 672 bp, Zea mays
  misc_feature: Ceres CLONE 1505013
  misc_feature: SWISSPROT Homolog: EC 2.7.11.25 Mitogen-activated protein kinase kinase kinase
  misc_feature (1)..(1): n is a, c, t, g, unknown, or other
  misc_feature (672)..(672): n is a, c, t, g, unknown, or other
ncgattgggtaccgggccccccctcgagccactgcagtggtaaaggtgtcgctcgccgccgacgccgcctcgggcgcgctcttcgcggtcaagtccgcccccgcggggacgcgggccgcggagagcctgcggcgcgaggggagcatcctgtccgcgctccggtccccgcacgtggtgccctgcctgggcctccgcgccgcgccggacggcgggtgcgagctgctcctcgagttcgcgccgggcggctcgctggcggacgtggcggcgaggaggagcggccgcgacgagcgcgcagtcgccgcgtacgccgcggacgtggcgcggggcctggcgtacctccacgggcgctcggtcgtgcacggcgacgtcaaggcgcggaacgtcgtggtgggcgccgacggccgcgccatgctcgccgacttcggctgcgccagggccgcggcgggcggcgccgaccccgtcggcggcacgccggcgttcatggcgcccgaggtgctgcgcggcgaggggcagggccccgccgccgacgtctgggcgctgggctgcaccgtcgtcgagatgggcacgggccgcgcgccgtggagcgacctggacgggctccccgcggccgtgctccgggtcgggtacacggacgccgtccccgaggcgccccgggtggatgtcgcccgaggn

SEQ ID NO: 57302 - DNA, 612 bp, Zea mays
  misc_feature: Ceres CLONE 1505018
  misc_feature: Encodes the peptide sequence at SEQ ID NO. 57303
cgattgggtccgggccccccctcgagccactgcagtggtaaagggggcggccccgcgttctccgtctccgtctccgtccgcccggcgtaaagaaaagcctccctcaccacagccgccacgccatggccgaggagaccgacaccaggcctgcctccgcgagctcccgaggccgccccgcgcccggggacgacgacagggaggagggcgagatcaccgacatcgcctgcgctccttccccgcccgccacgcacccgctcgagcactcctggaccttctggttcgacaacccgcagagcaagtccaagcaggccgcctgggggagctccatccgcccaatacacaccttctccaccgtcgaggaattctgggggctttacaataacattaatcaccctagcaaattgatcgtgggagctgatttccattgcttcaagaacaagatcgagccaaaatgggaagacccctattgtgcgaatggtgggaaatggaccatcagctgtgggaggaggaaaatctgaatacgttttggctgcaccctctgcctgccaatgaatggtggaccaatcgactatggggaagaaatttgtgggccccatttttcatggggcgggg

SEQ ID NO: 57303 - protein, 131 aa, Zea mays
  misc_feature: Ceres CLONE 1505018
  misc_feature (1)..(131): Pfam Name: IF4E Pfam Description: Eukaryotic initiation factor 4E
MAEETDTRPASASSRGRPAPGDDDREEGEITDIACAPSPPATHPLEHSWTFWFDNPQSKSKQAAWGSSIRPIHTFSTVEEFWGLYNNINHPSKLIVGADFHCFKNKIEPKWEDPYCANGGKWTISCGRRKI

SEQ ID NO: 57304 - DNA, 535 bp, Zea mays
  misc_feature: Ceres CLONE 1505020
  misc_feature: Encodes the peptide sequence at SEQ ID NO. 57305
  misc_feature (149)..(149): n is a, c, t, g, unknown, or other
  misc_feature (364)..(364): n is a, c, t, g, unknown, or other
  misc_feature (365)..(365): n is a, c, t, g, unknown, or other
cgattgggtaccgggccccccctcgagccctgcagtggtaaagggtccgtcagttatttctcttcctcctccaaccaccgatgtcgctaccggttctatccctgcgctgccattgctcgtccgcatcctccttggatttccctcccagngaaggttagggttttctgatgcgctcatacatggggcagcaagaagatgggatgtctgatggcttgtacacttacaagcatcaccgcgagcgaggagctgatatccacaccatctttgtgaagaagagcaaattcaggattctgctgtcatttatcggcacaacgttccccttctgtgtctgttttgctgcgccctgttatcgaaggatggtttnnatgtctttgttccctttgggagcatttcatttgccaagtgtaatttgcggaaatgccctgccgatgtggacccctgtggaagaaaagaagtcatttgttggatcatgccccaccttttgggaattccaattttgaaccacacccttttttgaagggggaaaaaatttttc

SEQ ID NO: 57305 - protein, 106 aa, Zea mays
  misc_feature: Ceres CLONE 1505020
  misc_feature (62)..(62): Xaa is any aa, unknown, or other
MGQQEDGMSDGLYTYKHHRERGADIHTIFVKKSKFRILLSFIGTTFPFCVCFAAPCYRRMVXMSLFPLGAFHLPSVICGNALPMWTPVEEKKSFVGSCPTFWEFQF

SEQ ID NO: 57306 - DNA, 631 bp, Zea mays
  misc_feature: Ceres CLONE 1505025
  misc_feature: Encodes the peptide sequence at SEQ ID NO. 57307
  misc_feature (280)..(280): n is a, c, t, g, unknown, or other
  misc_feature (403)..(403): n is a, c, t, g, unknown, or other
cgaattgggtaccgggccccccctcgagccactgcagtggtaaaggagaatggcacgcatctgaactgaaatggaaactgtgctgtcaccaccactgcaggagtggaggatgtgatcgccgactccaaggcgcacaaggtgctggtgaaggggaagaaggcggccgccgaccccatgaaggtggtggagcgcgtgcagaagaagaccggccgcaaggtcgagctgctgtcgccgatgccgcccccgccggaggtggaggagaagaagaagacgatgaggncggacagaagaaggacgatgagaagaaggcggagccccgaggcgccggaagccgggaggagaagaaggagcccgccgggttgatccgccgtgggtgcttgaaggtgccacaatgcacttgccnaggccttgccccccaagggggaatcaaagaaagaaggaatccctccaagaatgaaaaagggccttgcccattccccgttaaaaacccgggaacctttaaagggggtcttccggaaaggttaaaccgggtggaaaaaggggcccttttttttccaaagggaaaatcccccaaaaccttgggggcgggagaataatcccttgtttttaaaaaaaaagcgcgcagcggggg

SEQ ID NO: 57307 - protein, 62 aa, Zea mays
  misc_feature: Ceres CLONE 1505025
  misc_feature (36)..(36): Xaa is any aa, unknown, or other
MKVVERVQKKTGRKVELLSPMPPPPEVEEKKKTMRXDRRRTMRRRRSPEAPEAGRRRRSPPG

SEQ ID NO: 57308 - DNA, 677 bp, Zea mays
  misc_feature: Ceres CLONE 1505028
  misc_feature: Encodes the peptide sequence at SEQ ID NO. 57309
  misc_feature (385)..(385): n is a, c, t, g, unknown, or other
  misc_feature (392)..(392): n is a, c, t, g, unknown, or other
  misc_feature (394)..(394): n is a, c, t, g, unknown, or other
  misc_feature (420)..(420): n is a, c, t, g, unknown, or other
cgattgggtccgggcccccctcgagccctgcagtggtaaagggggctgtacctgttggtcttcctcctcgctcttcttggttctcgctggttgccgggagctgggatcgaaagtactgctgttgttcgcacggcgaggcggcggcggagaccggtcagaaggaatgtcttcggcccaaatcgcgccggcagatcatgtgtgctatgtgcactgcagcttctgcaacacagttctcgcggtgagtgtcccggggaatagcatgctcaacatcgtgacagttcggtgtggacgctgcgcaaatctactgtcagtgaacctgagagcactgacgcactcactcccagaaacagatcatcagctccaggagaacatcgaggtccatggncatcacngncactttgcatgatgatcatcagtgcngccattttggatcagctcgtttcttcttcgtcgtcaaggttccggcggctttccagtgatgtgttcgcccacagaacgagcagcacctgctgcaagaacaacccttaacaacaatgctcgtcctccgggaaaaaagccgcgggttccctccgggtttaaacaaattcctcaaggaaaaaatccccgggatcaaagggaaaaaccccggggttaaacccaaggggaacccttccacccgggaccccaaaattggggcc

SEQ ID NO: 57309 - protein, 80 aa, Zea mays
  misc_feature: Ceres CLONE 1505028
  misc_feature (4)..(81): Pfam Name: YABBY Pfam Description: YABBY protein
  misc_feature: The sequence is a functional homolog of SEQ ID NO 414 in the 10/666,642 US patent application
  misc_feature: The sequence is a functional homolog of SEQ ID NO 888 in the 11/435,388 US patent application
  misc_feature (77)..(77): Xaa is any aa, unknown, or other
MSSAQIAPADHVCYVHCSFCNTVLAVSVPGNSMLNIVTVRCGRCANLLSVNLRALTHSLPETDHQLQENIEVHGHHXHFA

SEQ ID NO: 57310 - DNA, 702 bp, Zea mays
  misc_feature: Ceres CLONE 1505030
  misc_feature: Encodes the peptide sequence at SEQ ID NO. 57311
  misc_feature (702)..(702): n is a, c, t, g, unknown, or other
cgattgggtaccgggcccccctcgagccactgcagtggtaaaggagtgattgttcgcgtccccgaccgcgagatagaacttttcatcccaaacggaagagtccagtgcagttcctacggcaatccggcgaatgtgagcgtgtgtgtatatttcacgacgtgctcccggcgctcgcacgcctcgctcctacagtacccggactcccctttcgcgtccgcttcgcttgttcgatgaagtgctctcccgttaccgggatccgtactaaggaaggaacgatgacggcgatggcgaatgatactgtgcgggagatgcgcgcgagtttcccggcggcacggagccgcacagcctattgatcggcggcgcagctcaacgggctcatcatgatgattaacgagaacgaaaccgagatcattgccaaggtgccccacgacctcgtcaagccgcacatggagtccttccccctgagatatcacttataaaatcgacttgctcttttgccctcaaaaacgctcaaaaactggaatgaaccccacagaaggtacctggcggccaataattaccactcacaccgtcccccctaaatggtggccacaacccccctcggactacatcgcctcataatccccaggcctggaacacttacacctttccttaacatctctggccagcccccagttccatttagcacgccattcaccctgn

SEQ ID NO: 57311 - protein, 32 aa, Zea mays
  misc_feature: Ceres CLONE 1505030
MMINENETEIIAKVPHDLVKPHMESFPLRYHL

SEQ ID NO: 57312 - DNA, 602 bp, Zea mays
  misc_feature: Ceres CLONE 1505032
  misc_feature: Encodes the peptide sequence at SEQ ID NO. 57313
  misc_feature (206)..(206): n is a, c, t, g, unknown, or other
  misc_feature (224)..(224): n is a, c, t, g, unknown, or other
cgattgggtaccgggccccccctcgagccactgcagtggtaaagggcgtgcccgatccgggccgtcctccttttttcccctcttatatttgatcggtttctttgcgtcgttcacgcagggatcgtcagagaggactcgcatagagggccgtctcatccgactttaggaagccatggagctacatgatgctgggtgccaggcccccnatgcacccatcctctgcnatcatactgggggtttcttctgcagcgcggcgacaataacatgtgctcttagtgcaactagagatgatcccggaggccgatcaggtcaagctggctgcctcttcttttgaaagcctcctttaatgggccctaccccgcatggaacccggtgttccgggaaaccaaccggaatattttttccccaaaaaattttcaaaaataaattccccaacccctttattttgcggaacccagggggggggggggggccttttccagggggggaagggggggcaaaaccggggcccccccccccaaaaaaaaggggggggaccccaatttatccccccgcggtggagaaaatttaaaggcgccccccccccaagtttttttaaaaaa

SEQ ID NO: 57313 - protein, 53 aa, Zea mays
  misc_feature: Ceres CLONE 1505032
  misc_feature (12)..(12): Xaa is any aa, unknown, or other
  misc_feature (18)..(18): Xaa is any aa, unknown, or other
MELHDAGCQAPXAPILCXHTGGFFCSAATITCALSATRDDPGGRSGQAGCLFF

SEQ ID NO: 57314 - DNA, 676 bp, Zea mays
  misc_feature: Ceres CLONE 1505036
  misc_feature: Encodes the peptide sequence at SEQ ID NO. 57315
  misc_feature (676)..(676): n is a, c, t, g, unknown, or other
cgattgggtaccgggccccccctcgagccactgcagtggtaaagggtcagcaatcctaatccaaaccgccgcggccacggccgcagccttccatagttctgtcagaaattccccttctcatccctgatccctccaactcccaccccaatacatcctggcgacgccatcagccggagggacgcacacacgaggtcgaccttcgaaccctagtccttggccgagccgccttgcgggatcgtccccgccgcgcggaagctctgcctcgacccttttagtctccgtccgacaccgcttggatcatagatggaatcagccacccctcacagctgaagcaattgcttttacccagaaaaagatggacatgacttaggaggatataatcaagatgtcagagaaaaagaatgctgaagggaagaacccccctaggcagccgatcaaaaagcgtccattccagaatgccaacacgaataaacggaatggcaaggatcaacggtttatggaatctagatcaaccattggacaaggtgttcttgcacagagaagggcacatcttggtggaactcagattgctgctacaaagcaagctgcaaagaaggctgctgctatagcaactgcgcagcggggctgcctatttgaaagattctagtgcaagtaccttagcgcacaggaggtcagn

SEQ ID NO: 57315 - protein, 86 aa, Zea mays
  misc_feature: Ceres CLONE 1505036
MSEKKNAEGKNPPRQPIKKRPFQNANTNKRNGKDQRFMESRSTIGQGVLAQRRAHLGGTQIAATKQAAKKAAAIATAQRGCLFERF

SEQ ID NO: 57316 - DNA, 667 bp, Zea mays
  misc_feature: Ceres CLONE 1505040
  misc_feature: Encodes the peptide sequence at SEQ ID NO. 57317
  misc_feature (667)..(667): n is a, c, t, g, unknown, or other
cgattgggtaccgggccccccctcgagccactgcagtggtaaagggtgcgagccaccgacggcaacggtcccgccttctatcccttaaccctagacgccgccgccgccggttaaccctcgctagggagctgcagcaacccccgccgacgatggtgaaggagaatacgcggaacctgcctcctgccgacgcggcgacgcctccgagcgacgaccgtgacgccaagagcgagaggaacggcaaaaaggccacgaacgagaacgcgaaggcgatactgccgtcgcagatctcgaccaaggacatgcgccccgaggtgcacgccatgcttaacccatacaacaaggcccataatgacgcgctcggccgccagcgcgggcaggccgcccgccgcgtctaacagctcagcgagcagccaccagataggcatgtgccccacacgatcgataccgccaggaagcccgatgagactgtgtgccggccctacgaccattagctgtttgcacgagatgatgcagatgaattcagtgctggtctacagcatcgcataacctcgaacatgttgattacgacgtgccgcttgcattcaggctagggacctgcatttattgatcagtctatgcatgcgataccgaattctaactgtgtgggaagaggaccatatgacctcan

SEQ ID NO: 57317 - protein, 81 aa, Zea mays
  misc_feature: Ceres CLONE 1505040
MVKENTRNLPPADAATPPSDDRDAKSERNGKKATNENAKAILPSQISTKDMRPEVHAMLNPYNKAHNDALGRQRGQAARRV

SEQ ID NO: 57318 - DNA, 653 bp, Zea mays
  misc_feature: Ceres CLONE 1505053
  misc_feature: Encodes the peptide sequence at SEQ ID NO. 57319
cgattgggtaccgggccccccctcgagccactgcagtggtaaaggctagccagctgagctcgctcccagtccaagagccggccccaccaccgcagctcgatcacaccatgagcaaggagaagcaccaccgcgactggatcctccggcgctgctgcggctccatcgacgcctgcatcctgacgctggacgccgtcgtcggcttcatcgtgcacgtcatcttcctggcgctgcgcccatccaagccgtccttctacctgcaagacgtgcagctgcgctccatcgacctcagcgacccggtgctctacctcgacctccaggtgacgatcgcctcgcgcaacaagaacgagcgggtggacgtgtactacaagacgctggacgcgtacaccacgtaccgcgacgaggcggtgacggtacccgtgtcgatgtcggcgatctaccagggccacaaggacgtgtcgatgtggtcaccggtcatgtcgggagacacggtctccgtggcgcataacgtggcggacgccatgaagcaggacatctagacggcatacatgctgctccacatcagggtggaccgcacgcgtaagtggacggtcggcagctgggtctcgagaagctacaactctttcataaactccccagcgctgctcgtcaacagc

SEQ ID NO: 57319 - protein, 142 aa, Zea mays
  misc_feature: Ceres CLONE 1505053
  misc_feature (38)..(141): Pfam Name: Hin1 Pfam Description: Harpin-induced protein 1 (Hin1)
MSKEKHHRDWILRRCCGSIDACILTLDAVVGFIVHVIFLALRPSKPSFYLQDVQLRSIDLSDPVLYLDLQVTIASRNKNERVDVYYKTLDAYTTYRDEAVTVPVSMSAIYQGHKDVSMWSPVMSGDTVSVAHNVADAMKQDI

SEQ ID NO: 57320 - DNA, 658 bp, Zea mays
  misc_feature: Ceres CLONE 1505055
  misc_feature: Encodes the peptide sequence at SEQ ID NO. 57321
ccgattgggtaccgggccccccctcgagccctgcagtggtaaaggggccgccgcacgccgcacgccccactcctcctctcacctcacttgctcgtcgccgcacctggatctggctctcgtctcctccaagcacggattaggagtgcacctattttgattctgcgaactgagtaactgattctaaaggatagggcaagaaggctcctttctaagcctatcaagtttttcaatgaaatgcaagagttgtttattaacagcagtgctgatggctctctagccatggaagctacaacttgtatgaatgaaactcatcctggagatgacagtgacttcaatgatgatgtgtgcagtgacttctccaactatcctcagcctgtgcatgatctaggtgatgattctgacactttacaatctcccaatcatcatccatctcaaagtgttgatcatagctcgtcaagttctggactgaagcgcccacaaggagagggagtaccagcgaagaggaacgtggaaccaaagagtcgcacaacaaaggtagtagatgaactcagtgctactttggtagaacttcaaaatgatcttaagaagccaccacctccagtgcctatgccttttgttaaccctgatgcaatattgtggcaaaggcttgagaatatga

SEQ ID NO: 57321 - protein, 141 aa, Zea mays
  misc_feature: Ceres CLONE 1505055
MQELFINSSADGSLAMEATTCMNETHPGDDSDFNDDVCSDFSNYPQPVHDLGDDSDTLQSPNHHPSQSVDHSSSSSGLKRPQGEGVPAKRNVEPKSRTTKVVDELSATLVELQNDLKKPPPPVPMPFVNPDAILWQRLENM

SEQ ID NO: 57322 - DNA, 631 bp, Zea mays
  misc_feature: Ceres CLONE 1505075
  misc_feature: Encodes the peptide sequence at SEQ ID NO. 57323
catagctggagctccccgcggtggcggccgctctagaactagtggatcccccgggctgcaggaattcgcacgagaccattacctagaacatcctaatcgaaaaattgattgatcggacggacgcgcgtctccggtcccgtccgtaataacactgatccgatccacgccggccggcgatggagctcatcaagtccagggcgaccgtgtgcgcgctcctcctggcgctgctcctgctctcacactacgacggcgggacgacgacgacgatggtggcggaggcccgggtgtgcatgggcaagagccagcaccactcgttcccctgcatctccgaccgcctctgcagcaacgagtgcgtcaaggaggacggcgggtggaccgccggctactgccacctccgctactgcaggtgccagaaggcgtgctaagcaaagctcttcaaacacccttggcttgccagaactgaactctagtagtactaagtaacacccttggctagctgtgcacaacctacgtaccgtgcatgcatgtaatgtggtgtcatgtaacgtgacagcaataaatagtattaataataataacacggcatgtagccaagcaacagactgtgcggtcccaccgggtcagcgaccgt

SEQ ID NO: 57323 - protein, 82 aa, Zea mays; identical to SEQ ID NO: 41020
  misc_feature: Ceres CLONE 1505075
  misc_feature (36)..(82): Pfam Name: Gamma-thionin Pfam Description: Gamma-thionin family

SEQ ID NO: 57324 - DNA, 630 bp, Zea mays
  misc_feature: Ceres CLONE 1505078
  misc_feature: Encodes the peptide sequence at SEQ ID NO. 57325
aaagctggagctccccgcggtggcggccgctctagaactagtggatcccccgggctgcaggaattcgcacgagaccattacctagaacattctaatcgaaaaataaaccgaccccaacgcatccattatattcagcttcttgatctcacacgaaggcatggcgacggagatccagggctactacgatgacggcaccgccgtggtgtcgttcgacgtgcacaacatcgacaccacgctgacgaacttgggcagcgtggtggagtggtggctgggtgagacctatcgcctccaccaccgcggccacatcgccggcctcgacgtggagtggcgccccgctcgcgtgccgggccccgtccccgtcgccgtgctgcagatctgcgtcgaccaccgctgcctcgtattccagatcctccaagccgactacatccccgacgccctgtccaggttcctcgccgaccgccggttcaccttcgtgggggtcgggatcagcggcgacgtcgcaaagctgcgggccgggtacaggctgggggtggcgagcgccgtggacctgcgcgttctcgctgccgacacgctggaggtgcccgagctgctccgcgcggggcttcagacgctggtgtgggaggtgatggg

SEQ ID NO: 57325 - protein, 157 aa, Zea mays
  misc_feature: Ceres CLONE 1505078
MATEIQGYYDDGTAVVSFDVHNIDTTLTNLGSVVEWWLGETYRLHHRGHIAGLDVEWRPARVPGPVPVAVLQICVDHRCLVFQILQADYIPDALSRFLADRRFTFVGVGISGDVAKLRAGYRLGVASAVDLRVLAADTLEVPELLRAGLQTLVWEVM

SEQ ID NO: 57326 - DNA, 628 bp, Zea mays
  misc_feature: Ceres CLONE 1505084
  misc_feature: Encodes the peptide sequence at SEQ ID NO. 57327
aaagctggagctccccgcggtggcggccgctctagaactagtggatcccccgggctgcaggaattcgcacgagaccattacctagaacatcctaatcgaaaactgttcgccagagccaagcccctagtagccacctcgctccagaagctttcctcccctagatctccctcccgtgcccggtcgcgctgccgacccggccatggcgaccaaggggaagctcggggagctagtgtgggagcaccgggtgcaggcggccgcagcggtggctttcgtggccgcggccgccgtctcgatctccgccgtcgggcccaggctcggcgccgtggtgtcattcttctggccgctgctcgtctccacgggcctcttcctggtggcggtcgccgtgctgctccggatctcgccgccgcccgcgggcgacgacgacgagtccggcaaggagctcatcgacttcgtcgccgggtgccgcccggagcacctcgtcccggatgcggcgccgccggcggccgtagcccccgtggaggctccgcccgagctgcagatctaacgggctgccggaggaggaggctgacagcagcctagctgtgctgtgtgctgctgcgtggcatggcgtgctccgtccccgggtgaa

SEQ ID NO: 57327 - protein, 114 aa, Zea mays; identical to SEQ ID NO: 42026
  misc_feature: Ceres CLONE 1505084

SEQ ID NO: 57328 - DNA, 603 bp, Zea mays
  misc_feature: Ceres CLONE 1505086
  misc_feature: Encodes the peptide sequence at SEQ ID NO. 57329
aaagctggagctcaccgcggtggcggccgctctagaactagtggatcccccgggctgcaggaattcgcacgagaccattacctagaacatcctaatcgaaaaaagggccaaggcagggcactgcactgcacgcatgcactgacctgacgacgcgcgccacagtccactccacactcaggcatggcgatgggcgccgcttccatcctactgatgatggtttcgctggaggccctgcttctcgccgccgccgccggcggcgggaccatccgtctgcccagcgatgtcggaggcgttgctgcagaccttgtcacggcgatggcgagggcgagggcaagggcaaagcatcagcttcgcgacgaggagaggccgtggggggaatgctgcgacttggccgtatgcgtcaagacgtacccgctaacttgctcgtgctttgatcgggttgagcgctgctccgacgcctgtaaggagtgcgtggaaacggaggactcgcgccacgtctgcgtcgacaggtaccgtggcgaccccgggcccaggtgccacgacgaggacgggaggagcggcggacccgctgacgacgacgctggtgggcaagcgacgccgacg

SEQ ID NO: 57329 - protein, 141 aa, Zea mays
  misc_feature: Ceres CLONE 1505086
MAMGAASILLMMVSLEALLLAAAAGGGTIRLPSDVGGVAADLVTAMARARARAKHQLRDEERPWGECCDLAVCVKTYPLTCSCFDRVERCSDACKECVETEDSRHVCVDRYRGDPGPRCHDEDGRSGGPADDDAGGQATPT

SEQ ID NO: 57330 - DNA, 621 bp, Zea mays
  misc_feature: Ceres CLONE 1505087
  misc_feature: Encodes the peptide sequence at SEQ ID NO. 57331
catagctggagctccccgcggtggcggccgctctagaactagtggatcccccgggctgcaggaattcgcacgagaccattacctagaacatcctaatcgaaaagacgaaggaaaaggcagccttctcaccgtcggacccggcgatgcagcggcacgtcgcctccggccggccgtcgggcacggacggctccgacttttcttaccgcatggtcgtcgaatcccggtaccagagggtcgccgagggcagatcccgcctcgcgcgcctcatcctcgtgcaggcgctgcacctagtggccggaggcttgcttctattgctgtcgttgtccaagggggcggcggtgaacaagttcgccgtgctgtccatggccgcgggattcctggctatagtggtgggggaattagggcgattgcggaccatggcagtgctgcttcggctttacacaagcttgtcatcaatttgcgttgcattctctgtgacgtgcattatcccggtcagtggtgttcttgaaggttatgaagcaaaacacagaagccctcacaagctaccaaatggctgatgcggttccggttgctccttggatcctgcctgcaatggggggttatagctccaactcccaactc

SEQ ID NO: 57331 - protein, 137 aa, Zea mays
  misc_feature: Ceres CLONE 1505087
MQRHVASGRPSGTDGSDFSYRMVVESRYQRVAEGRSRLARLILVQALHLVAGGLLLLLSLSKGAAVNKFAVLSMAAGFLAIVVGELGRLRTMAVLLRLYTSLSSICVAFSVTCIIPVSGVLEGYEAKHRSPHKLPNG

SEQ ID NO: 57332 - DNA, 607 bp, Zea mays
  misc_feature: Ceres CLONE 1505088
  misc_feature: Encodes the peptide sequence at SEQ ID NO. 57333
atagctggagctccccgcggtggcggccgctctagaactagtggatcccccgggctgcaggaattcgcacgagaccattacctagaacatcctaatcgaaacaagaattcgcacgagaccattacctagaacatcctaatcgaaaaaagcaaaggctgctgcatactggaaggccctctgtctgtgtgcgagcgcaagagaaagggagtcagagagagagagagagggaggagaccttgcagaggagcgaagcaagcaaggtgggaaagaggcagcagcaagggcggcgggctgccggaaggggaacatgctccctcctcatctcacagagaatggcgcggtgatgattcagtttgggcatcagatgcctgattacgactccccggctacccagtcaaccagtgagacgagccatcaagaggcgtctgggatgagcggagggagccttcacgagcttattatgacctttcaggcaaccttgaatggtaacccaaaaaaggcccaaacaaaatgattccaacctttcccctggcaaacccgaaaaagcttttccccataatcccaaacctggaccggactcagccctttcccaataaaaacccaattg

SEQ ID NO: 57333 - protein, 68 aa, Zea mays
  misc_feature: Ceres CLONE 1505088
MLPPHLTENGAVMIQFGHQMPDYDSPATQSTSETSHQEASGMSGGSLHELIMTFQATLNGNPKKAQTK

SEQ ID NO: 57334 - DNA, 648 bp, Zea mays
  misc_feature: Ceres CLONE 1505089
  misc_feature: Encodes the peptide sequence at SEQ ID NO. 57335
aaagctggagctccccgcggtggcggccgctctagaactagtggatcccccgggctgcaggaattcgcacgagaccattacctagaacatcctaatcgaaagattcctttgtttcctgcagctgccgtccccgtccgcctcgctcgctcgttcttccgcctcgctccaccaccggcgcccgcacgcacgtctggcgtagggatacagccgcacaggaagaccccctcccctcgacggaagcctcctccgagtgggggcatctacctctctttccctttagttaattttccaaactatatttgggggtgttcagcaaaaaaaccgcgtccaactgcgcccgtgcgggtgagggatcactagaggctggactcgcgctagagatggtgaaggcaaaagcaagggtccgctatgagcctggaccggcttttgaggaggtcaaagaagaagccatgcttgatatatcaccaacagactcgacagagttttggttaattcagtggcctaaggaccagatagatgttttggattttcatggcaaagagctttctctcaagctgcatagtgatggaaacttgggcaacttggaaaattcctcagggaaatcttatgagattgcgagctttgcagctcagaaaccagatgcaaccg

SEQ ID NO: 57335 - protein, 89 aa, Zea mays
  misc_feature: Ceres CLONE 1505089
MVKAKARVRYEPGPAFEEVKEEAMLDISPTDSTEFWLIQWPKDQIDVLDFHGKELSLKLHSDGNLGNLENSSGKSYEIASFAAQKPDAT

SEQ ID NO: 57336 - DNA, 622 bp, Zea mays
  misc_feature: Ceres CLONE 1505099
  misc_feature: Encodes the peptide sequence at SEQ ID NO. 57337
atagctggagctccccgcggtggcggccgctctagaactagtggatcccccgggctgcaggaattcgcacgagaccattacctagaacatcctaatcgaaaattactcggcagacggcagcgcacacattcacttggccttggcttttgcctttgtgctgtgacttgcaaggaacgtcggcgagagggccgggcaggcaggcaggcgcacagcacagacacagactcctccatcctcgcccaccggccggccggcgctcccgatggcgtccaggtgcttcttccccagggacgctgcggccgccgaccacccgcagtccaaggcggcggcggcccaagccctcgagcggctgcaccacggcgggcgcctcctgtccaggtagacgtcgggggcgcggtgcgcgtcaagatcgtcgtcagcaagcgcgagctcaagcagatggtcgcggcgctcggcgacggcggtctgttggccgcgggcagcagcgagcgccacccgcagcccgcggcggcagccgcagggcccggcgccaacaaaagctgcaatcccttgcggcgcccaacctggcgggggcggcccaaagctgccccccggcgatcccagccggccggaaatggaaacc

SEQ ID NO: 57337 - protein, 39 aa, Zea mays
  misc_feature: Ceres CLONE 1505099
MASRCFFPRDAAAADHPQSKAAAAQALERLHHGGRLLSR

SEQ ID NO: 57338 - DNA, 664 bp, Zea mays
  misc_feature: Ceres CLONE 1505110
  misc_feature: Encodes the peptide sequence at SEQ ID NO. 57339
  misc_feature (637)..(637): n is a, c, t, g, unknown, or other
ctggagctccccgcggtggcggccgctctagaactagtggatcccccgggctgcaggaattcgcacgagaccattacctagaacatcctaatcgaaaaaccacgctgtgcctgtgagtgactcggtcgcatcttccccattctccatcgacgcaccggcggcggcgcaagtgaagcgaagaggaaaggaagctacgagatgtcggcgaccactgcagcggtgcccttctggcgggcggcggggatgacctacatcggctactccaacatctgcgctgcgctggtccggaactgcctcaaggagcccttcaagtctgaggccgcgtcccgcgagaaggttcatttctccatctccaagtggacggatggcaagcaggagaagcccactgtccgcacagaatcggatgactaagggctggcgcgccatggcgacatagtccttcccacagatgatttgaagcgtcgttgcaagtttctgagacttgttatttagttggcttgatttgtaatcaatgctgaagaataaatactttttgcgacaatggtctttttacaatgtcgtgttgttttcgttgctaattgcacttgcccttcccaaatcaagcatgtgaactaatggaatgcttcagttttgtgcnaaaaaaaaaaaaaaaagcttatcgata

SEQ ID NO: 57339 - protein, 70 aa, Zea mays; identical to SEQ ID NO: 4918
  misc_feature: Ceres CLONE 1505110
  misc_feature (9)..(57): Pfam Name: ATP-synt_Eps Pfam Description: Mitochondrial ATP synthase epsilon chain

SEQ ID NO: 57340 - DNA, 652 bp, Zea mays
  misc_feature: Ceres CLONE 1505112
  misc_feature: Encodes the peptide sequence at SEQ ID NO. 57341
tggagctccccgcggtggcggccgctctagaactagtggatcccccgggctgcaggaattcgcacgagaccattacctagaacatcctaatcgaaaaatgcgaccctgtttcctgtctcctaccctcttgcggtcttgccagcgccccttcctcccttcgtctccgccgccgcggactcctcgccggaaccctaaatggaccccggcgccggtgcacactactccgcccgtaccgcggaggaagtcttccgcgatttccgcggccgccgcgcgggcatgatcaaggccctcaccaacgatgtggagaagttctaccagctgtgcgaccccgaaaaggaaaacttgtgcctttatggctaccccaacgaaacatgggaagtaactttgccagcagaggaagttcctccagagatccctgaaccagctttgggtataaactttgctagggatggcatgaacgagaaggattggttggcgttagttgctgtccacagcgatgcctggatactagctgttgcattctactttgcagcccggcttgggtttgacaaagagccaggcggcgactcttcacatgataaatacttgcccacatatttgaagtagcgactggggtgccaagaaacaaatcagggagaggaactcaatatac

SEQ ID NO: 57341 - protein, 136 aa, Zea mays
  misc_feature: Ceres CLONE 1505112
MDPGAGAHYSARTAEEVFRDFRGRRAGMIKALTNDVEKFYQLCDPEKENLCLYGYPNETWEVTLPAEEVPPEIPEPALGINFARDGMNEKDWLALVAVHSDAWILAVAFYFAARLGFDKEPGGDSSHDKYLPTYLK

SEQ ID NO: 57342 - DNA, 656 bp, Zea mays
  misc_feature: Ceres CLONE 1505120
  misc_feature: Encodes the peptide sequence at SEQ ID NO. 57343
aagctggagctccccgcggtggcggccgctctagaactagtggatcccccgggctgcaggaattcgcacgagaccattacctagaacatcctaatcgaaaacccgaccctcgtggcctcgtccaacgttcgtgccgcttgctgggccgccgacgcgccaggccgctggagcagctcgcctgccccccacgccgtgcccctcgctcagcctgcgccgcctcgcacacctcgcgccgctagcccggccggagccgctcttcttccaccgcgatcgccagctgccgccgctcctctaatggtgacgaggtggcgccagaagagcccgggcctcaagatcctgtggatctggaccctgggcaccgccgcaattgtggtcggcggtatcgtccggatgcgggtaaacgatgtgcagaagatccttcgggaagaagaggaagccgccgctaccgccacggccacgtcgccccccagcgagcgagtcctgaaagacgaagagtagaacaggaagtggagagttttgcgccatttgagctgggggatgcatctgtatcgggcccataatgtagtatctccattttaaaaaaggtttgagttttaggaaagaattgtttactgtagtgattcataaccccttcacctgtctgcattaaactttca

SEQ ID NO: 57343 - protein, 67 aa, Zea mays; identical to SEQ ID NO: 54925
  misc_feature: Ceres CLONE 1505120

SEQ ID NO: 57344 - DNA, 679 bp, Zea mays
  misc_feature: Ceres CLONE 1505122
  misc_feature: Encodes the peptide sequence at SEQ ID NO. 57345
aaagctggagctccccgcggtggcggccgctctagaactagtggatcccccgggctgcaggaattcgcacgagaccattacctagaacatcctaatcgaaaacacaaaaaattagggagttttcttctcccgtccaccttgcgtgctcgcgcgcgagctctcgtggcgcagccacaactaggcgaccgccgccgcccctacgccacgtgctcgagtctagcctcgtcgattgcttccccagtttaattgatctacaagcttcagaacatgttcaagaatacatttcagtctggggtcctgtccattctttatagcctcgggaccaagccattgcagatatgggataaggaagttgtgaatgggcacattaaacgaccccaagatgaagatatccaatctaatgtacttgaaattgttggaacaaatgtacagtcaacttacatcacatgcccagctgatccttctgctactcttgggattaagcttccatttctggctattattgtgaaaaatcttaagaaatacttcccgtttgaaatccaagtccttggatgacaagaatgtccgacgccgatttcgagcatcaaattttccatctggcccaagggggaaagccctttaatctgcgcccaagccccttgaaaccctcaccaaagggtggggaaaaacaccccgaggg

SEQ ID NO: 57345 - protein, 95 aa, Zea mays
  misc_feature: Ceres CLONE 1505122
  misc_feature (1)..(96): Pfam Name: DUF667 Pfam Description: Protein of unknown function (DUF667)
MFKNTFQSGVLSILYSLGTKPLQIWDKEVVNGHIKRPQDEDIQSNVLEIVGTNVQSTYITCPADPSATLGIKLPFLAIIVKNLKKYFPFEIQVLG

SEQ ID NO: 57346 - DNA, 587 bp, Zea mays
  misc_feature: Ceres CLONE 1505124
  misc_feature: Encodes the peptide sequence at SEQ ID NO. 57347
tcccccgggctgcaggaattcgcacgagaccattacctagaacatcctaatcgaaaaaatgcttcgagcgcccaaatccacctgagactccgtgagctccctgcctgctgccctgcacactccccgccgagccgcaccacctcaactcagctcagcagtcatggctcgcccctgccgcagcagcagcagcgccgctgcccgcctcctcctgctgctcgccgccgtcgcagcggggctccaggccgcggccgccgcgccgccggtggcgaggggcttcatccgtaaatcaggccgcgcgacggagaacccgtcggtgtgggaggggaaccccccgaaatacggaggctccacgacgcctggaagccggcggaatctgcccccccccgcgctaccagagagggggtaccgagggcagaaagcgtccgcgggggtaagcgcggatagtgcgactcacggcccggtacctgcaacagaagccaccggcggatcgactgcagcggcgcatagaaaggacggccaaccgctagtgccccagcagcgacgatcaggaaaaagcgaaagacagcgtgacccgggcggggcaaccc

SEQ ID NO: 57347 - protein, 142 aa, Zea mays
  misc_feature: Ceres CLONE 1505124
MARPCRSSSSAAARLLLLLAAVAAGLQAAAAAPPVARGFIRKSGRATENPSVWEGNPPKYGGSTTPGSRRNLPPPALPERGYRGQKASAGVSADSATHGPVPATEATGGSTAAAHRKDGQPLVPQQRRSGKSERQRDPGGAT

SEQ ID NO: 57348 - DNA, 665 bp, Zea mays
  misc_feature: Ceres CLONE 1505142
  misc_feature (511)..(511): n is a, c, t, g, unknown, or other
aaagctggagctccccgcggtggcggccgctctagaactagtggatcccccgggctgcaggaattcgcacgagaccattacctagaacatcctaatcgaaaattgtctcgagctctagtcatagtccaacttgtgggagtggtaatccttgtgtttctgctagtataaaccctctcatcagtcctcaggtttgccctgtacagaaccttgcacgttgtgttcctgcacgtggtgaccaacccacccagttgctcatctcaccgtggccggggtgtcttgaggagtcgcgtgcccagaacagagtcacaccgacgcggtctggcgccgtggacagcttcaccaccaactcatcgtaccacgtcttctccgagtgttttcacacaagcacagtaagacagaacacctagaagaagtggtgtttgaaggaggagtctactccagtggctgctgatcaagtggaggagccatctgactgggtattgggtggaaaggtctttagcctcttctctgncacaaaggagaagtttttttcccttttctttaggttagttacttcatgtggaggacttgaagcttagaaagtttttatatatcttttatggaaaggcttcacccttccaattattgtaataagttatgcacttcgagtactatcaggacttgta

SEQ ID NO: 57349 - DNA, 634 bp, Zea mays
  misc_feature: Ceres CLONE 1505175
  misc_feature: Translation starting site: 170
  misc_feature (553)..(553): n is a, c, t, g, unknown, or other
  misc_feature (575)..(575): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
atagctggagctccccgcggtggcggccgctctagaactagtggatcccccgggctgcaggaattcgcacgagaccattacctagaacatcctaatcgtaaactgattcctcacccctgctcgccgcgaagcacagctctgtcaccgcggtttgccgtggccggcgaagatgatgtccggcggtgggtactccgccctcgacgaccccaaggcctccggatccgtcccggcggccacggggacagatccgccggccatcaggttcgccgactccaacctccagaccttcccgccgtccgaggccaggggcaagatctccggcgcctaccgcccgcccaccgacgccgatgacaccttctcgtccaagggcggaggagccggaagcggtggcagaggcggcagcgccggggttggatgatgccgcgcagggcggctggttccgcatggtctccgtggcagcgtacaagccctacttcgacgttgacacctctgacgttgtccagagaatcctggggagtccgtcttcccccttccgcggcacatttacccgagnaaagactccgagaaaccctgancctgtctggggcatttgcgggnnntgcacccaccctgatttttcgttgcctgcatctat

SEQ ID NO: 57350 - DNA, 663 bp, Zea mays
  misc_feature: Ceres CLONE 1505178
  misc_feature: Encodes the peptide sequence at SEQ ID NO. 57351
  misc_feature (413)..(413): n is a, c, t, g, unknown, or other
  misc_feature (419)..(419): n is a, c, t, g, unknown, or other
  misc_feature (420)..(420): n is a, c, t, g, unknown, or other
gctccccgcggtggcggccgctctagaactagtggatcccccgggctgcaggaattcgcacgagaccattacctagaacatcctaatcgaaaactctccgtgtaggccgcgggattccgtgtccctctccaatccggcgtagccatcgtcgccggatacaggatccggtccccgcgatggagccctcaccaacctcctcctcgccggctgtggcgcgccggttgtcgccggaggtaaggagggtgccgaagcgggcgctggaggagttgttggagcaggtccagcgggctgttgagatgctgcgcgatgccgacgctgatctcgccatctctctctcggaggagaccgcagcagcctcgccggaggccgaggaccgcaaggacgatgttggtgtcgatggagatggcatggcnacctcnncggttgcgagtgactccgattacgagacgacgcagatgtgtgacctttcttaaatctaaggttggatcactccgagttccttcaaaagctccaatggtattcagaaagtcacgaagatcaagaattgtgccagttggaacccggataacatcatgggggatataaataaaaagtccgaaatttggtgcgaaaagaatgggggacccccaaatgagtggcaattttgcttcctttgtctaaaga

SEQ ID NO: 57351 - protein, 98 aa, Zea mays
  misc_feature: Ceres CLONE 1505178
  misc_feature (82)..(82): Xaa is any aa, unknown, or other
MEPSPTSSSPAVARRLSPEVRRVPKRALEELLEQVQRAVEMLRDADADLAISLSEETAAASPEAEDRKDDVGVDGDGMATSXVASDSDYETTQMCDLS

SEQ ID NO: 57352 - DNA, 697 bp, Zea mays
  misc_feature: Ceres CLONE 1505179
  misc_feature: Encodes the peptide sequence at SEQ ID NO. 57353
ctggagctccccgcggtggcggccgctctagaactagtggatcccccgggctgcaggaattcgcacgagaccattacctagaacatcctaatcgaaaactggcttcctttcttcgccatggcaaccatgtccctccgctgcctcgccatggccatggccgacaccgcgctcccgcccgcccacaagctcctccccacagtttccctcccgctcctctcctcgtccacccgcgccgcgccgctcctcctcttcgccaggcgccgcctgccgctcgcgcccctcgttacctcctccgacgccgttgaggccaagtcggcagacgaggaagaagagaaggccggagagcccgtcgaaatggaagctggggagtttgaagaggtgctagcctcaggccgccaagggtgaagggccataccccgccggtgggcccgccagaggaggccaagggctacgttgggaaccttccctaccacttcaacgggaagggactccggaaaattttcaacaagccggcctccttcaagtcccccaaggttactcaaaaacaaaaaactgggccaaaacccggggttttggtttttttccctgaaccccttttggggaacctaacaaaccctttggaatttcccccccccttttaatattccggaggggttttttaaaaaaaaaaaagggcgtcttttttagggcgcccccc

SEQ ID NO: 57353 - protein, 95 aa, Zea mays
  misc_feature: Ceres CLONE 1505179
MATMSLRCLAMAMADTALPPAHKLLPTVSLPLLSSSTRAAPLLLFARRRLPLAPLVTSSDAVEAKSADEEEEKAGEPVEMEAGEFEEVLASGRQG

SEQ ID NO: 57354 - DNA, 689 bp, Zea mays
  misc_feature: Ceres CLONE 1505191
  misc_feature (689)..(689): n is a, c, t, g, unknown, or other
ctccccgcggtggcggccgctctagaactagtggatcccccgggctgcaggaattcgcacgagaccattacctagaacatcctaatcgaaaaatattccctacgcctcgctagcgccttccgcgaactgaggtctcccgagaggccgagaccaccccgatgtccgccatggagaccgacatcaacgcgccgccgcccgccccagccggcgagggatcctccgtggtcggcccgtcctcctcatcctcccgcaagcccaacaagcgccccgagaccacgaagtggaacgccgtcccgctctggccacggaatatccgacctcgacaactgcgccaccctgccacaaccccatcatgcgctcgtatgcatcgggtgggcaggcgcaacccacctaaccccaaccagcgagggagtgcacccgcccccccgggcgggtcctgtaatcgatcgcgcccgcaccttccacctggatcagctggccggctgtaagacccccgccacagccacccccgtttgcacgcacagcgcagttgtgaatctcccacaaagatggggcagcgacgtcccccgggcccacccgccaattccgattgacccgcgcccgtgtgctggccgcccgagggagaggggtacgcttgtccggcccccaagcgtcttccccaccttccggaccgtgttcctcgccactgn

SEQ ID NO: 57355 - DNA, 794 bp, Zea mays
  misc_feature: Ceres CLONE 1505194
  misc_feature: Encodes the peptide sequence at SEQ ID NO. 57356
  misc_feature (1)..(1): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (58)..(58): n is a, c, t, g, unknown, or other
  misc_feature (59)..(59): n is a, c, t, g, unknown, or other
ngggggctaccctcttaagcacccaccaaccgcgggctcctnnnnnnnnaaaaaaaannccatgctggagctccccgcggtggcggccgctctagactagtggatcccccgggctgcaggaattcgcacgagaccattacctagaacatcctaatcgaaaaaattattgcctctctttcttgctcgccaccgcctcgtcaaagacacgcggaaaagaagaggaagggggaggcgactcgaccgacgcccggtttcgatctctggtcctccgattgcgtccagatccaccggcaatggcaccatctgcggacccatggctgaaggaatacactgaagcacccggactcgtcgacaacctcatctgcatgagtgccgacagagggtttgttcgaaaatcaaggcccagaaattaatgggggataactcccccccgcccggcagaaaaatgtgtatttcgtcgggacctagactcgggtcagcgtggaaaccccccccccctcgcccgaagtggggggcgggaaccgcgcaccacctcgacaccgcgcccaagcccgcaaaaccgcaaaagaacaatgctctgatccaggatgcgctaaaccctatagggccgccgcctgattggggggaccgaggttgaccaacaatggtcgaaaatctttcgcggcaaccaagggggagggaatcccgcatcttcggcgcccagagataaaatacggcccactaatacacctgtcgaggaacacatagtggtcctcgggggtgtctgcattatcccccctatggggcattggtgt

SEQ ID NO: 57356 - protein, 39 aa, Zea mays
  misc_feature: Ceres CLONE 1505194
MAPSADPWLKEYTEAPGLVDNLICMSADRGFVRKSRPRN

SEQ ID NO: 57357 - DNA, 640 bp, Zea mays
  misc_feature: Ceres CLONE 1505198
  misc_feature: Encodes the peptide sequence at SEQ ID NO. 57358
  misc_feature (247)..(247): n is a, c, t, g, unknown, or other
  misc_feature (331)..(331): n is a, c, t, g, unknown, or other
  misc_feature (378)..(378): n is a, c, t, g, unknown, or other
  misc_feature (379)..(379): n is a, c, t, g, unknown, or other
  misc_feature (380)..(380): n is a, c, t, g, unknown, or other
  misc_feature (381)..(381): n is a, c, t, g, unknown, or other
  misc_feature (383)..(383): n is a, c, t, g, unknown, or other
  misc_feature (390)..(390): n is a, c, t, g, unknown, or other
  misc_feature (391)..(391): n is a, c, t, g, unknown, or other
  misc_feature (399)..(399): n is a, c, t, g, unknown, or other
  misc_feature (426)..(426): n is a, c, t, g, unknown, or other
ccgcggtggcggccgctctagaactagtggatcccccgggctgcaggaattcgcacgagaccattacctagaacatcctaatcgaaaaattcattcatcactcaccagtcaccaccactgccgcgaccgagagagtcagagagagcaggcggcggcaatggctggcgctggggacaagtactactacggcgggccgggccagcgcggcgcgcccccggcctgctgctggcggtggtggtgggcctcntggtggcgggccccctgttcctgcgcgggggggggggaggcgctgaccgaatccttggtcggactccggaccccggggggggtncttcttttttttttttccccccccccattggggaaagaaaagggggnnnncnaaacccnncccccccnctcccccaccaaaaccttaaacttccnaccggggcgcgcggggggggggcgcccccccccccaacccttcccccggccgcgcgccccccgccctcgccccccgcccccctccccgcccgcgccccgccgccgctccgcgcccccctcctccccgccccgtcccccccccccccctcccacccccccccccgccgcgcgttgtgttcccccccctccccccgccacgggcgccccgcccccg

SEQ ID NO: 57358 - protein, 161 aa, Zea mays
  misc_feature: Ceres CLONE 1505198
  misc_feature (74)..(74): Xaa is any aa, unknown, or other
  misc_feature (75)..(75): Xaa is any aa, unknown, or other
  misc_feature (76)..(76): Xaa is any aa, unknown, or other
  misc_feature (78)..(78): Xaa is any aa, unknown, or other
  misc_feature (81)..(81): Xaa is any aa, unknown, or other
  misc_feature (90)..(90): Xaa is any aa, unknown, or other
MAGAGDKYYYGGPGQRGAPPACCWRWWWASWWRAPCSCAGGGEALTESLVGLRTPGGVLLFFFSPPPLGKEKGXXXTXPPXSPTKTLNFXPGRAGGGRPPPQPFPRPRAPRPRPPPPSPPAPRRRSAPPSSPPRPPPPPPTPPPAARCVPPPPPATGAPPP

SEQ ID NO: 57359 - DNA, 654 bp, Zea mays
  misc_feature: Ceres CLONE 1505200
  misc_feature: Encodes the peptide sequence at SEQ ID NO. 57360
  misc_feature (573)..(573): n is a, c, t, g, unknown, or other
aaagctggagctcaccgcggtggcggccgctctagaactagtggatcccccgggctgcaggaattcgcacgaagaaccattacctagaacatcctaatcgaaaaagtgagtagtagccaaccttggtctccacttcctgctgccaagtgccaacgcgagtccatccctcttctcctccgcatccaaagaaaccagaccacaagacatcgagagaacagttgcggccttgctggcacggggatagatcttctccactccaatggcgggcttctcacggccgaacaactcggagctcctcctcaagatgcctgcgactttggccagtagccacaccccgaacctctcaagcctcctgttctacgaccagaaccatggccaagctgtaaatgcaaatgcagcagcgatgacgatggtggaggacgacgcctcactccagagctcatctgcagtggtcgacacctccccgcagccacagggcagtgctgctgctgcgtctcccatggagagaaagaagaagcctgcaaaagacagtgctacactcagctctgctcaatccaaggaggattgcaaccngcagcaggagagcaagagcaggcggggaaaaaagccccccaacaaggaggctaatactgaagagaagaaccgctcttgaaa

SEQ ID NO: 57360 - protein, 130 aa, Zea mays
  misc_feature: Ceres CLONE 1505200
  misc_feature (105)..(105): Xaa is any aa, unknown, or other
MAGFSRPNNSELLLKMPATLASSHTPNLSSLLFYDQNHGQAVNANAAAMTMVEDDASLQSSSAVVDTSPQPQGSAAAASPMERKKKPAKDSATLSSAQSKEDCNXQQESKSRRGKKPPNKEANTEEKNRS

SEQ ID NO: 57361 - DNA, 646 bp, Zea mays
  misc_feature: Ceres CLONE 1505203
  misc_feature: Encodes the peptide sequence at SEQ ID NO. 57362
  misc_feature (369)..(369): n is a, c, t, g, unknown, or other
atagctggagctccccgcggtggcggccgctctagaactagtggatcccccgggctgcaggaattcgcacgagaccattaccagaacatcctaatcgaaaactcctttctcacacctcgacgcctctctctctttccccgagctctcgaaaccctaggtgcgtgccgaccggcggcggcggcgaggtgatggcgatggacccggacgcggtggcgaaagccttcgtggagcactactaccggacgttcgacaccaaccgcgcggcgctggtggggctgtatcaggagacctccatgctcaccttcgagggccagaagttccagggcccatccgccattgccggcaagctcggatctcttcccttcaggnctgcgagcaccagatcgtcaccgtcgactgccagccgtcggggccccagggagggatgctcgtcttcgtctcccgttccatccgcaccggccccgaagaagacccatcaggtcccctcaggattccatttgctgcccgaaactgggccctttctccgggcaaaatgacagggtccgcccgaaacttggttaaaaaaccccgaaaaacccttgggaataaacaattttgttaagggcttcctgttggaaacaaaaatccccgcgggccccccctcctc

SEQ ID NO: 57362 - protein, 115 aa, Zea mays
  misc_feature: Ceres CLONE 1505203
  misc_feature (8)..(114): Pfam Name: NTF2 Pfam Description: Nuclear transport factor 2 (NTF2) domain
  misc_feature (61)..(61): Xaa is any aa, unknown, or other
MAMDPDAVAKAFVEHYYRTFDTNRAALVGLYQETSMLTFEGQKFQGPSAIAGKLGSLPFRXASTRSSPSTASRRGPREGCSSSSPVPSAPAPKKTHQVPSGFHLLPETGPFLRAK

SEQ ID NO: 57363 - DNA, 662 bp, Zea mays
  misc_feature: Ceres CLONE 1505205
  misc_feature: Encodes the peptide sequence at SEQ ID NO. 57364
caaagctggagctccccgcggtggcggccgctctagaactagtggatcccccgggctgcaggaattcgcacgagaccattacctagaacatcctaatcgaaaagtgttatccatttcttctcctctctgctctgttcacttcgttctagtggggagcgccgccgctgcagttgccgccgccaccagagcagtccacctcggtctgatatggcgaccgggagtgcaagtgccatcgcgtccttctccgtggcggcggcagcggctgctgctctgcgcgtcaggcggccatgcgctcgcgcttgcgcttgggccccctcgcagcgaccgcagcaaggggcactcgtcagcctcaagccttgcgcctcactgggcacacaagctcctctgtggcgcgcggggtccgaatgcgcggggggtggtgccgcgccggcgatgtcatgggcttctcctccggagcgcatagtcttctccgacacgaaatcgaggatttcctcgggaaccccgttgtaaacaagttcctcctctttgagccttgaacccggaattcgaaatccccctttttggaaattccccaggggggatccctttgcgcaaaaatggcccctttattaaataaaagccccttgtggaggcgcaaacggggcccccttggggaaggggga

SEQ ID NO: 57364 - protein, 100 aa, Zea mays
  misc_feature: Ceres CLONE 1505205
MATGSASAIASFSVAAAAAAALRVRRPCARACAWAPSQRPQQGALVSLKPCASLGTQAPLWRAGSECAGGGAAPAMSWASPPERIVFSDTKSRISSGTPL

SEQ ID NO: 57365 - DNA, 675 bp, Zea mays
  misc_feature: Ceres CLONE 1505213
  misc_feature: Encodes the peptide sequence at SEQ ID NO. 57366
  misc_feature (526)..(526): n is a, c, t, g, unknown, or other
  misc_feature (675)..(675): n is a, c, t, g, unknown, or other
aagctggagctccccgcggtggcggccgctctagaactagtggatcccccgggctgcaggaattcgcacgagaccattacctagaacatcctaatcgaaaactcttctccgtccacatccgtcctccagcactccacctgcatcgacgaggaacgccgtagcgatttgcgaagcgaagcgggacgggagaggaacccgaggaaggcgaaaatgatctaccgcaactggtcgctgctctcgtccacagtcgtcatttggggcggcgtcgccaccgccggcctcgccggtatcttcctcttgggcggcaaggagaaattcaatggttatctgtgccgcgaaggcgagaggcttaggcagcaggacagagccgcgatgggccgaagctaagctttagcttctttggtatctcaagggagcaatagcccttggaaatttcacaagattcctgcgtccctaccagaacaagtccctatctaggatggaatccatccttctgcaggctttcactttcctgataataacaganacaataaattgacaatggtttgtgttcttctgcaacctttttggctccctggtttcgcaagggttccgtgctttgtttggcgtcatcaaaaagaaaaaaaaaaaaaaaaaagcttatcgataccgtcgacctcgagggggggcccggtn

SEQ ID NO: 57366 - protein, 58 aa, Zea mays; identical to SEQ ID NO: 27340
  misc_feature: Ceres CLONE 1505213

SEQ ID NO: 57367 - DNA, 661 bp, Zea mays
  misc_feature: Ceres CLONE 1505224
  misc_feature: Encodes the peptide sequence at SEQ ID NO. 57368
  misc_feature (613)..(613): n is a, c, t, g, unknown, or other
  misc_feature (661)..(661): n is a, c, t, g, unknown, or other
aaagctggagctccccgcggtggcggccgctctagaactagtggatcccccgggctgcaggaattcgcacgagaccattacctagaacatcctaatcgaaaaactctgacgactctgacttcttaacctgttctgatgatttggaacctttgatagataaaaagaatgttgatgacctgggatgaagattcagaggatgatgactatgatccagcaggtcctgattcggataaagatgtcgaaaagaagtcaaattctgatgagtctgatttcatgtctgactcggatgatttttgtaaggagattaaaaaatctggtggacatgatgaagtttcatcgcctccattacccgatgtcaaggtgggtgatatggaaaagaacactgctcagtctaacacaacaagttctgctgacgaccctatggagactgaaatagaccagagtgtggttttaccagtatcaaggaggcgtcaagctgaacggttggactacaaaaggctgtatgatgaggcatatggtgaagcatcatctgattctagtgatgaagaagaatggtctgggaagaacacaccaataaaaagcaatgaagagggtgaagttggttctcctgcangaaaaggctctagagttgcgcaccataatgaactgactacacaaaacn

SEQ ID NO: 57368 - protein, 165 aa, Zea mays
  misc_feature: Ceres CLONE 1505224
  misc_feature (150)..(150): Xaa is any aa, unknown, or other
MLMTWDEDSEDDDYDPAGPDSDKDVEKKSNSDESDFMSDSDDFCKEIKKSGGHDEVSSPPLPDVKVGDMEKNTAQSNTTSSADDPMETEIDQSVVLPVSRRRQAERLDYKRLYDEAYGEASSDSSDEEEWSGKNTPIKSNEEGEVGSPAXKGSRVAHHNELTTQN

SEQ ID NO: 57369 - DNA, 674 bp, Zea mays
  misc_feature: Ceres CLONE 1505226
  misc_feature: Encodes the peptide sequence at SEQ ID NO. 57370
aaagctggagctccccgcggtggcggccgctctagaactagtggatcccccgggctgcaggaattcgcacgagaccattacctagaacatcctaatcgaaaaaccggaccaaactgcgtgctccggcctccgggagaggagagagggtagaggagttgggcgcgcagcaggatgagcggggaggaggccgacggctccaagccccagggaggcggcgtacactacggcaccttccaggggccgcccagctacccgcccccgcgcccgccgccgagcctctccgcccaccaccgcggcgactaccaggccgttcccggtaatctacaggggaacctactggtgccgttcctgggcgccgcttcaaaggcatgaagctgcaaaggagaagctagtccaggcttgcagacatctggagaaagtggtgatgatggtgtttgcgcataatggatggcgtttcttcaatcgcattaatctgtagctttttgatgtgtttgaagtccttcgtggtttccccttgtttcagtttcatgtgtgcttagctatggtgttcgtgtggatgctatttatgtagctgttggctcggaccctctacggaggagaaggccggaactatttttccattatctaaaaaagttctggagcgacggttctactgtaaaaaaaaaaaaaaaaag

SEQ ID NO: 57370 - protein, 66 aa, Zea mays
  misc_feature: Ceres CLONE 1505226
MSGEEADGSKPQGGGVHYGTFQGPPSYPPPRPPPSLSAHHRGDYQAVPGNLQGNLLVPFLGAASKA

SEQ ID NO: 57371 - DNA, 605 bp, Zea mays
  misc_feature: Ceres CLONE 1505227
  misc_feature: Encodes the peptide sequence at SEQ ID NO. 57372
caaagctggagctccccgcggtggcggccgctctagaactagtggatcccccgggctgcaggaattcgcacgagaccattacctagaacatcctaatcgaaaaacatcttacaccagccgcactcccgtgtcctcctctccgagacgagacggacgggacggcaggcaccaccgcaccggcgccaccccacccgccggctcagagcgggggcccggccacccgaatcacacagatcggaacgccggaggaggagcaacgcgggcgcggagaggcccgccagcgaaggcgcagtgcaagctctgggttcccggatccgataccaccggcctctcggcgagtgtgtaatccagcgagcgagcgctcggttttagccgtgagagcgagagatgagtgctctgaagaaatcccgacagaaagccgccctcgactttcgcgcatggagctttcatgtcaccacgtcggtcggactcatcatggtcaaacagggcgtgatggctacgtatgggatcagtttttgcaccgacataactgggcctacattttgtgacacctacttgatgactattgtatttcgatgggtaggcctgagccagcatcccactta

SEQ ID NO: 57372 - protein, 72 aa, Zea mays
  misc_feature: Ceres CLONE 1505227
MSALKKSRQKAALDFRAWSFHVTTSVGLIMVKQGVMATYGISFCTDITGPTFCDTYLMTIVFRWVGLSQHPT

SEQ ID NO: 57373 - DNA, 674 bp, Zea mays
  misc_feature: Ceres CLONE 1505230
  misc_feature: Encodes the peptide sequence at SEQ ID NO. 57374
aaagctggagctccccgcggtggcggccgctctagaactagtggatcccccgggctgcaggaattcgcacgagaccattacctagaacatcctaatcgaaaagcggaatttgcttcaccacaccttcatcagagagccgagacgacacgctcgggacccagcaaggcaagaagaacacgagagagatagcaggcaccaggcagggatcaatcatccgtccatggagaacctaaaggaggtaagtaaacctagtgatctctgcctccctggaccctctctctcttgattcctttcccgaggagctcagctcgctcggctagctaggcaccgggttcctgttcctgccgcgaggcgcgtctcacacgcggcggtcggtgcgcgcatgcagcagcggggccacgacgcggcgggcgccaacgcctggatgacggtgccggcgttcggggactgggacacgaagaacggcgcgctgccggactactccatggacttctccaagatccgcgagatgcgcaagcagaacaagaaggagctctcccgcgccagcctcggcggcgacgacgacctcctcgcccacgcccaggcccaggccctgaagccgcaggccagtaacgccccgcccaagctcggccgcccccgccccggccccgccgacgaccactccccaacgggag

SEQ ID NO: 57374 - protein, 97 aa, Zea mays
  misc_feature: Ceres CLONE 1505230
MQQRGHDAAGANAWMTVPAFGDWDTKNGALPDYSMDFSKIREMRKQNKKELSRASLGGDDDLLAHAQAQALKPQASNAPPKLGRPRPGPADDHSPTG

SEQ ID NO: 57375 - DNA, 643 bp, Zea mays
  misc_feature: Ceres CLONE 1505236
  misc_feature: Encodes the peptide sequence at SEQ ID NO. 57376
  misc_feature (149)..(149): n is a, c, t, g, unknown, or other
  misc_feature (388)..(388): n is a, c, t, g, unknown, or other
  misc_feature (393)..(393): n is a, c, t, g, unknown, or other
  misc_feature (416)..(416): n is a, c, t, g, unknown, or other
ggagctccccgcggtggcggccgctctagaatagtggatcccccgggctgcaggaattcgcacgagaccattacctagaacatcctaatcgaaaaattgcaccgtacctctggcatcgagagagctcgccagcgtccagttgtcacgcntcggctcgatcgggctctgccaactgccatggcggcggcgtccggacgggctccgtctgcttgcgcgctcctcctcttcctcctcctcgttgtgggtgccgccgccgccgccgccgtcgtcgttgatgccaaccggggggagcaggagcaggacagggactgggagcagctaagcgcggcgtcgccctcgccgtggagtcctgcgcctgcccccgcaccgtcccccgtgagcttcatanactgncggaaccccgtgcgggggcccgntgcccccctttccttcccggtgggacccttgtgcccgaagggggcgtgcggggtccctggttgggcccccccttgaaaattggctttgcccccccgggggcacccccccggggaaaaacaagaaaagttttggccccttgtgttaaccccgccctttaaacaacccgcgggggggggggcccccccccccaaggggccccctttgaaaggggagaaaaacccccggg

SEQ ID NO: 57376 - protein, 104 aa, Zea mays
  misc_feature: Ceres CLONE 1505236
  misc_feature (71)..(71): Xaa is any aa, unknown, or other
  misc_feature (72)..(72): Xaa is any aa, unknown, or other
  misc_feature (80)..(80): Xaa is any aa, unknown, or other
MAAASGRAPSACALLLFLLLVVGAAAAAAVVVDANRGEQEQDRDWEQLSAASPSPWSPAPAPAPSPVSFIXXRNPVRGPXAPLSFPVGPLCPKGACGVPGWAPP

SEQ ID NO: 57377 - DNA, 677 bp, Zea mays
  misc_feature: Ceres CLONE 1505239
  misc_feature: Encodes the peptide sequence at SEQ ID NO. 57378
  misc_feature (591)..(591): n is a, c, t, g, unknown, or other
  misc_feature (677)..(677): n is a, c, t, g, unknown, or other
aagctggagctccccgcggtggcggccgctctagaactagtggatcccccgggctgcaggaattcgcacgagaccattacctagaacatcctaatcgaaaaatcgcaacagctcaccaccaccaccatggcgctcccgccgcacatcatggcactcagcaaggtgcagcgcctctacgacgcctgcgacgtcgtcttctcctcgccgccggtggcgcccacgctcggggacatcacatggctgcagaacatcctcgatggcgtggaagcagccgacgtcgggatcgacgacggggagaagccgacgtcgtcctcgtcctcgtccgacgacgacctcctcctgccggcgccggcgttcacgcggatcacctacgtgcacatacaccagtgcgacgatttctcgattggcgttttctgcttcccggccggcgcgacgctgccgctgcacgaccacccggagatggtagtgctcagcaagctgctgtacggctccgtgcgcgtgcgctcctacgactgggtcgccgcgccgcctgataattcgccgtcgccgcccaggaggaggaaacgtggcctggccagggtggtggccgcnggacgtggtgcgccgggcgccctgcccggcgtccgtcctcttcccgcgcagcggcggcaacctgcacgcccttcaccgccgtcacn

SEQ ID NO: 57378 - protein, 183 aa, Zea mays
  misc_feature: Ceres CLONE 1505239
  misc_feature (12)..(183): Pfam Name: DUF1637 Pfam Description: Protein of unknown function (DUF1637)
  misc_feature: SWISSPROT Homolog: EC 1.13.11.19 Cysteamine dioxygenase
MALPPHIMALSKVQRLYDACDVVFSSPPVAPTLGDITWLQNILDGVEAADVGIDDGEKPTSSSSSSDDDLLLPAPAFTRITYVHIHQCDDFSIGVFCFPAGATLPLHDHPEMVVLSKLLYGSVRVRSYDWVAAPPDNSPSPPRRRKRGLARVVAAGRGAPGALPGVRPLPAQRRQPARPSPPS

SEQ ID NO: 57379 - DNA, 676 bp, Zea mays
  misc_feature: Ceres CLONE 1505252
  misc_feature: Encodes the peptide sequence at SEQ ID NO. 57380
  misc_feature (649)..(649): n is a, c, t, g, unknown, or other
aagctggagctccccgcggtggcggccgctctagaactagtggatcccccgggctgcaggaattcgcacgagaccattacctagaacatcctaatcgaaaaaagacttcactagaatctactcgtcgagtcaccaaagataaggctctatcggactcggagtctcggacagcacagcaaagcaagagccgctactcaagtatagtctctgacaccggccgaccctgccctccaacccaagccatggaggacaacaacaaccggcggaaccacgggcagaccttgctcgccggcgcgggcctgggcctgctcgccgtgaactcgggcctcgccatctaccgcgcgaggggcgacacggccgccgtcctcttcgtcgcggggtcctgcgccaccctgctcctcctcttcgcctgcctccgcgcctacgagcgggcggcgcccgggacgccggcccgggaccgggcgcgcaacgaccgtgtggacgctcgccacgctgctcacgctctcgttcgcctggaaggtggcggcggtcatgccttccgccgccgcggccgccctcgtatggagcctggccgtggccaccaccgccgggcagcttcgtggcactgtacgtgcagcacgcatgaacacgtgggcgcgggacggactangcaagcagctgcagacttgcagttcgt

SEQ ID NO: 57380 - protein, 144 aa, Zea mays
  misc_feature: Ceres CLONE 1505252
  misc_feature (136)..(136): Xaa is any aa, unknown, or other
MEDNNNRRNHGQTLLAGAGLGLLAVNSGLAIYRARGDTAAVLFVAGSCATLLLLFACLRAYERAAPGTPARDRARNDRVDARHAAHALVRLEGGGGHAFRRRGRPRMEPGRGHHRRAASWHCTCSTHEHVGAGRTXQAAADLQF

SEQ ID NO: 57381 - DNA, 663 bp, Zea mays
  misc_feature: Ceres CLONE 1505255
  misc_feature: Translation starting site: 225
  misc_feature: SWISSPROT Homolog: EC 3.6.3.14 H(+)-transporting two-sector ATPase
  misc_feature (389)..(389): n is a, c, t, g, unknown, or other
aagctggagctccccgcggtggcggccgctctagaactagtggatcccccgggctgcaggaattcgcacgagaccattacctagaacatcctaatcgaaaagtcactgctcgaaatcgatccgatctccgctcgcgctgaagcctgatctccaccgggttcgcagcaggggcgcaggacctcgatcacgaggaggcaggggagcagcatccacaaccacaagccatggcggggagggccaacatccccactaacaactccgccctcatcgcaatcatcgccgacgaggacaccgtcactggcttcttgatggccggcgttggcaatgttgatctgcgcaagaaaaccaactacctcctcttcccccccacacgaggggggggggggtcnaggattctttcaaaaaatttactaccagggaggatattgctattgggctcatcagtccagataatgcccacatgacaaggtttctggtgggaaagctaccacaaacccctccccctgcttttcgggaaatccccctcaaggaccccccctaaagacccaacccgccgaactcgggggcttcctttaagggaaaaaagccggtatcctggcacaaacccgcggaggggccggcataagaagagcaaaaagaatcccccggcgttatcaaaacccg

SEQ ID NO: 57382 - DNA, 645 bp, Zea mays
  misc_feature: Ceres CLONE 1505257
  misc_feature: Translation starting site: 194
  misc_feature: SWISSPROT Homolog: EC 2.1.1.104 Caffeoyl-CoA O-methyltransferase
aaagctggagctccccgcggtggcggccgctctagaactagtggatcccccgggctgcaggaattcgcacgagaccattacctagaacatcctaatcgaaaaaacctcgttctacccaccagccaccagccggcacaaattctcccttcccacaagaacatcacacggcgatagcaaaaccttccgtcggaggatggcttccgccggcgctggagaagggaaggagacggctgccgggagcagcctccacagcaagactctcctcaagagccaaccactgtaccagtacatactggaatccaccgtcttcccacgcgagccggactgcctgcgggagctccgcgtcgccaccgccacccaccccatggcgggcatggctgcgtcgccggacgaggtgcagctgctgcagctcctgatcgagattcttggcgccaagaacgccatcgaggttggcgtcttcaccgggtactcgctgctcgccaccgccctcgccctccccgacgacggcaagattgtggccatcgacgttacccgcgagagctacgaccagatagggtcgccggtgatcgagaaggccggcgtggcgcacaagatcgacttccgcgtcgggctcgcgctgcccgtgctggaccagatggtggccga

SEQ ID NO: 57383 - DNA, 672 bp, Zea mays
  misc_feature: Ceres CLONE 1505259
  misc_feature: Translation starting site: 340
  misc_feature: Pfam Name: Ribosomal_L37e Pfam Description: Ribosomal protein L37e
aagctggagctccccgcggtggcggccgctctagaactagtggatcccccgggctgcaggaattcgcacgagaccattacctagaacatcctaatcgaaaacacgccgtgactcctctcaacccgaccacgccgcgcctccgcttcgaagcctagcctaccgggggaaggagggaaagggggaagggcacggggaacttcggtaagcgccggaacaaaacgaacacgctgtgcatcgggtgcggccgccgcaacttccatctccagaagagaattctgctcctcctgcggctaccccggcgtccgtatccgcaagaataattggagtgtgaaggccatcatgcacaagaccactggtacaggaaggatgaggtacatgctacacgtgactcgacgtatcacgaccatcttcttagaacggactgaggctgccccagagaagagtgcggctgctgccgactaagtgtctatgttgccatctagaacctcataatctacacattggatcttattactgaattgcactgctgagctatgtgcacgtagtactatccagtgctggctcaccgtgggctgaattgtagcctcactcaatcttctttgggagcgggattaagaagaacactagaaaacggatctataccatctagcatgaggggagtccggtacccaa

SEQ ID NO: 57384 - DNA, 661 bp, Zea mays
  misc_feature: Ceres CLONE 1505334
  misc_feature: Encodes the peptide sequence at SEQ ID NO. 57385
  misc_feature (185)..(185): n is a, c, t, g, unknown, or other
  misc_feature (187)..(187): n is a, c, t, g, unknown, or other
  misc_feature (200)..(200): n is a, c, t, g, unknown, or other
  misc_feature (201)..(201): n is a, c, t, g, unknown, or other
  misc_feature (203)..(203): n is a, c, t, g, unknown, or other
  misc_feature (206)..(206): n is a, c, t, g, unknown, or other
  misc_feature (207)..(207): n is a, c, t, g, unknown, or other
  misc_feature (210)..(210): n is a, c, t, g, unknown, or other
  misc_feature (214)..(214): n is a, c, t, g, unknown, or other
  misc_feature (218)..(218): n is a, c, t, g, unknown, or other
  misc_feature (219)..(219): n is a, c, t, g, unknown, or other
  misc_feature (220)..(220): n is a, c, t, g, unknown, or other
  misc_feature (221)..(221): n is a, c, t, g, unknown, or other
  misc_feature (225)..(225): n is a, c, t, g, unknown, or other
  misc_feature (227)..(227): n is a, c, t, g, unknown, or other
  misc_feature (228)..(228): n is a, c, t, g, unknown, or other
  misc_feature (230)..(230): n is a, c, t, g, unknown, or other
  misc_feature (293)..(293): n is a, c, t, g, unknown, or other
aagctggagctccccgcggtggcggccgctctagaactagtggatcccccgggctgcaggaattcgcacgagaccattacctagaacatcctaatcgaaaaaggaaggaacaacgcagacaaaccgaactcgcacctcgcacctcgcatcgtcttgtcgacacacctccagctccgaaaccctantncgccggggatgtnntnatnnggngccncggnnnngggngnngnaatggccgttgacgacgccgcccgcccccccgcctcgccgccatgtccacggaggatatgatnagggaatgccgccttcttgacaacgagatccgtgtgctcaaggatgagttgtattggacgaacctccagttggagtcattcaaggagaagattaaggaaaaccaagagaaaattaagctcaataaacaccccccctgcctcggtggcaacatcgctgagatcttggaaatgaaccctgacgatgaagctgaggaggatggtgctaacactgatttagactcccacaggacaggaaaatgggttggtccgaagacctccacgagacaaactatattccttcctgttcgttgggctcgtggaccctggacaacttaaccctgggggatctgcctcgcagtaaataaaaatacctcccttatcccaaaccc

SEQ ID NO: 57385 - protein, 111 aa, Zea mays
  misc_feature: Ceres CLONE 1505334
  misc_feature (7)..(7): Xaa is any aa, unknown, or other
MSTEDMXRECRLLDNEIRVLKDELYWTNLQLESFKEKIKENQEKIKLNKHPPCLGGNIAEILEMNPDDEAEEDGANTDLDSHRTGKWVGPKTSTRQTIFLPVRWARGPWTT

SEQ ID NO: 57386 - DNA, 683 bp, Zea mays
  misc_feature: Ceres CLONE 1505337
  misc_feature (221)..(221): n is a, c, t, g, unknown, or other
  misc_feature (222)..(222): n is a, c, t, g, unknown, or other
  misc_feature (223)..(223): n is a, c, t, g, unknown, or other
  misc_feature (224)..(224): n is a, c, t, g, unknown, or other
  misc_feature (225)..(225): n is a, c, t, g, unknown, or other
  misc_feature (226)..(226): n is a, c, t, g, unknown, or other
  misc_feature (227)..(227): n is a, c, t, g, unknown, or other
  misc_feature (256)..(256): n is a, c, t, g, unknown, or other
aagctggagctccccgcggtggcggccgctctagaactagtggatcccccgggctgcaggaattcgcacgagaccattacctagaacatcctaatgaggtggagagatcgcacgcgccctctgccgcttgttcgttcctcgcgcttgccaccaggcaccaccacacacatcccaatctcgcgaggcggcgagggcaagcacagggggtcctggcggcggcnnnnnnncttccggctccccttcccattggcctccncgatggcgctccgcctcggcgacgactcgctctgcctctccccgcaggtcgtcgcccgtcgacctctccggagctgagctaggatagtccgtatctgctccattgacctgggaattctcatactcgtgcagaagatagcgcattttgttcatctagggaagatatgctccccgagatcaggcctgtctttcttccgaattgagcgctccgtatcgccagatgggtggagactcagagcctctttcgacggaccatacggtccactctaagggggatggcctccatgggagggttcccctttttaatggcatcttccagaatggtgcgagagccctaaggggcgacctccgaccgggacaatctgggagccctaaggaatcctaaccgagcacaccgacggaccttggtgggtcaaccaggccaaata

SEQ ID NO: 57387 - DNA, 494 bp, Zea mays
  misc_feature: Ceres CLONE 1505338
  misc_feature: Encodes the peptide sequence at SEQ ID NO. 57388
  misc_feature (322)..(322): n is a, c, t, g, unknown, or other
aagctggagctccccgcggtggcggccgctctagaactagtggatcccccgggctgcaggaattcgcacgagaccattacctagaacatcctaatcgaaaaagaacacttgagcagactagcaaggccttcagaccgggagggctccctgtcctgtcccccgcgccgccgcggatggccggagccaccacgccggcatcaggcgccctcgtcaggctctgcctgccttcgctcctcctctttctgtaccggtgctgcagatgtgaggctgttgagatggagagaacccttgcgatgatcaagcccgatggtttgtccggtanttccccgaagccatccagggggcctccttggatcgggatttcatatccccaaaaaaacccaagccccctttatgctaaaaaggatttgttttttttcggagattccccaagaaacttttttaaaccccaaacaaaaaaaaaaaagggggccccttttgcttttgttttggac

SEQ ID NO: 57388 - protein, 107 aa, Zea mays
  misc_feature: Ceres CLONE 1505338
  misc_feature (50)..(50): Xaa is any aa, unknown, or other
MAGATTPASGALVRLCLPSLLLFLYRCCRCEAVEMERTLAMIKPDGLSGXSPKPSRGPPWIGISYPQKNPSPLYAKKDLFFFGDSPRNFFKPQTKKKKGAPFAFVLD

SEQ ID NO: 57389 - DNA, 657 bp, Zea mays
  misc_feature: Ceres CLONE 1505343
  misc_feature: Encodes the peptide sequence at SEQ ID NO. 57390
  misc_feature (396)..(396): n is a, c, t, g, unknown, or other
  misc_feature (411)..(411): n is a, c, t, g, unknown, or other
  misc_feature (413)..(413): n is a, c, t, g, unknown, or other
  misc_feature (414)..(414): n is a, c, t, g, unknown, or other
tccccgcggtggcggccgctctagaactagtggatcccccgggctgcaggaattcgcacgagaccattacctagaacatcctaatcgaaaaattcccgtcacgcccccaacacccccacaacccgaagcagcgaaagctcccctaaccctctccgcgcatccgatcgcaaggaagaagagggagatgagctactacgggcagcagccccccgtcggcgtcccgccgcagcaaggctacccgggcaaggacggctacccgccagcggggtacccgccggccggctaccccccgccggcgcagggctaccctccgcagggctacccgccgcagtacgcgcagccgccgccctcacagcagcagcagagcagcggggcttccttcatggagggatgctnggctgccctctgctncnnctgcctcctggacgcctgcttctgagagtgagaggggccgaccgacggattcgacacgggacaagtgaaactactagctttccatgccagggaaaaaaaaaaaaaaactggaactgggtttggccctggaaaggcattcgggctattcaagcttttggaaaaaaaaaatggcccccccagtttttttttttcccccgcacaggttaacgggatcaaaggggggggtgtgattccccgggggag

SEQ ID NO: 57390 - protein, 84 aa, Zea mays
  misc_feature: Ceres CLONE 1505343
  misc_feature (71)..(71): Xaa is any aa, unknown, or other
  misc_feature (76)..(76): Xaa is any aa, unknown, or other
  misc_feature (77)..(77): Xaa is any aa, unknown, or other
MSYYGQQPPVGVPPQQGYPGKDGYPPAGYPPAGYPPPAQGYPPQGYPPQYAQPPPSQQQQSSGASFMEGCXAALCXXCLLDACF

SEQ ID NO: 57391 - DNA, 650 bp, Zea mays
  misc_feature: Ceres CLONE 1505345
  misc_feature: SWISSPROT Homolog: EC 2.5.1.18 Glutathione transferase
aagctggagctccccgcggtggcggccgctctagaactagtggatcccccgggctgcaggaattcgcacgagaccattacctagaacatcctaatcgaaaaaagggtctcgcctatcgatatgtgaaggacaatttgcactgcaggagcgagctcctcctggcctccgaacacgtggacgggaaggtgggtgtgctcgtccacgatggcagggccgtatgcgagtctcgggtgatcgtggagtatatcgactaggccttcccggccagcggcccgtgcctcgtctatgcagatccttaccgctccgaggtcgaccagcttctgggctctattaagtcgactgactagctcttttgcacctggatacctgtactacaaaggtaggacgagcgaggacaggatctgcgtctgatactcatgtagtgaccctgttggagaactttgagctggctatccatcagtgttccggaggtaagatgttcttcaactgtgacgctgatggcttcatggacgtcgtgataggagttttcctcgggtagctgctcgcgtctgagatgatctgagtgaacaggtcatcgacgctacaaaagacgttgctgaggattgggcgaacagttttacgctcttaagtgtctgcaggtaatccggacc

SEQ ID NO: 57392 - DNA, 666 bp, Zea mays
  misc_feature: Ceres CLONE 1505349
  misc_feature: Encodes the peptide sequence at SEQ ID NO. 57393
aagctggagctccccgcggtggcggccgctctagaactagtggatcccccgggctgcaggaattcgcacgagaccattacctagaacatcctaatcgaaaagataaaccacagagccaccccactaactactttcaccattgtttccagaaaaatctccgcgcataatatttctctagagcaaacgctctgtcatcacacaacactagttcgtccgcacgacactcccgcagttcctcgacaggggagaggtttccattccaggcggttgcggttgcggttggcggcggagatgagccgggggagcaagctccggtggctgtggcgcgcgccggcgcgggcgctggggcgggcgcgggacctgtacgtgcgggggctgacggggtgcgcgcgccacgtcccctccgacgccgcgttcgggtaccccgtgttcgtgccggcgccgctgtccaggagccacagcgccgtcggctggggcgccgggtcgtccgaggccgacgaggacctgcgcgaagtggtccgcgccgcgtcgcagcgccgcgtggagcaacgccgcgccgagctgcaggccgtggcccggaccagagcatggccgcctcgctctccatggcgcgcatcgacgaagacgcgccctgcgacttcggggcgccgggggcgctgtgcccca

SEQ ID NO: 57393 - protein, 125 aa, Zea mays
  misc_feature: Ceres CLONE 1505349
MSRGSKLRWLWRAPARALGRARDLYVRGLTGCARHVPSDAAFGYPVFVPAPLSRSHSAVGWGAGSSEADEDLREVVRAASQRRVEQRRAELQAVARTRAWPPRSPWRASTKTRPATSGRRGRCAP

SEQ ID NO: 57394 - DNA, 660 bp, Zea mays
  misc_feature: Ceres CLONE 1505351
  misc_feature: Encodes the peptide sequence at SEQ ID NO. 57395
  misc_feature (628)..(628): n is a, c, t, g, unknown, or other
aaactggagctccccgcggtggcggccgctctagaactagtggatcccccgggctgcaggaattcgcacgagaccattacctagaacatcctaatcgaaaaatccctcgtcgcagcaaccgtcctcgctccctgcctccctcagttccgctcttcgtctttgggggccattgcccgtgcgtcacccgagcccgtgcccggaatctttgtagaagcgtctggaggactcccacccggctgccagccatggctgagaatctggcgcccgagaagcgccactccttcgtgcacaacgggcagaaggtgttcgagtgggaccagacgctggaggaggtcaacatgtacatcgagctcccgaagggtgtgccaaccaagctatttcactgcaacatccaggctagccacgttgaggtcggcatccgcggcaacccgccatacctcaaccatgacctgacacacccagtgaagactgactcgtcgttctggacaatagaagatggtgagatgcatatcacactgcaaaaaagagagaaggggaaaacatggtcatctccaatacaagggcaagggattttggatccatatgctgcagatcaggagcaaaagcggcttatgctcaaaaggtttcnggaagaggctcagttcagtgggaccctgcctg

SEQ ID NO: 57395 - protein, 138 aa, Zea mays
  misc_feature: Ceres CLONE 1505351
  misc_feature (19)..(93): Pfam Name: CS Pfam Description: CS domain
  misc_feature (128)..(128): Xaa is any aa, unknown, or other
MAENLAPEKRHSFVHNGQKVFEWDQTLEEVNMYIELPKGVPTKLFHCNIQASHVEVGIRGNPPYLNHDLTHPVKTDSSFWTIEDGEMHITLQKREKGKTWSSPIQGQGILDPYAADQEQKRLMLKRFXEEAQFSGTLP

SEQ ID NO: 57396 - DNA, 577 bp, Zea mays
  misc_feature: Ceres CLONE 1505378
  misc_feature: Encodes the peptide sequence at SEQ ID NO. 57397
aaagctggagctccccgcggtggcggccgctctagaactagtggatcccccgggctgcaggaattcgcacgagaccattacctagaacatcctaatcgaaaaagcgcagcgccctctcttagccgactcccaagtcccaactagcccctcacgcgctcatcggcgccctgtcgagtcgagcccgcatctcggccgatcgagagcgagcgcagccgcgcgccggtgagagctttgcttgctttcggtggtctgcaacgacttaacgaacgtcggcaggcggtagataaaggcgcgcgatgtgcgacgcggcgccgaaggtacagggggcgtgcgggaaagcggccgtgggggccggggttcgcggcggaagatccggggacccccggcgaagcgcggcggcgccgtctgggcttcgggcccctttcgaacttcggcccaaagggccgccggggcccgcgcccttaaaaaacggggggcccccgccggggggcccctgggggcgggggcccccccctttcccccagggggaaacaaaaattttttccccccggggggttttaaaaaaaaacaaaacttc

SEQ ID NO: 57397 - protein, 93 aa, Zea mays
  misc_feature: Ceres CLONE 1505378
MCDAAPKVQGACGKAAVGAGVRGGRSGDPRRSAAAPSGLRAPFELRPKGPPGPAPLKNGGPPPGGPWGRGPPPFPQGETKIFSPRGVLKKNKT

SEQ ID NO: 57398 - DNA, 653 bp, Zea mays
  misc_feature: Ceres CLONE 1505394
  misc_feature: Encodes the peptide sequence at SEQ ID NO. 57399
aagctggagctccccgcggtggcggccgctctataactagtggatcccccgggctgcaggaattcgcacgagaccattacctagaacatcctaatcgaaaacccggcaggcacggtcggtcaatccagcaatacccgacgcgcaagccagtgccgcacccagaccagatctccgcgacatatcagtcgttcgtccagctaactgcactgcactgcactgcacgcaatggccaccacggcgaccgaggcggccaaggctgcaccggcgcaggagcagcaggccaacggcaacggcaacggcgagcagaagacgcgccactccgaggtcggccacaagagcctgctcaagagcgacgacctgtaccagtacatcctggacacgagcgtgtacccgcgggagccggagagcatgaaggagctgcgcgagatcaccgccaagcacccatggaacctgatgaccacctccgccgacgagggccagttcctcaacatgctcatcaagctcatcggcgccaagaagaccatggagatcggcgtctacaccggctactcgctcctcgccaccgcgctcgcactcccggaggacggcacgatcttggccatggacatcaaccgcgagaactacgagctaggccttccctgcatcaacaaggc

SEQ ID NO: 57399 - protein, 142 aa, Zea mays
  misc_feature: Ceres CLONE 1505394
  misc_feature (50)..(142): Pfam Name: Methyltransf_3 Pfam Description: O-methyltransferase
  misc_feature: SWISSPROT Homolog: EC 2.1.1.104 Caffeoyl-CoA O-methyltransferase
MATTATEAAKAAPAQEQQANGNGNGEQKTRHSEVGHKSLLKSDDLYQYILDTSVYPREPESMKELREITAKHPWNLMTTSADEGQFLNMLIKLIGAKKTMEIGVYTGYSLLATALALPEDGTILAMDINRENYELGLPCINK

SEQ ID NO: 57400 - DNA, 667 bp, Zea mays
  misc_feature: Ceres CLONE 1505399
  misc_feature: Encodes the peptide sequence at SEQ ID NO. 57401
aagctggagctccccgcggtggcggccgctctagaactagtggatcccccgggctgcaggaattcgcacgagaccattacctagaacatcctaatcgaaaacccgacgagcagccgcccccaggtgtagggttccccctttcctcttctccacgcgaatcagctagatactagaaccagcatcgatggcggctgcagcgcccgcagacgcaaaggcagaggccgccaaaatggacctcctcgaggacgacgaccagttcgaggagttccagatcgaccaagaatgggatgacaaggaagatggcaactaagctgtccagcaatgggaggatgactgggatgatgacgacgtgaacgatgatttctcactgcagctgacgaaagagcgggagggaggcaacactcggaagagctgaactacttcgatcaggcactgtgtggccattgctctctgaacctgtgatacttccctagcaatatcaagctctgatacttatcttcgtatcagcactgtgtatcagactttgtacattactgcatgtacttatcggctgcgagcagcataacttgccgaacgatgatagttcgcagagagtatcgcacttacccgaaagacaaaaaaaaagcttatctataccgtctacctcgagggggggcgcggtacccaa

SEQ ID NO: 57401 - protein, 41 aa, Zea mays
  misc_feature: Ceres CLONE 1505399
MAAAAPADAKAEAAKMDLLEDDDQFEEFQIDQEWDDKEDGN

SEQ ID NO: 57402 - DNA, 725 bp, Zea mays
  misc_feature: Ceres CLONE 1505427
  misc_feature: Encodes the peptide sequence at SEQ ID NO. 57403
  misc_feature (366)..(366): n is a, c, t, g, unknown, or other
  misc_feature (368)..(368): n is a, c, t, g, unknown, or other
  misc_feature (376)..(376): n is a, c, t, g, unknown, or other
tccccgcggtggcggccgctctagaactagtggatcccccgggctgcaggaattcgcacgagaccattacctagaacatcctaatcgaaaattaccacatagccgccgccgcaaccgtagagcctcggctcactactcccctctcccgggagcatccaccccccgcctagcggcgcgaagcgaccatgacgttcaagcggaggaacggcgggcgcatcaagcatgggcgctgccacgtcgtgtacatccactgctccaactgcaccaagtgctgccccaaggacaaggctgtcaagagtatggtggcgatcaacatccacgaagccgactcctgtcagcaggatgtgcaggagagcttggagcaanangaataaancactccccagggtcaaaccccaacgtagctccgctgccgacccctacgaccagcgacgaacaaggtggttgctgggtccgcctcgcgttgaagaacaaggagtgaacgcgcgacgcccgcgggaaaggtggttcaggcgccaagggatgataagaaccgaagggcgcggacagggatggcggccacacccatggctggggcctacgttggtgggggaaaaaaggggggcgggggaaggcctcccaggggggaaggaggtttccccggggtgcaaattggggggagaggttcgcgcggggttctaaatccagcccccaagggtttacttcgagccccgggaattttgggg

SEQ ID NO: 57403 - protein, 62 aa, Zea mays
  misc_feature: Ceres CLONE 1505427
  misc_feature (61)..(61): Xaa is any aa, unknown, or other
MTFKRRNGGRIKHGRCHVVYIHCSNCTKCCPKDKAVKSMVAINIHEADSCQQDVQESLEQXE

SEQ ID NO: 57404 - DNA, 643 bp, Zea mays
  misc_feature: Ceres CLONE 1505430
  misc_feature: Encodes the peptide sequence at SEQ ID NO. 57405
tcccccgggctgcaggaattcgcacgagaccattacctagaacatcctaatcgaaaaaagcttctttaaattctgctgccattctgctaccgtgggcgtcgtacagccccgttcccatagaggacagtctgctgtctgccggaagcctagcttcgtccaccactgaatcaagaaacagaacaactagatatggacgaccgcacctacaagggcggcatcaaggcgtactggaaacgccgggactactaccagcatggacagagacgcctcgaggggccgccagtcgctccccaccgtggagctcttaagtggcgtctcccaagcccagggacaggcccatccaccaggcgggagatggctacaggccagttgcgtgggtgccgcgtgtggcgcgtgcgccctcgaacagatggggatgggggtagctccagtcgttgggccctaggaggggtgggtcatgcaagttgcagggagggctatatggatcgacatggctgtaagtgtggctccttcccgtggcagtccgattcattgatctttggtgcaccctattggtgtccttcagccaacctattgtccccagtcatgcgacattctttctattcccgtcgtctcggccacacttttgggaattattaacgag

SEQ ID NO: 57405 - protein, 63 aa, Zea mays
  misc_feature: Ceres CLONE 1505430
MDRDASRGRQSLPTVELLSGVSQAQGQAHPPGGRWLQASCVGAACGACALEQMGMGVAPVVGP

SEQ ID NO: 57406 - DNA, 673 bp, Zea mays
  misc_feature: Ceres CLONE 1505435
atagctggagctccccgcggtggcggccgctctagaactagtggatcccccgggctgcaggaattcgcacgagaccattacctagaacatcctaatcgaaaaacgacgctgccgccacctatctcaacgaagctttttcttccctccggtgtggatccacactcttcatgcgctggttcgtgttttggatcttcccttgcgttttccttatttgcggtgttctctttttgaccggggatttgggatccgtctttggttgaggacgatgaagattgtatctataggtctcgttcgtcgtaactggcatctgattggattgccttgccgaccatcctgatatatcaccacccatattccgagtccgctgcctacagtcctcagtccccatcgagattttcttatctatttagcctttcccccatgatttactactattgttttctgggcgatgattaaatcaaaataatagacaagcatatgtccgaatccatctatgtggataagcctaatcttctctatgaggtcgaccgcatcttctaggtttactgtttttttttcatttgatcttattttgattcatccaggggcctaagacgaaatatatggatgccattttttggatggaaaatgttgattacaaaaccatttctgcctttccttctgaaggcccctt

SEQ ID NO: 57407 - DNA, 549 bp, Zea mays
  misc_feature: Ceres CLONE 1505436
  misc_feature: Encodes the peptide sequence at SEQ ID NO. 57408
  misc_feature (243)..(243): n is a, c, t, g, unknown, or other
aaagctggagctccccgcggtggcggccgctctagaactagtggatcccccgggctgcaggaattcgcacgagaccattacctagaacatcctaatcgaaaaaaccgctacatttccgtcactaccggagccgccactcccacgaacgcgggcggcggagcggaagcgaaccagttatctagtggagttgcctccttcaagctactctaatgtccttttctattcaaggtctagccatgggcngggccccacctggaaaaaaatccccattccccccggaaagaaaaccggccgggggaaaaaaaaataaaaatgggaatttttcccccccagggggggcctcttggggggaaaaaaacccctctttttaagggggggggcccttttttaaaaaaaacctcccccccttttttaaaaaaaaaggcccccccccttttataaaagggaaaaaatttttttttttttttcaaaaaaaaaaaaagagaaaaaaccccgggggaaaattgggggcggccacaaaaaaaaaacctctttttttaaaaaaataat

SEQ ID NO: 57408 - protein, 53 aa, Zea mays
  misc_feature: Ceres CLONE 1505436
  misc_feature (12)..(12): Xaa is any aa, unknown, or other
MSFSIQGLAMGXAPPGKKSPFPPERKPAGGKKNKNGNFSPPGGASWGEKNPSF

SEQ ID NO: 57409 - DNA, 770 bp, Zea mays
  misc_feature: Ceres CLONE 1505442
caagctggagctcaccgcggtggcggccgctctagaactagtggatcccccgggctgcaggaattcgcacgagaccattacctagaacatcctaatcgaaaaaaggaaacagtcacgtctcccagatctaactccccccgactcacgaatcccagagagcctccatggcgacgcaccgccactgcctcccactcctcctcgtggccgccgccctcgccctcgccgccgtccctgctcgcgtggcccctgggtggcgggcgcggaccggtggtagggcaggcggaacccccacccccgacttgagctactccgccgcgccgcggggcgtggcggggagctcacatggggcagagtgattctccagcaaacaccgccaaccgactctctccccgggtcccccctcgatatcacgccccccacactaaatggtacccggggctgggtgggacccacccccgcgctggggtggaggcgctgtcggagcgagtatcgggttgatcgtgcggggccgccgcgcgaccctccggtgttgctgactctctgctcggctaaccagcagggggcgggcgcgggtgcggtaggataaagcggcgtgggggtgctgtcgtgtcgtcgttataaggggggggtgggcgcgggctgtgaggggcgctgccgggccgggggtctacccgcatgcgttgcaccatacgagtgtgtgcgtcggcctcaccgatcgccctcctctgacagagggcggtgcgcggggcgaacttcacatacacgaaggg

SEQ ID NO: 57410 - DNA, 776 bp, Zea mays
  misc_feature: Ceres CLONE 1505467
  misc_feature (1)..(1): n is a, c, t, g, unknown, or other
  misc_feature (12)..(12): n is a, c, t, g, unknown, or other
  misc_feature (13)..(13): n is a, c, t, g, unknown, or other
  misc_feature (43)..(43): n is a, c, t, g, unknown, or other
  misc_feature (45)..(45): n is a, c, t, g, unknown, or other
  misc_feature (54)..(54): n is a, c, t, g, unknown, or other
natttttggtgnncccccccggcgagtgtggtggggccggggngngggaggtgncccaaaactggagctccccgcggtggcggccgctctagaatagtggatcccccgggctgcaggaattcgcacgagaccattacctagaacatcctgatcgaaaaagacaccggcagtcggtagtagcaacccgcatcacgaggtcaccgacgcctccccgcacaggcacagctcactagcaaccagcgagttcataccagaggcaacgagaacgaacgccaccaccgcgctccggtcgctttgcttgggtcgggactctgcaccgccattgatgatctgatctccttctccttggaggagaaacaagaggggagaggaatgatggggcggacgagcgtggcagcggcctcggctgcggtcggcccacggaccgggatgggtatgttggtgactcataaaacaccccccaggggagttttccccccgggcgggttgtgctgggttgttgggccgctccatccttctctaagcccggccacacaccacgggcggggcgctcccgggacgttcaaggggaaacaacggggggaaggatgtacaacgggttatcctggcgcaggcggcctacctgaggcggaaatagatgggtgcgaggcccgcggctccgtccatcttgggtggcgcgggctaagactaacacatcatccgaggggccaaaaggggaatggggcacgaaaatgtgggcgccaggccacacgtattcggcgcccgctggtacaaac

SEQ ID NO: 57411 - DNA, 665 bp, Zea mays
  misc_feature: Ceres CLONE 1505471
  misc_feature: Encodes the peptide sequence at SEQ ID NO. 57412
aaagctggagctccccgcggtggcggccgctctagaactagtggatcccccgggctgcaggaattcgcacgagaccattacctagaacatcctaatcgaaaatcctcacctggcatccagagaggaagggaagggaggaactcggggcacacagcacagggggtcgtccggaatttcctctgcttccgcttaccgccgaaacctctgtcttgaaggaagaatccgttcctctgcttgatctgtattcttatagtggagaagagaagccgaggacgattaatagagctggaaggtgaattgacgcttagtatttgaagctcgtcgccaaatggagaaagaggcgaggaaccactaccgcacgcggggatcctcgcgcggcagcggcggcggaggcaccgctgccgagcgcgacctgctgttacagtggggcaaccggaagcgcctgcgctgtgtcaaggtgcagcgccgcgacgtcgaggccgccgccaccgcggccgccgagaaggccgccatcagccagcgccgcgccgcggccgcagccgcagccgcgcagcaccacccaaccggccacacccaccaccgcgttctcaggaagtcagaagagtttgcaatcatgaaattgccagcacggcaacgacagaatgacaggatccacacagttgctt

SEQ ID NO: 57412 - protein, 112 aa, Zea mays
  misc_feature: Ceres CLONE 1505471
MEKEARNHYRTRGSSRGSGGGGTAAERDLLLQWGNRKRLRCVKVQRRDVEAAATAAAEKAAISQRRAAAAAAAAQHHPTGHTHHRVLRKSEEFAIMKLPARQRQNDRIHTVA

SEQ ID NO: 57413 - DNA, 620 bp, Zea mays
  misc_feature: Ceres CLONE 1505473
  misc_feature: Encodes the peptide sequence at SEQ ID NO. 57414
tcccccgggctgcaggaattcgcacgagaccattacctagaacatcctaatcgaaaacggcgtcggcgcccacagggaggaggtcgccgacgagaggagctggagcgacctcgccttctgcaggaagttcaagctgtggcacgccctggccaagacgctgtcggagaagacggcgtgggcgctggccatggacaggggcgtcgacatggtggccatcaacgccggcctgctgctggccgcccccgggctcgggctcaccgccgcgcacccctacctaaagggcgcccccgacatgtacgacggcggcgtcctcgctaccgtcgacgtcggcttcctggccgacgcgcacgtcgccgcctacgagtcccccaccccccacagccgctacctctgcttcagcaacgccgtctgccgtcccgaggacgccgtcaagctcgcccagatgctctcgccggccgcgccacgctcggcgccgcccagcgacgaactgaaggtgataccacagaggatccagggcaagaagctcaaccagctcttgctggagttcgccagcgggggaatacgggggagctggactagggaaggaactgccgttgcctggccacagatgatgccaatgg

SEQ ID NO: 57414 - protein, 144 aa, Zea mays
  misc_feature: Ceres CLONE 1505473
MDRGVDMVAINAGLLLAAPGLGLTAAHPYLKGAPDMYDGGVLATVDVGFLADAHVAAYESPTPHSRYLCFSNAVCRPEDAVKLAQMLSPAAPRSAPPSDELKVIPQRIQGKKLNQLLLEFASGGIRGSWTREGTAVAWPQMMPM

SEQ ID NO: 57415 - DNA, 583 bp, Zea mays
  misc_feature: Ceres CLONE 1505474
  misc_feature: Encodes the peptide sequence at SEQ ID NO. 57416
  misc_feature (477)..(477): n is a, c, t, g, unknown, or other
aaagctggagctccccgcggtggcggccgctctagaactagtggatcccccgggctgcaggaattcgcacgagaccattacctagaacatcctaatcgaaaattttcccatccttcacttcgcccaatttttctcccatccctgcccctcctctcgcgattctgccattttgtcccccgctcaccaacctaaatcgagagaattcgatatttgccatcatcaccaaacacgatagtaaaaatgtcacagaagtggcaaaattccaattattatttcacctaaaaccctctgctctcaaacctagctcgctcccggcggaccgacgatgccgaaggcagtcggcggggcggcggacgaagaggagttccgcgccgaggtggaggagcgcctcatcaacgaggagtacaagatctggaagaagaacacacccttcctctacgacctcgtcatcacccacgcgctcgaatggccctcccnttacgtgcagtggctccccgaccgcacgagccgcgggggaaagaccactccgtccagagatgatcctcgggacgcacacctctgaacacgagccaactacctcatg

SEQ ID NO: 57416 - protein, 78 aa, Zea mays
  misc_feature: Ceres CLONE 1505474
  misc_feature: SWISSPROT Homolog: EC 2.3.1.48 Histone acetyltransferase
  misc_feature (51)..(51): Xaa is any aa, unknown, or other
MPKAVGGAADEEEFRAEVEERLINEEYKIWKKNTPFLYDLVITHALEWPSXYVQWLPDRTSRGGKTTPSRDDPRDAHL

SEQ ID NO: 57417 - DNA, 657 bp, Zea mays
  misc_feature: Ceres CLONE 1505475
  misc_feature: Encodes the peptide sequence at SEQ ID NO. 57418
atagctggagctccccgcggtggcggccgctctagaactagtggatcccccgggctgcaggaattcgcacgagaccattacctagaacatcctaatcgaaaattttccgtttccaccccgcctcgctaccttggcggtttccacccgcacccggctcgcctcctatggcctttgcctccccacgcggcccgccggcatgcctcctctcgccgagcacgagctcgcggccgcggccgccacctccgcgctcggcgtagccttcggggtgcgcctgctcgtcgccctctcccgctcccgcgcgctcaagccgctggcggccgccacgtccgccgccgccgccgcgctccggacgccgcgggcgctcgccaccgcctcctcccctgtcgccgccatcctagccgcgtccaaagccgcctccaagtcgtacaaagcggcacgcacgctcggccccgccgccgcgcgcctcccctcgctcccctcctccaagcgcctcaaggccgcgctcgccgccgcctcgctcctccgcctcgccgccgccgcgccggcgggcctccacgccgcgtcgcccgcgggcgtcgccgtgctcgccgtcctcaagtccagctacaagctctccaagaacacctccaaggtcgtcgagggcttcctcggcctcca

SEQ ID NO: 57418 - protein, 153 aa, Zea mays
  misc_feature: Ceres CLONE 1505475
MPPLAEHELAAAAATSALGVAFGVRLLVALSRSRALKPLAAATSAAAAALRTPRALATASSPVAAILAASKAASKSYKAARTLGPAAARLPSLPSSKRLKAALAAASLLRLAAAAPAGLHAASPAGVAVLAVLKSSYKLSKNTSKVVEGFLGL

SEQ ID NO: 57419 - DNA, 726 bp, Zea mays
  misc_feature: Ceres CLONE 1505476
  misc_feature: Translation starting site: 167
gaactggagctccccgcggtggcggccgctctagaactagtggatcccccgggctgcaggaattcgcacgagaccattacctagaacatcctaatcgaaaaagaacacaattacacaagcgatagctcgcggtgagcatcgatcactgtgtactcaaacagcaagaatggccaaggttctgcaggccgctgttgctctcctgctggtggaagcgctgctgctgctagcccattgcgacggcagggagctgaaagcgagcggcgtggcggcgtcgggcggcggtgccgccgccaacgggtggtgggtaggtagcgggggggcgaccgagaaaggccacggggctttgcccgctggattcccggccgcctccccgccccggtggctccggcccccgggggtggcaaaaaccccccccccctttccctctccctgggaaaatacccctccgccgcccgggggggcccccacaaaaacccaaaaaaaaaaaggtttttccccggcgggggggggaagccgcggaggaagcccgcgggggctgccccgaaaaaacagggaggtgggggggcctggggggtggggggccaccacaaaaaagacagtcgcggggcgcccccgccttgcatcaggggggaggggagaggagagaatccgtgggccgcacgggagttccagtggtggccgggggccccgcaccggccaaaaaaatacccgcagtggggggggggg

SEQ ID NO: 57420 - DNA, 813 bp, Zea mays
  misc_feature: Ceres CLONE 1505481
  misc_feature: Encodes the peptide sequence at SEQ ID NO. 57421
  misc_feature (771)..(771): n is a, c, t, g, unknown, or other
tctgctgttcgtttataatatagtgggcgcgcgcggcgagggtggtttttttattctcaaaactggagctccccgcggtggcggccgctctataactagtggatcccccgggctgcaggaattcgcacgagaccattacctagaacatcctaatcgaaaaacaccacgccaccgctgctgcctgctcctcacagtcctccccgcgctcgcattgcgattcgcgacctagcgcgagggtacggggggtggtgcgcgcgcgtgctcggtgatccgggaagcgccgcgagatggccgggggcggaggcggcggtgccgcgccgaagcacgacgacttcgcgccgcaccccgtcaaggaccagctccctggggtctcctactgcatcaccagccctcccccgtggcctgaagccgttcttcttgggttccaacattatactggacaagccttggtaccactgcgaaacatactaacctgcaatttgttcccccaaatggcgaggaaatgcaatgagggacaaaggcagtgggttaatccagaacatgggcttggttcgttcacaggttattcaaaaccccccctaggtagagatttcttttgggtaccctacgctggcgcctgcagtgggatcaggtgggggtcaaaaccccctcatagtatcacaacacaaccaattttcaaaatacatcctatgtgggtgagatcaggttattgcgtagaatggaaacctctagtacgtcttaaatattaaaaagtttttctacaagagaaancaaaaggcgaaggggcggatcgcccacggcgtcccgtgtctg

SEQ ID NO: 57421 - protein, 153 aa, Zea mays
  misc_feature: Ceres CLONE 1505481
MAGGGGGGAAPKHDDFAPHPVKDQLPGVSYCITSPPPWPEAVLLGFQHYTGQALVPLRNILTCNLFPQMARKCNEGQRQWVNPEHGLGSFTGYSKPPLGRDFFWVPYAGACSGIRWGSKPPHSITTQPIFKIHPMWVRSGYCVEWKPLVRLKY

SEQ ID NO: 57422 - DNA, 703 bp, Zea mays
  misc_feature: Ceres CLONE 1505482
  misc_feature (370)..(370): n is a, c, t, g, unknown, or other
  misc_feature (703)..(703): n is a, c, t, g, unknown, or other
atagctggagctccccgcggtggcggccgctctattactagtggatcccccgggctgcaggaattcgcacgagaccattacctagaacatcctaatcgaaaaatcacacacgcgcatcgcgccaccccatccgtcaccgtcgacccgcgagcacccatggcgaagggaggaggtggaggcctgcgccgcctcatcgccctgtaaatggcggccatcgacgcacgggagatctctctagtctgtactcaccgcgcagactgctttcaagcccttaatgggactcctacacgctggtatcttcagctccaccgacaccttccgcgacctcgaccagtaggagcctcccgcgcctgcctctgcgacagacgcncacaacgcgatctcaacacatgaccctgccacgatggaggagatatccgaccacaacgcggcctaattaaaatacacaggtgctggagccggctggctcgagtatcccattgagggtacttctgtcgtggtctcccatcctagtagcctataaatcaccggccttgatacactttaattgcacctgatcccctccgactagcttcctcgcccgtgatccctagattcttcagaggaccccttttcctttctttcctcacaatgtacccggtctgttccacctaggaactttaaacgaatggccctctcccggcaggaattccggccgctcgcn

SEQ ID NO: 57423 - DNA, 666 bp, Zea mays
  misc_feature: Ceres CLONE 1505485
  misc_feature: Encodes the peptide sequence at SEQ ID NO. 57424
atagctggagctccccgcggtggcggccgctctagaactagtggatcccccgggctgcaggaattcgcacgagaccattacctagaacatcctaatcgaaaaaaacctctccgtagtcctactcttgtccgacccgcgcggccgccgccagcccgcgccctcggagcccccttccgcttctcctctccgggaatggcgtcggcgcgaggaccttgcggaattagtgtccgttctgacttcagttcagcctgccttattcacaaggctggagccccatcaaattctgtttctggcgtgatggctgttcaggttcaccgccaccgtaacaaggtccgcaatggccaagctatcaagtgtgcaatggcaactggataagagcaggttgcatttccactgccagtagcggtgatcaaaccagggcggtttgcgtggaaaataaacaaagtggttttagcttatagtggtggtttggatacatccgttatgtttcatggctcagggaaactatgggtggggaagcctttggtcccctgccgatggtggccagggggcccttaatttggaaggtttggaaaaaaagcaaaaccccggggggccggccccttgttgggaaagccccaaaaaaaaatttgggaaggaaatttattcccccccgcccgggggggg

SEQ ID NO: 57424 - protein, 60 aa, Zea mays
  misc_feature: Ceres CLONE 1505485
MASARGPCGISVRSDFSSACLIHKAGAPSNSVSGVMAVQVHRHRNKVRNGQAIKCAMATG

SEQ ID NO: 57425 - DNA, 682 bp, Zea mays
  misc_feature: Ceres CLONE 1505491
  misc_feature: Encodes the peptide sequence at SEQ ID NO. 57426
atagctggagctccccgcggtggcggccgctctagaactagtggatcccccgggctgcaggaattcgcacgagaccattacctagaacatcctaatcgaaaaatagcttcgtctgtataccctatatctctatagccaacacacacacaaatactctccattccattccatctcaaaggatagaataatgggcggtctctccaccaagcttttcgtggtcctcctcctgctcgtttgttacaccgggacgcaaggcgggccggtgactatggtgtcggcgaggaagtgcgagtcgcagagcttccgcttcaagggaccttgctcgagggacgccaactgcgcaaacgtctgcctgaccgaaggtttcaccggcggcgtgtgcaagggcctacgccaccgctgcttctgcaccagggactgctagtactgcctcgtctcgcctcgcctcggctcgtgtcctgcgtgtgcatagccgcagcggatcagtaaaacatgcatgcatgcgttaccgaatatttggcagtaccagcaagttaatggattaaataatatgtaatggaacaaagcctgttttgaacgtggaactgctgagtgctagcagcgctcgtgtttattggcatatatgaactctatggcgcgtttggacttaaaaaaaaaaaaaaaaagcttatcgataccgtcg

SEQ ID NO: 57426 - protein, 78 aa, Zea mays; identical to SEQ ID NO: 54886
  misc_feature: Ceres CLONE 1505491
  misc_feature (32)..(78): Pfam Name: Gamma-thionin Pfam Description: Gamma-thionin family

SEQ ID NO: 57427 - DNA, 674 bp, Zea mays
  misc_feature: Ceres CLONE 1505494
  misc_feature: Encodes the peptide sequence at SEQ ID NO. 57428
caaagctggagctccccgcggtggcggccgctctagaactagtggatcccccgggctgcaggaattcgcacgagaccattacctagaacatcctaatcgaaaatgtggtcctcgcgcccaccaacccccgcgacgagtaccagcactggttcaaggacatgaggcacagcaaccgcatcaaggatgaggaaggctacccggccttcgccctcgtcaacaaggtgacaggcgaggccatcaagcactcccaaggcgagggccaccctgtgaagctggtgccatacaacgccaactaccaggacgagtcagtgttgtggactgagagccgcgacgtgggcgccggcttccggtgcatccgcatggtgaacaacatctacctcaactttgacgctctccacggcgacaaggagcacggcggcgttcgcgacggcacctccctcgtgctgtggaagtggtgcgagggcgacaaccagcgctggaagatcctcccctggtaaacgtgtcatgctgctgaagctgagttgatcgccaccgtgacccggagttggtagagatcggcctgtgatctgttgccgcggcggtagaataaaaatcgtgtgcggtccgcagtggtgatgtgtccctgaatgtgggtgtttaatttctggcctgtccgtgtgtcctgctatggccag

SEQ ID NO: 57428 - protein, 112 aa, Zea mays
  misc_feature: Ceres CLONE 1505494
MRHSNRIKDEEGYPAFALVNKVTGEAIKHSQGEGHPVKLVPYNANYQDESVLWTESRDVGAGFRCIRMVNNIYLNFDALHGDKEHGGVRDGTSLVLWKWCEGDNQRWKILPW

SEQ ID NO: 57429 - DNA, 655 bp, Zea mays
  misc_feature: Ceres CLONE 1505497
  misc_feature: Encodes the peptide sequence at SEQ ID NO. 57430
aatagctggagctccccgcggtggcggccgctctagaactagtggatcccccgggctgcaggaattcgcacgagaccattacctagaacatcctaatcgaaaagttgcatcttctcctctgttctccacgacgcagttcggctgccagacaaaaaccctaaccaccgtcgccgccgccgccgccgccgctcttcctcgagatgggaggcaagtgcccgcaccgcaaggtaaagaagcgccgcctatcccacaagacggctcgccgcggcaagttcctcctgaaggccgacgatgccgtctatgacgagctcgtcaagctggccgaccagggcaaggacgctgaaaccaaggagctccccgtcgatgaggaccttccaggcctgggacagttctactgcctccactgcgatcgctactttgcaagtgaaagcgtgaaggatgatcactaccgctcaaagcgccacaagaaaagggttaaggtaatgtctggaccggccccgcacacgcagcttgatgcagaactcgctgcagggatgggaaagcctgacaacggcctgaagctcatgtccatgtgaaggaacctcttgctggtactggtacttgttccgtgcctttgttgctgccgtacaattgaagctgctttgcgcagtaagta

SEQ ID NO: 57430 - protein, 124 aa, Zea mays; identical to SEQ ID NO: 45117
  misc_feature: Ceres CLONE 1505497

SEQ ID NO: 57431 - DNA, 673 bp, Zea mays
  misc_feature: Ceres CLONE 1505499
  misc_feature: Encodes the peptide sequence at SEQ ID NO. 57432
catagctggagctccccgcggtggcggccgctctagaactagtggatcccccgggctgcaggaattcgcacgagaccattacctagaacatcctaatcgaaaaatttcagtgtctgtcgttggagatgctctgacgttgccggaggccgacatggagcgtggccgcatcagcacctcttgccggtacttgctgctcctcctcctggtctgcttctcacacggcgcctgggcggccgcggcggctccggtccagacgcctctgcatgcagctgctgccgtgcctcctcctctggctcttcaccaagcggagaggaatggcgccacggcggcagctgccgactacggtctcgtgatgactcacgaaggtgacgctaactccacgagcaatggcaacgacgactaccagatctcctccgtctcagagtcagagacgatgacaggcgcacaggatgcgtgtgggacagaaggcaactaccaggaggactgactgcagaggcggctgctctgagacgcgcacctcgactacatctacactgcacacatgggcaagccgtgagccgagcccgtgatcaatgcatctcggcctcggactcgacggtttgcatggatggcttgatgtgtacaaagagcgtacctgacatgcatgctgctgggaagaagtcgatgacagacg

SEQ ID NO: 57432 - protein, 111 aa, Zea mays
  misc_feature: Ceres CLONE 1505499
MERGRISTSCRYLLLLLLVCFSHGAWAAAAAPVQTPLHAAAAVPPPLALHQAERNGATAAAADYGLVMTHEGDANSTSNGNDDYQISSVSESETMTGAQDACGTEGNYQED

SEQ ID NO: 57433 - DNA, 620 bp, Zea mays
  misc_feature: Ceres CLONE 1505500
  misc_feature: Encodes the peptide sequence at SEQ ID NO. 57434
caaagctggagctccaccgcggtggcggccgctctagaactagtggatcccccgggctgcaggaattcgcacgagaccattacctagaacatcctaatcgaaaaatccgccacagccgaactggcccgatgtcgctggttgcctacgatgcctcctccgatgaggaagacgccggcgagcctgccgccgccgcggcgccacaccctgcccccatcggtccgcagccaaggcctccgtctcctacggcagtgagcccctgctcctcggcctacgcctacgcttacgccgccgccgccagcagccagccagagtgtagcacccatttagttcgagtgatgtctctctggccacatcatcattaggatctcccagatgttgcaaaatctctttggctccccccggggggccccccttttgggggagggggggtgcaatgggggtgtggccccccaggagcccggccaattaatttcccaagggaggccattccccattcccccaaggggcatacggaagggccccccgggaaaagccctttttcccccccccaccttccgggaaagaggaaatggggtggtccccaaaaaattgggccaacacccttttgggggtaaaccaaa

SEQ ID NO: 57434 - protein, 77 aa, Zea mays
  misc_feature: Ceres CLONE 1505500
MSLVAYDASSDEEDAGEPAAAAAPHPAPIGPQPRPPSPTAVSPCSSAYAYAYAAAASSQPECSTHLVRVMSLWPHHH

SEQ ID NO: 57435 - DNA, 869 bp, Zea mays
  misc_feature: Ceres CLONE 1505501
  misc_feature (30)..(30): n is a, c, t, g, unknown, or other
  misc_feature (31)..(31): n is a, c, t, g, unknown, or other
  misc_feature (56)..(56): n is a, c, t, g, unknown, or other
ggagtcgcaaaccctcctcgggccataaannagggggggccggcttggtgcataantacaaactgggactccccgcggtggcggccgctctagaatagtggatcccccgggctgcaggaattcgcacgagaccattacctagaacatcctaatctaaaaacaatgctgattttgtttgagccatctggactggactggaccctatgagaaacagatcagatcgcccccacgctcgcttccccagcctggagggtggtcatcaccctcttcctcctccttcgcattaggggggtaatgtgggaaagggggggggggggcaacgcggggggaaatgggggtaaacggggggggaacaacgggggggtggagaggggggggcactaaggggggggggtggggggtggatgcgaaaattaataatccgaaaagcgaaggcacagtgcggggaaccacgaccccccgggaagggggaaaatcactcggtgtatgggggggggcgtggtaaagtggggccacccacggcgggtgttgagctggccgcaccttgtggggggggcagggaggggtggggggggagctagcccctcgcaaaaaaggcgcagcgtgttggggttgggtaaaacaaactgctattttggttcggcgtcgccagggcggggggcgtggggggccgaaagaggaataaaatgtgggggtgggggtgggggaggggggggcaggtgcttaggcggggggggtgggggcacacagaggtgggggagtgtgcgctgaggggccaccccggtatatgggggggagcgcaaaggtaaaataaggggtaacaagtctgtgggatataggtatcggtgccacacatatatgaggatggg

SEQ ID NO: 57436 - DNA, 645 bp, Zea mays
  misc_feature: Ceres CLONE 1505502
  misc_feature (22)..(22): n is a, c, t, g, unknown, or other
ctccccgcggtggcggccgctncattcctagtggatgccccgggctgcaggaactcccacgagaccattccctagaacatcctaatcgaaaacctctcgttcttcacttcgacaggagctggagcgcccgccctccagcccaggtccgcgccgccgccgcgccgaccacaatcccagcgcccgctgcccagacccagcgccgcctgcggttgtgagcgcgaacaggagagagcgggtcttcggggcgagcgccacgcgcagacggcggttgaggagcctgagaaaaccctggtcttccttcaagatcctggtggatcgcgcccagctccgcgaaatttccttgatgtctatgtaggttcgtcctaaagattcgattttgttggctcttttgatccgacgcagatccgtaccgctctcgcctgattctgcaattcaggcgccaggaggcttgctggctgtttttggattggtgtcttctcccatggggtcttgcaggtgtaggagggtgaattctgtctgattaatcagcggaggggaagcggctaccgtggctgcgcgaacatggccgggcgagcagggctccggaagggagcggggaccagtaaggcgcatggatcctaaccctgtgttctccggactcccctc

SEQ ID NO: 57437 - DNA, 892 bp, Zea mays
  misc_feature: Ceres CLONE 1505504
  misc_feature (19)..(19): n is a, c, t, g, unknown, or other
  misc_feature (24)..(24): n is a, c, t, g, unknown, or other
  misc_feature (25)..(25): n is a, c, t, g, unknown, or other
  misc_feature (41)..(41): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (413)..(413): n is a, c, t, g, unknown, or other
tgggcgtttggcccgcggnggggnnaaatactcttttgttnggggggggnnnnncaaaactggagctccccgcggtggcggccgctctatatctagtggatcccccgggctgcaggaattcgcacgagaccattacctagaacatcctaatcgaaaaatctgttcccatctcttctgcctccgtctcaatctcgaccggtcaccccatctccaccgccacatccgtcgtcttccgccgccgccgatggggccgcctcctcacgcaaaccctcaccctagcccgccgcggctcctccccctccgctaccggcgcatccggttcccgtccgtggcctcgccaccaaggggcgagatcatccagatccaatgtccgcgggagaaagacgggtgggtgcctcatgcgcgagtggttngagataaaaaagagggaggacggggcccaggccccccccgcaatccgggcgacgcggggagcgagcggcggtggggggggggagagggggtggcccccggccggcccccccacatacctcgggcgtgcgcccctggcctcctctccgggggaccggcccccttccccatgcgagccccagccaaaatgcgggggcggcgcctggtttgtgcaagtaccaactaaagacagggggtgacgggccggggcggacgcccgggtccgctctgtggggggctccacggcgggggggggtgcccccgcgagtggcttgttgccgataacgtctgacttcagctgtgggcctgcttttccgggctagctcggggcgaggcgggcacgcgaggaggcgcggcgggcgaatgcaaaaggcatgggggcgggagcgcacatgcgtttggggggcgcacggcccaccgcttatacttcgagtagcgggca

SEQ ID NO: 57438 - DNA, 870 bp, Zea mays
  misc_feature: Ceres CLONE 1505509
  misc_feature: Encodes the peptide sequence at SEQ ID NO. 57439
  misc_feature (1)..(1): n is a, c, t, g, unknown, or other
  misc_feature (21)..(21): n is a, c, t, g, unknown, or other
  misc_feature (54)..(54): n is a, c, t, g, unknown, or other
nttgttggtgctgaggtgggnattcgaatccctctctttttattcggggggtgnaccaaaactggtgctcaccgcggtggcggccgctctagaactagtggatcccccgggctgcaggaattcgcacgagaccattacctagaacatcctaatcgaaaaacgaatcactgctctgctttcaccccccgcatcgaacctcacccccgatctgatcgaatccaaggctgcggcggcgatgggcggggaccacggcggtgggcacgccggcggctacttccgccttaaggtatggtgcatgacgggcggcccctactggcgccccgttcatctggcgccgtgtcgctgccttccgccatgtacggcgtgcttcctcatcttggctccccatgcgctatgaaaacccgtaaatagctggaggattcgacccgaagggacctcggtccgtgccttaccccctccccgaatgggggcggggcaaaatactgtgggggaagaaaacgggggccccgggtagggaccgccggccaacccctcgcactgaaaaatgtcgcatgctaccctcaccccgcttgaacccatatttcttttcggcccgtataagcgaagggtgcgatttgatacatgcaccccccactctccacaacagtcgattttcgaatattagtctttgagggggaccaactaatcctccgtcgtttggtggcggtacctaagcggcggtgcaccacccgcatctgggacccgttctcgacaattatggtgtgcgagggtgtggtgttgttggaacaggttcaccccccccttatttcccgtatcccgcgttcatgcttttaggggtagtgggaagagggagaagtacgtactacggcg

SEQ ID NO: 57439 - protein, 53 aa, Zea mays
  misc_feature: Ceres CLONE 1505509
MGGDHGGGHAGGYFRLKVWCMTGGPYWRPVHLAPCRCLPPCTACFLILAPHAL

SEQ ID NO: 57440 - DNA, 648 bp, Zea mays
  misc_feature: Ceres CLONE 1505511
  misc_feature: Encodes the peptide sequence at SEQ ID NO. 57441
atagctggtgctccccgcggtggcggccgctctagaactagtggatcccccgggctgcaggaattcgcacgagaccattacctagaacatcctaatcgaaaaattccccgccgcctcgcgcccccgctcgcttcacttctctaggtgcgcaccgatcagaaggtgcctgcctcctcctcgtcggcgaaaagatggcggtgccgctgctgacgaagaagatcgtgaagaagcgggtcaagcagttcaagaggccccacctcgaccgctacaagtgccttaagccaagctggcgcaggccaaagggtattgattcccgtgtcaggaggaagttcaagggatgcactttgatgcccaacattggttatggttctgacaagtcgaccaggcactacctccccagcaagttcaagaagtttgtggtccacaacgtttctgagctggagttgctcatgatgcacaacaggacctactgcgctgaaattgctcacaacgtgtccaccaagaagcgcaaggagatcgtggagcgtgctgcacagctcgacattgtggtcaccaacaagcttgctaggctccgcagccaggaggacgagtagtctggtttcttgtcttaacgacgaactggatgttgccattcctttctgtagggaa

SEQ ID NO: 57441 - protein, 133 aa, Zea mays; identical to SEQ ID NO: 13146
  misc_feature: Ceres CLONE 1505511
  misc_feature (14)..(123): Pfam Name: Ribosomal_L32e Pfam Description: Ribosomal protein L32

SEQ ID NO: 57442 - DNA, 672 bp, Zea mays
  misc_feature: Ceres CLONE 1505524
  misc_feature: Encodes the peptide sequence at SEQ ID NO. 57443
  misc_feature (672)..(672): n is a, c, t, g, unknown, or other
atagctggagctccccgcggtggcggccgctctagaactagtggatcccccgggctgcaggaattcgcacgagaccattacctagaacatcctaatcgaaaactttctctctcctccgcctcccccgactcgcgagtcgcgatctccacctccctcgaccaccactcccgtaacccacttccgggtgggccccacgtcgccgctggcgaccagcacctcccctccttgactccctcgctacccgccgcccgccgagcagcagcatgaggaagaggaggtgctggtgccgtatggcccgcacctggagttgcccaatggagcgcagccaatggaaggacttcagtgatcttttggtacatcgctgctaatacaaacaacctacccaaactgcttttgtgaagtgaaaccaaaaaaggaggtgtgctactgttcttctgtattgatgtcaatgcaacagcagaaagtggagataagtggaggtggcaccaccaattccttgatgtaccaagaatgtgtggattgttgcattctgacattgtttggctcaccatattcaagttggagcgtcaggtctcccaacattaaactaattggaggagtggagcttcatgttgggaagatgcatgcccctttcaagtttccgaaagctgggctcaactgcaacttgtggcn

SEQ ID NO: 57443 - protein, 76 aa, Zea mays
  misc_feature: Ceres CLONE 1505524
MSMQQQKVEISGGGTTNSLMYQECVDCCILTLFGSPYSSWSVRSPNIKLIGGVELHVGKMHAPFKFPKAGLNCNLW

SEQ ID NO: 57444 - DNA, 824 bp, Zea mays
  misc_feature: Ceres CLONE 1505526
  misc_feature: Encodes the peptide sequence at SEQ ID NO. 57445
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
taatagcgctcacaccccggggcggtcgggccggggggggggggnnngggggggttgtccatagctggactccaccgcggtggcggccgctctagaactagtggatcccccgggctgcaggaattcgcacgagaccattacctagaacatcctaatcgaaaaacggcgaccaaccctctcccaacccgactagtcggactcgcagctccgccccaagtccaggtcgaagcatggaagtcgcggcggcgtcggcgaggcccgtcctgcgcgtggctgccatctgcggctccctccgcaaggactccttcaaccggggcctcctccgcgccgccgcggaggtgtgcgaggactccatcccggggctccagatcgacgaggtcgagatctgcgactgtggccataaaaaacgaccgaccctcaaacccggccgcctccgccagctatgtgttttgctgtccggccatccaaaggccttgccgctggcaaagcggcaggccaggggcggaccgggggtcctctttacaggggcgggcccgagataaggaaactacctccccattcgagcccaccccccgtgatgaaagatatacgccaacgtccgaacatgggactccccgtttggatgggaagagaaacccggttcgggtgcccgaaaccacggacgcggctctgacaaatcggtgaagtcctcacggcgctgaaggcccttaccgaagaaagagggaggagaccctcccacaccaaattcagccgagcccgggtcgggcgggctctccctgcgcggctcctggcacttgtcacagtagagaaagacccgacacgag

SEQ ID NO: 57445 - protein, 103 aa, Zea mays
  misc_feature: Ceres CLONE 1505526
  misc_feature: SWISSPROT Homolog: EC 1.6.5.2 NAD(P)H dehydrogenase (quinone)
MEVAAASARPVLRVAAICGSLRKDSFNRGLLRAAAEVCEDSIPGLQIDEVEICDCGHKKRPTLKPGRLRQLCVLLSGHPKALPLAKRQARGGPGVLFTGAGPR

SEQ ID NO: 57446 - DNA, 661 bp, Zea mays
  misc_feature: Ceres CLONE 1505528
  misc_feature: Encodes the peptide sequence at SEQ ID NO. 57447
aaagctggagctccccgcggtggcggccgctctagaactagtggatcccccgggctgcaggaattcgcacgagaccattacctagaacatcctaatcgaaaaccattcattcacacaccacacctcccgaactacaagtttcgcttctcgtcgcgatgactgggcgagaccgccgccgccgcctgagttctgtagaaatggctgatggtgaggacatccagcctcttgtctgcgacaatggcactggaatggtcaaggctggttttgctggcgacgatgcaccaagggctgttttccctagtattgttggccgtcctcgccacactggtgttatggtagggatgggacagaaggatgcgtatgttggcgacgaggcacagtccaagagaggtattctcacgctcaagtatccgatcgagcatggtattgtgagcaactgggatgacatggagaaaatctggcatcacactttctacaacgagcttcgtgttgccccagaggagcaccctgtgttgctcactgagggtcctttgaacccaaaggccaacagggaaaaagatgacccagattaggttcgagactttcaatgttcctgccttgtacgttgcaatttcagcaattgctgtctctcttttgcccgtgggacgttactactggtatt

SEQ ID NO: 57447 - protein, 138 aa, Zea mays
  misc_feature: Ceres CLONE 1505528
  misc_feature (18)..(139): Pfam Name: Actin Pfam Description: Actin
  misc_feature: SWISSPROT Homolog: EC 2.7.10.2 Non-specific protein-tyrosine kinase
MTGRDRRRRLSSVEMADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEGPLNPKANREKDDPD

SEQ ID NO: 57448 - DNA, 658 bp, Zea mays
  misc_feature: Ceres CLONE 1505529
  misc_feature: Encodes the peptide sequence at SEQ ID NO. 57449
aaagctggagctccccgcggtggcggccgctctagaactagtggatcccccgggctgcaggaattcgcacgagaccattacctagaacatcctaatcgaaaaatcggagtatcggacggctcactacccagaaaagggctcgtggagcttctcttaatctcttgtaaaaaaaaaaccttgacaagaacgaattcgcctccggctctcctcttctcgagcgttttcggcaccacggcgcagtaggatggcggcggcggccccgacgagagcagaggtgctgtcgctcttccgttccttactccgcacggcgaagaagttctcggactacaacatccgcgagtacacgcgccgacgcgccgcggactccttccgcgaaaaccgcgccctcgccgatgcgtcggccgccgccgcggcgttctcggaggggaagaagcagctagaggttgcgaagcggcaagcggtggtttactctctctacgcccccaaggccaagagcgtgatggagttgaaggtgcagtgatggctgcgaccttttcttccccaccgttcccgttccagattcgttgcttttgtgtgatgatgaaactataaactgctccgttgtcgcattttctggatgattgtcatgatatagtttcgttctgtgcaataaattact

SEQ ID NO: 57449 - protein, 91 aa, Zea mays
  misc_feature: Ceres CLONE 1505529
  misc_feature (6)..(70): Pfam Name: Complex1_LYR Pfam Description: Complex 1 protein (LYR family)
MAAAAPTRAEVLSLFRSLLRTAKKFSDYNIREYTRRRAADSFRENRALADASAAAAAFSEGKKQLEVAKRQAVVYSLYAPKAKSVMELKVQ

SEQ ID NO: 57450 - DNA, 672 bp, Zea mays
  misc_feature: Ceres CLONE 1505540
  misc_feature: Encodes the peptide sequence at SEQ ID NO. 57451
  misc_feature (325)..(325): n is a, c, t, g, unknown, or other
tcccccgggctgcaggaattcgcacgagaccattacctagaacatcctaatcgaaaaaagcctaatccccacgaaaaccctaaaccctcgctacccggcggcggctacaagctcttcatagcaccatgaggccaccggctagaggaggacgtggtgggaggggaggcaggttcgatggcggcggccataggggcggcggcggcggccgtgggtttggcggtggtagaggcgggagaggggacaggggtagggagaggtggcaggacccccagaggcggccgtggctgccgtggcaaggttggccggggggggtgggatgaaaggnaaaaacaaaggccaccaaggcaccccaaaaagaacgccgggggtttcttcctcccgccccccagcaggttgcgctctggcgcccaggaaggggttcccccaaaaaagcccccgataacggagagaaacggggcgtcgccgctcggaatggggggggggggaccaaaaggtcggaaatagagggggtggcggaacccgctgcccggtgccaaacctagcctacttgcttggtctttggagcggggctgggtaacttcctggagaggggctcctggggggcccccgacgggcggaaaccggggggggcgggatgtctggtacgaaccctccaccctcaccgcgcccccc

SEQ ID NO: 57451 - protein, 109 aa, Zea mays
  misc_feature: Ceres CLONE 1505540
  misc_feature (51)..(51): Xaa is any aa, unknown, or other
MAAAIGAAAAAVGLAVVEAGEGTGVGRGGRTPRGGRGCRGKVGRGGWDERXKQRPPRHPKKNAGGFFLPPPSRLRSGAQEGVPPKKPPITERNGASPLGMGGGGPKGRK

SEQ ID NO: 57452 - DNA, 643 bp, Zea mays
  misc_feature: Ceres CLONE 1505546
  misc_feature: Encodes the peptide sequence at SEQ ID NO. 57453
  misc_feature (17)..(17): n is a, c, t, g, unknown, or other
  misc_feature (41)..(41): n is a, c, t, g, unknown, or other
cctcggaggaggtcgcnccttccaatttggagtgggggggnggacgtacatcactagaccattaccgagaagatcctaatcgaaaagtaccccggagttctttgcacacaaaccagctcgaaaccctagacctgtgcggctgtccctattctctccaacggaaagatgtactcggaccagatgtccaccgggcgcaagcgctccatccacgaccgccttgacggcgacctccccgccggcacgggcgccggcggccgtgttcgtcacacggtgtccaagaggcaacggcagatagatgaaaaatggaagcatgatctgtatcgggaagacgatgaaccagcttctatattaatagacccgaaggaggtgcgagtgtagcttcataggcgaagttcacaacaaagctttaccagcacaaggagttctggtgtgcgtgatttacgtgagaagctatctggtataatgcacccacagccatcaaatgctgatccaaagcccaagccaaagccagtatcagaggttgttaacatctcaaggcgtcaaactgctgatgaaatgcctgcacgtcaaagcaagagagcaccaaaacagacttcattgaagaagacatctcaggccaaggttgaaagtccactcagcagtt

SEQ ID NO: 57453 - protein, 70 aa, Zea mays
  misc_feature: Ceres CLONE 1505546
MYSDQMSTGRKRSIHDRLDGDLPAGTGAGGRVRHTVSKRQRQIDEKWKHDLYREDDEPASILIDPKEVRV

SEQ ID NO: 57454 - DNA, 689 bp, Zea mays
  misc_feature: Ceres CLONE 1505576
  misc_feature: Encodes the peptide sequence at SEQ ID NO. 57455
aaagctggagctccccgcggtggcggccgctctagaactagtggatcccccgggctgcaggaattcgcacgagaccattacctagaacatcctaatcgaaaactgaatcgaaaccggcggccacgagagcagtgcgaggcgcccaccgttatggctcgaaccaagcaccagaccgtgacgaagacggcggagaagcccaataagaagctccagttcgagcgctcaggtggtgcgagtacttctgcgacgccagaaagggctgctgggaccgtgcgaagagcggcgtctggaggtgactcgattgtgaagacgaaaccacgccaccgctggcggccagggactgtagcgctgcgggatatcaggaagtaccataagtccactgaaccgctcatcccctttgcgcctttcgtccgcgtggagagggagttaaccaatttcgtaacaaacagcaaagtagagcgctctaccgcacaagccctccttgcgctgcacgacgcagcacaattccacttgatagaactgtttgaaatggcgaatctgtgtgccatccatgccaagtgtgtcgcaatcatgtataaggacatacaacttgtaaggcgtatcgtacgaaggcattagtcatgacatatgatatccattctgattgcatcagtcttgtgaatttgtttgtatgagctagacattattgt

SEQ ID NO: 57455 - protein, 155 aa, Zea mays
  misc_feature: Ceres CLONE 1505576
  misc_feature (76)..(152): Pfam Name: Histone Pfam Description: Core histone H2A/H2B/H3/H4
MARTKHQTVTKTAEKPNKKLQFERSGGASTSATPERAAGTVRRAASGGDSIVKTKPRHRWRPGTVALRDIRKYHKSTEPLIPFAPFVRVERELTNFVTNSKVERSTAQALLALHDAAQFHLIELFEMANLCAIHAKCVAIMYKDIQLVRRIVRRH

SEQ ID NO: 57456 - DNA, 912 bp, Zea mays
  misc_feature: Ceres CLONE 1505582
  misc_feature (14)..(14): n is a, c, t, g, unknown, or other
  misc_feature (52)..(52): n is a, c, t, g, unknown, or other
  misc_feature (461)..(461): n is a, c, t, g, unknown, or other
  misc_feature (610)..(610): n is a, c, t, g, unknown, or other
ggggggggggaggntggggtgggtggccggggggggttttgcgagcccctanaaaaactggggctcaccccggcggggggcgcgctctacaactagtggatcccccccggctgcaggaattcgcacgagaccattacctagaacatcctaatcgaaaaaacacgaccgtcgccggctctactcccagtcccagctgccaagggcttcgtcgcctcgacgggctcgggtcctttgccggcgacgagcgcctgcacaccacaagaataatggggagccgcgatgccggttggaaaactagttcgattattgcaggccgccggcgatggcctcggagccgctgcgagcggcgtctcctggtgttagggtaggtggggaggattgcggtacggagaccggctccgctctgcctacccacggccctggactagcgaacgcgagatgtataaggggggggccaaaancaaaaaaaacacatcaaccgggggggggggggggagtcgctgtggtggcgggggaaagggcgagcacctcccccccccgaagggggtggtggggggagtgtgaccgcgccgaacacacaacaacaaatcagcgccaagagacaccaaanaaagaaaataatctcacggtgtatgggggaaatttctggtctaccctgcagttcttcctctggagaccgcccgaggcgccgccccacaaacgcatttcttaacacattggcttttgggggggtgtgaagtttctaccacgaccccatgacctgtgggcgggcgcccccctaaacccagggagtttgtttattatctctcgaacggccactgggcccatagccatagacgggggcgccctgatccgccggtggagagtgcgaataactaattacacgccccgccaccccccgccctgaccgcc

SEQ ID NO: 57457 - DNA, 673 bp, Zea mays
  misc_feature: Ceres CLONE 1505597
  misc_feature: Encodes the peptide sequence at SEQ ID NO. 57458
  misc_feature (600)..(600): n is a, c, t, g, unknown, or other
  misc_feature (668)..(668): n is a, c, t, g, unknown, or other
caaagctggagctccccgcggtggcggccgctctagaactagtggatcccccgggctgcaggaattcgcacgagaccattacctagaacatcctaatcgaaaactaattgagcatcgcagagataggcgtcttcgtactcgcctacctccgcggctcaaacctttcccccttctcccaattccttccgccggccgccgctccacccgtacgacgacaccatgagggagtgcatttcgatccacatcggccaggccggtatccaggtcggaaacgcgtgctgggagctgtactgccttgagcatggcattcaggctgacggtcagatgcccggtgacaagaccattgggggaggtgatgatgctttcaacaccttcttcagtgagactggtgctgggaagcacgtgccccgtgctgtttttgttgaccttgaacccactgtcatcgatgatgtgagaactggcacctaccgccagctcttccaccctgagcagctcatcagtgggaaggaggatgcagccaacaactttgcccgtggtcactacaccatggggcaggagatgttgacctgtgccttgatcgcatcaggaagcttgccgacnactgcactggtcttcaggacttcctcgtcttcaacgctggtgatgggaagaacggctctggccctggntcccc

SEQ ID NO: 57458 - protein, 151 aa, Zea mays
  misc_feature: Ceres CLONE 1505597
  misc_feature (49)..(151): Pfam Name: Tubulin Pfam Description: Tubulin/FtsZ family, GTPase domain
  misc_feature (150)..(150): Xaa is any aa, unknown, or other
MRECISIHIGQAGIQVGNACWELYCLEHGIQADGQMPGDKTIGGGDDAFNTFFSETGAGKHVPRAVFVDLEPTVIDDVRTGTYRQLFHPEQLISGKEDAANNFARGHYTMGQEMLTCALIASGSLPTTALVFRTSSSSTLVMGRTALALXP

SEQ ID NO: 57459 - DNA, 698 bp, Zea mays
  misc_feature: Ceres CLONE 1505599
  misc_feature: Encodes the peptide sequence at SEQ ID NO. 57460
  misc_feature (476)..(476): n is a, c, t, g, unknown, or other
  misc_feature (477)..(477): n is a, c, t, g, unknown, or other
aaagctggagctccccgcggtggcggccgctctagaactagtggatcccccgggctgcaggaattcgcacgagaccattacctagaacatcctaatcgaaaaatcgagccgccgccgccgccgccgcagttgtcttcggtcttccgtgctcaccttcgagagatcaagttgctgctgcggtagtccccaaccatcatcatgcagaacgaggagggtaagacggtggacctctacgtccccaggaagtgctcggccacgaataggatcatcactgccaaggatcatgcctctgtccagatcaacattggccacttggatgcgaatggcctgtacgatggtcacttcaccacgtttgctctctctgggtttgtccgtgctcagggtgatgctgacagttcgttggacaggctgtggcagagaaagaagctgagatcaagcagtaggtctttgcacgtagttccaccggtaatggactnnctgaggatactgctctagctatgcttttagctgggggggggggggaaggaatcccgaaggttgggctggtccttttgtggatgacaaggttttattttgtccggccatgcttgggtcccaacaaatcgggggaacaagaaaaataattttgccaaccctatctttcccaaaaaaaaaaaaaaaaaagtttttcgaacccccaaaccccgaggggggggccc

SEQ ID NO: 57460 - protein, 98 aa, Zea mays
  misc_feature: Ceres CLONE 1505599
  misc_feature (1)..(81): Pfam Name: Ribosomal_S21e Pfam Description: Ribosomal protein S21e
  misc_feature (93)..(93): Xaa is any aa, unknown, or other
MQNEEGKTVDLYVPRKCSATNRIITAKDHASVQINIGHLDANGLYDGHFTTFALSGFVRAQGDADSSLDRLWQRKKLRSSSRSLHVVPPVMDXLRILL

SEQ ID NO: 57461 - DNA, 688 bp, Zea mays
  misc_feature: Ceres CLONE 1505604
  misc_feature: Encodes the peptide sequence at SEQ ID NO. 57462
aaagctggagctccccgcggtggcggccgctctagaactagtggatcccccgggctgcaggaattcgcacgagaccattacctagaacatcctaatcgaaaaaagcaccgaagatggcttgacgcccgaatccagaccctcgtctgttatggcggcggcggaagcggcgccaccgccgatactcgagctggacccgtcacaagatcgagccgtcagcgttgtcgaggacatcatgcgtctagagcggaggatctttccgaagcacgaatcgctggcgcggtccctgcacaactagctaaagcggcagaactccgggctgatctacaagacgtccagcgccgacgagggggaggtcatcgggtatgccatgtacacctgcaacacatccctctgcgccaccatcaccaagctcgccgtgaaggagaactgcaggcggcagggccacggtgaggcgctgctggcgggctcagtggagcatgtgccacgctgctgaaggtccagctgctctccctccacgtcgactccacgaggacggctgccgtggcgctgtaccacaaggccgggttccaggtcgacaccaccgtcgagggctactacgagactcacagggacgcctacccgatgttcttggatctgtagtagaaccgtcgaggacgagaaaacatgcccatgtgctccaggagctgct

SEQ ID NO: 57462 - protein, 41 aa, Zea mays
  misc_feature: Ceres CLONE 1505604
MYTCNTSLCATITKLAVKENCRRQGHGEALLAGSVEHVPRC

SEQ ID NO: 57463 - DNA, 639 bp, Zea mays
  misc_feature: Ceres CLONE 1505607
  misc_feature: Encodes the peptide sequence at SEQ ID NO. 57464
  misc_feature (625)..(625): n is a, c, t, g, unknown, or other
caaagctggagctccccgcggtggcggccgctctagaactagtggatcccccgggctgcaggaattcgcacgagaccattacctagaacatcctaatcgaaaactgtttcttccaatcctccacagtctctctctagagtagacccaggaaagaggcgatggatatggccattgacacgccatcgccggcgccgcccacgccgccggcgccatcggcagcggccgggcggcagacgcgtgcggcagaggcggtgcgtctggagcaccaactggtgcgcgtgcctctcgagtccctccgcgccaccgtccgctcgaaccaccgcctcgccgagaaggagatcgccgccgtcctctcctccgcctccgcggcccccgcagagagcagtgccgccgccgtcgaccacctcacctccctcgtctctcgcctccacggcctcaagcgcaaggacctcgttgatattgatgtctttctcgatgcgaaaagagtaattgattctcttcagaataatgaagtttctcctgctttagcttggtgtgcagaaaacaagtctcggctaaagaaatcgaagagtaagcttgagtttttactgagggctcaagaagtttgtggagttggtccagggtnaaaaatttcatccg

SEQ ID NO: 57464 - protein, 160 aa, Zea mays
  misc_feature: Ceres CLONE 1505607
  misc_feature (156)..(156): Xaa is any aa, unknown, or other
MDMAIDTPSPAPPTPPAPSAAAGRQTRAAEAVRLEHQLVRVPLESLRATVRSNHRLAEKEIAAVLSSASAAPAESSAAAVDHLTSLVSRLHGLKRKDLVDIDVFLDAKRVIDSLQNNEVSPALAWCAENKSRLKKSKSKLEFLLRAQEVCGVGPGXKISS

SEQ ID NO: 57465 - DNA, 689 bp, Zea mays
  misc_feature: Ceres CLONE 1505620
  misc_feature: Encodes the peptide sequence at SEQ ID NO. 57466
atagctggagctccccgcggtggcggccgctctagaactagtggatcccccgggctgcaggaattcgcacgagaccattacctagaacatactaatcgaaaaaaaaaagcccatcttctcttcctctctcgcagcaccgcctctcaacctccgccgccgctcgcccggggcgtcacccacccgcgcagaaggcccccgccgctcaagctaccggtgccctaaaccccgatatcttcttcgcctccctttcctcctcagcacccaatccccgaccttcagggttccgccgccatgccgcagggagaccacatcgagcttcaccagaagcgccatggcaagcgcctggaccacgatgaacgcaagcgcaagcgcgaggcgcgcgaggtgcacaggcgctcgaaggacgcccgcaatttgattggtgctaagggcaagaggttcgccaagaaacgctatgctgagaaggcacagatgaagaagaccctgaaaatgcacgatgaatcaaataagcgacagaaggttgatgatgatgtccaagagggtgctcttcctccgtatctactcgatcgtgatcagacacagcgtgccaaggtcctcagcaacacaatcaagcaaaagaggaaggaaaaggctggcaaatgggatgttccgctgccaaaggtcagtagctgaagaagaaatgttcaagg

SEQ ID NO: 57466 - protein, 126 aa, Zea mays
  misc_feature: Ceres CLONE 1505620
  misc_feature (1)..(127): Pfam Name: Ribosomal_S8e Pfam Description: Ribosomal protein S8e
MPQGDHIELHQKRHGKRLDHDERKRKREAREVHRRSKDARNLIGAKGKRFAKKRYAEKAQMKKTLKMHDESNKRQKVDDDVQEGALPPYLLDRDQTQRAKVLSNTIKQKRKEKAGKWDVPLPKVSS

SEQ ID NO: 57467 - DNA, 694 bp, Zea mays
  misc_feature: Ceres CLONE 1505626
  misc_feature: Encodes the peptide sequence at SEQ ID NO. 57468
caaagctggagctccccgcggtggcggccgctctagaactagtggatcccccgggctgcaggaattcgcacgagaccattacctagaacatcctagtcgaaaacctttgccctctcctccttctgccgccacaagaaaaaggaaagcgccgccaccagaaatagccattgacagcaagtccggagagagtagctgggtggagatatcgccacgtctcaagtctcgggggcgaattcaggagctttggtcgcgttgaagggtctcgcgcgaggtgttgccgtgtatggtgggtgctcggctggtcgggaactcgccgccgtcgtgggatctccgtgtccggccactgcgggtcgtgccggctcacccaccatctcctcggtcgtcgacgagccagtgaccaaggatctaggtgtttagcaggtttgctgagcaggagctcattgaaggaccgagagatgatgattgagccagtgatgtggtgccaaccacaagatgcagatggtggaaccaaggaaggatgaacttaactagtggatgctcgccgagcgagtatctccccagcaaacactttctaagtgtcaaattaaaggagaagaacaaatggtccaagaggagccgtacaatgaggagtacgagttgatctaggtggcatctcctagtgagctttgtggcgccaaagaataatacttagttc

SEQ ID NO: 57468 - protein, 40 aa, Zea mays
  misc_feature: Ceres CLONE 1505626
MNLTSGCSPSEYLPSKHFLSVKLKEKNKWSKRSRTMRSTS

SEQ ID NO: 57469 - DNA, 714 bp, Zea mays
  misc_feature: Ceres CLONE 1505634
  misc_feature (424)..(424): n is a, c, t, g, unknown, or other
atagctggagctccccgcggtggcggccgctctagaactagtggatcccccgggctgcaggaattcgcacgagaccattacctagaacatcctaatcgaaaatctaagaggctcagaccctcatcaccaactcccctccatctcgctcccggtcctcactctcctctccgcctcctccctcctctccctttcgaaaccccatcttcgttggcgtagggctcgggggttggagtttgggctcgggggttagagtttggaggaagcattcgtgaagactctgtggcgacttctccagatcggcagatccgtctttctgggcgatttggagcgaagcccccaagtagtttgttacagaaagcagcggcttttgcgtcgctcctgcgtcagtgtacctgttgacgtcgtcgttcctagcccccgaccntcggatcatatatatccagctaggaaaaagggcactttgcatttattctttggcccccctcggagatcgccctcctccagaattgggtgggaacccaattcgctgggaattcctgtggaagggccccccctttggttcttgtttccccaaggtcccaaactttctaataccaaaaccccttgttcatctaacggttcttggtttttacccaacccaaaataattggggggccctttgtttccccggaaggggttaagggttgccctctttcccggcccaaaaatgggggc

SEQ ID NO: 57470 - DNA, 634 bp, Zea mays
  misc_feature: Ceres CLONE 1505643
  misc_feature: Encodes the peptide sequence at SEQ ID NO. 57471
  misc_feature (418)..(418): n is a, c, t, g, unknown, or other
aaagctggagctccccgcggtggcggccgctctagaactagtggatcccccgggctgcaggaattcgcacgagaccattacctagaacatcctaatcgaaaaacttcgctctgtcctcccatgcgccggattaccactgaccacttcacagtcacagtagtacagagcagcagagtggagaagtagactctaggtgagatggcggccgtggtggcggcggtggaggcaggggtggtggcggtggcaagcgggaggggatgcagcagccggctggtgcggggcctctactggcgcctgcgcgcggttctgcggcggctgcggtcggagcgagccaggcgcggcaggaggttcagcttccactacgacgcgctcagctacgcgctcaacttcgacgacgggcgcgccgcccccgcccggncccccgcgcggccgacctcggtcttgcccccgcgacaacgacgcgctacggtgaaatcgcgtccggacgatccgctggcaggaggccagatggggtctctctttccttgctccggacgccgcttgcttttttccccccctccggggggccccccctttttccaaaaaaagggggtggggtaagggaaaaaaagaaaaaaggtcgggggggggttcc

SEQ ID NO: 57471 - protein, 133 aa, Zea mays
  misc_feature: Ceres CLONE 1505643
  misc_feature (74)..(74): Xaa is any aa, unknown, or other
MAAVVAAVEAGVVAVASGRGCSSRLVRGLYWRLRAVLRRLRSERARRGRRFSFHYDALSYALNFDDGRAAPARXPARPTSVLPPRQRRATVKSRPDDPLAGGQMGSLFPCSGRRLLFSPPPGGPPFFQKKGVG

SEQ ID NO: 57472 - DNA, 715 bp, Zea mays
  misc_feature: Ceres CLONE 1505657
  misc_feature: Encodes the peptide sequence at SEQ ID NO. 57473
  misc_feature (1)..(1): n is a, c, t, g, unknown, or other
  misc_feature (405)..(405): n is a, c, t, g, unknown, or other
  misc_feature (407)..(407): n is a, c, t, g, unknown, or other
  misc_feature (409)..(409): n is a, c, t, g, unknown, or other
  misc_feature (411)..(411): n is a, c, t, g, unknown, or other
nataagctggagctccccgcggtggcggccgctctagaactagtggatcccccgggctgcaggaattcgcacgagaccattacctagaacatcctaatcgaaaatccatttgtcctccaactatttcgccgcaaaggcctctagaagcaatcaggcgagcggcggctgcggcgcgatgggagagcaggtcgtgacggagcgtatccagcggaagctggaggaggccaacgctaccgtccaacagcacctcgccggcatccaggaccacgtcaacttcaccatgcagcaagcatacttcaagtgcgcatatgattgccttcgatcggcgccgtactcaggaagcgatcaacaattgtgtggagaattttgcccccccctgcccgggggggggggggggtttttganantnanatcccccacccccacgaacgggtgaaccgggctttgatgggctgtcaggataattttcaacctcccaacctccaaatgatgagaacagcatccacccctggaacgggaatcctggggcaacagcacctatcaatgacgccatgcaggcccctcccacaatgtgggcgaccccaaagaagagcagcccccccctactccgagagaagaggtctccccccctaccccagacgagcccacaaccaggttctgcataagggctactgtgtccaccctccaccggctagaccacttcccctatcccgcg

SEQ ID NO: 57473 - protein, 86 aa, Zea mays
  misc_feature: Ceres CLONE 1505657
  misc_feature (77)..(77): Xaa is any aa, unknown, or other
  misc_feature (78)..(78): Xaa is any aa, unknown, or other
  misc_feature (79)..(79): Xaa is any aa, unknown, or other
MGEQVVTERIQRKLEEANATVQQHLAGIQDHVNFTMQQAYFKCAYDCLRSAPYSGSDQQLCGEFCPPLPGGGGGFLXXXSPTPTNG

SEQ ID NO: 57474 - DNA, 686 bp, Zea mays
  misc_feature: Ceres CLONE 1505668
  misc_feature: Encodes the peptide sequence at SEQ ID NO. 57475
aaagctggagctccccgcggtggcggccgctctagaactagtggatcccccgggctgcaggaattcgcacgagaccattacctagaacatcctaatcgaaaaaacaacaacgcacgagacaaagggcctcacgctttccacatcgacacaaaaccaaccgccgccacctccatccgctcgcgctagctgtgtgcgtgccttgtctgccacaactccagcacttggagtcttcgaccacgacgacgacggcaggggaggagaaacaggcaggcgggtcatccatggagacggaggaagagacgacgcccaaggcgaagaagcggccgcagtcgctgctcgggagcctgcgggaggcgatcaccaaggtccggttcctgctcttctccagcgcgacgcggtggatgctgctcaggtccctggcccgcggcggcggcggcggcggcgccccggcgcggcgcctcagcttcgacgcgcggccgggcctgctcgacaccatcgccgcgtcgccggactcctcctcctgcagctccaggacctccaggtcggccagcctgggcacggcgaccacccggaccctgtcgcgggccagcagcgccgcgtcgccggaggccctgacgagggcctcgtcgtcgtccggcggccgctccccggcgtcgtcggccggggacgacgacgtcgaccagcgc

SEQ ID NO: 57475 - protein, 135 aa, Zea mays
  misc_feature: Ceres CLONE 1505668
METEEETTPKAKKRPQSLLGSLREAITKVRFLLFSSATRWMLLRSLARGGGGGGAPARRLSFDARPGLLDTIAASPDSSSCSSRTSRSASLGTATTRTLSRASSAASPEALTRASSSSGGRSPASSAGDDDVDQR

SEQ ID NO: 57476 - DNA, 605 bp, Zea mays
  misc_feature: Ceres CLONE 1505673
  misc_feature (229)..(229): n is a, c, t, g, unknown, or other
  misc_feature (248)..(248): n is a, c, t, g, unknown, or other
  misc_feature (249)..(249): n is a, c, t, g, unknown, or other
  misc_feature (250)..(250): n is a, c, t, g, unknown, or other
  misc_feature (251)..(251): n is a, c, t, g, unknown, or other
  misc_feature (252)..(252): n is a, c, t, g, unknown, or other
  misc_feature (253)..(253): n is a, c, t, g, unknown, or other
  misc_feature (260)..(260): n is a, c, t, g, unknown, or other
  misc_feature (261)..(261): n is a, c, t, g, unknown, or other
  misc_feature (262)..(262): n is a, c, t, g, unknown, or other
  misc_feature (263)..(263): n is a, c, t, g, unknown, or other
  misc_feature (264)..(264): n is a, c, t, g, unknown, or other
  misc_feature (265)..(265): n is a, c, t, g, unknown, or other
  misc_feature (266)..(266): n is a, c, t, g, unknown, or other
  misc_feature (267)..(267): n is a, c, t, g, unknown, or other
  misc_feature (268)..(268): n is a, c, t, g, unknown, or other
  misc_feature (269)..(269): n is a, c, t, g, unknown, or other
  misc_feature (270)..(270): n is a, c, t, g, unknown, or other
  misc_feature (271)..(271): n is a, c, t, g, unknown, or other
  misc_feature (272)..(272): n is a, c, t, g, unknown, or other
  misc_feature (273)..(273): n is a, c, t, g, unknown, or other
  misc_feature (274)..(274): n is a, c, t, g, unknown, or other
  misc_feature (275)..(275): n is a, c, t, g, unknown, or other
  misc_feature (276)..(276): n is a, c, t, g, unknown, or other
  misc_feature (277)..(277): n is a, c, t, g, unknown, or other
  misc_feature (278)..(278): n is a, c, t, g, unknown, or other
  misc_feature (279)..(279): n is a, c, t, g, unknown, or other
  misc_feature (280)..(280): n is a, c, t, g, unknown, or other
  misc_feature (281)..(281): n is a, c, t, g, unknown, or other
  misc_feature (282)..(282): n is a, c, t, g, unknown, or other
  misc_feature (283)..(283): n is a, c, t, g, unknown, or other
  misc_feature (284)..(284): n is a, c, t, g, unknown, or other
  misc_feature (285)..(285): n is a, c, t, g, unknown, or other
  misc_feature (286)..(286): n is a, c, t, g, unknown, or other
  misc_feature (287)..(287): n is a, c, t, g, unknown, or other
  misc_feature (288)..(288): n is a, c, t, g, unknown, or other
  misc_feature (289)..(289): n is a, c, t, g, unknown, or other
  misc_feature (290)..(290): n is a, c, t, g, unknown, or other
  misc_feature (291)..(291): n is a, c, t, g, unknown, or other
  misc_feature (292)..(292): n is a, c, t, g, unknown, or other
  misc_feature (293)..(293): n is a, c, t, g, unknown, or other
  misc_feature (294)..(294): n is a, c, t, g, unknown, or other
  misc_feature (295)..(295): n is a, c, t, g, unknown, or other
  misc_feature (296)..(296): n is a, c, t, g, unknown, or other
  misc_feature (297)..(297): n is a, c, t, g, unknown, or other
  misc_feature (298)..(298): n is a, c, t, g, unknown, or other
  misc_feature (299)..(299): n is a, c, t, g, unknown, or other
  misc_feature (300)..(300): n is a, c, t, g, unknown, or other
  misc_feature (301)..(301): n is a, c, t, g, unknown, or other
  misc_feature (303)..(303): n is a, c, t, g, unknown, or other
  misc_feature (304)..(304): n is a, c, t, g, unknown, or other
  misc_feature (305)..(305): n is a, c, t, g, unknown, or other
  misc_feature (306)..(306): n is a, c, t, g, unknown, or other
  misc_feature (307)..(307): n is a, c, t, g, unknown, or other
  misc_feature (308)..(308): n is a, c, t, g, unknown, or other
  misc_feature (309)..(309): n is a, c, t, g, unknown, or other
  misc_feature (310)..(310): n is a, c, t, g, unknown, or other
  misc_feature (311)..(311): n is a, c, t, g, unknown, or other
  misc_feature (312)..(312): n is a, c, t, g, unknown, or other
  misc_feature (313)..(313): n is a, c, t, g, unknown, or other
  misc_feature (314)..(314): n is a, c, t, g, unknown, or other
  misc_feature (315)..(315): n is a, c, t, g, unknown, or other
  misc_feature (316)..(316): n is a, c, t, g, unknown, or other
  misc_feature (317)..(317): n is a, c, t, g, unknown, or other
  misc_feature (318)..(318): n is a, c, t, g, unknown, or other
  misc_feature (319)..(319): n is a, c, t, g, unknown, or other
  misc_feature (320)..(320): n is a, c, t, g, unknown, or other
  misc_feature (321)..(321): n is a, c, t, g, unknown, or other
  misc_feature (322)..(322): n is a, c, t, g, unknown, or other
  misc_feature (323)..(323): n is a, c, t, g, unknown, or other
  misc_feature (324)..(324): n is a, c, t, g, unknown, or other
  misc_feature (325)..(325): n is a, c, t, g, unknown, or other
  misc_feature (326)..(326): n is a, c, t, g, unknown, or other
  misc_feature (327)..(327): n is a, c, t, g, unknown, or other
  misc_feature (328)..(328): n is a, c, t, g, unknown, or other
  misc_feature (329)..(329): n is a, c, t, g, unknown, or other
  misc_feature (330)..(330): n is a, c, t, g, unknown, or other
  misc_feature (331)..(331): n is a, c, t, g, unknown, or other
  misc_feature (332)..(332): n is a, c, t, g, unknown, or other
  misc_feature (333)..(333): n is a, c, t, g, unknown, or other
  misc_feature (334)..(334): n is a, c, t, g, unknown, or other
  misc_feature (335)..(335): n is a, c, t, g, unknown, or other
  misc_feature (336)..(336): n is a, c, t, g, unknown, or other
  misc_feature (337)..(337): n is a, c, t, g, unknown, or other
  misc_feature (338)..(338): n is a, c, t, g, unknown, or other
  misc_feature (339)..(339): n is a, c, t, g, unknown, or other
  misc_feature (340)..(340): n is a, c, t, g, unknown, or other
  misc_feature (341)..(341): n is a, c, t, g, unknown, or other
  misc_feature (342)..(342): n is a, c, t, g, unknown, or other
  misc_feature (343)..(343): n is a, c, t, g, unknown, or other
  misc_feature (344)..(344): n is a, c, t, g, unknown, or other
  misc_feature (345)..(345): n is a, c, t, g, unknown, or other
  misc_feature (346)..(346): n is a, c, t, g, unknown, or other
  misc_feature (347)..(347): n is a, c, t, g, unknown, or other
  misc_feature (348)..(348): n is a, c, t, g, unknown, or other
  misc_feature (349)..(349): n is a, c, t, g, unknown, or other
  misc_feature (350)..(350): n is a, c, t, g, unknown, or other
  misc_feature (351)..(351): n is a, c, t, g, unknown, or other
  misc_feature (352)..(352): n is a, c, t, g, unknown, or other
  misc_feature (353)..(353): n is a, c, t, g, unknown, or other
  misc_feature (354)..(354): n is a, c, t, g, unknown, or other
  misc_feature (355)..(355): n is a, c, t, g, unknown, or other
  misc_feature (356)..(356): n is a, c, t, g, unknown, or other
  misc_feature (357)..(357): n is a, c, t, g, unknown, or other
  misc_feature (358)..(358): n is a, c, t, g, unknown, or other
  misc_feature (359)..(359): n is a, c, t, g, unknown, or other
  misc_feature (360)..(360): n is a, c, t, g, unknown, or other
  misc_feature (361)..(361): n is a, c, t, g, unknown, or other
  misc_feature (362)..(362): n is a, c, t, g, unknown, or other
  misc_feature (363)..(363): n is a, c, t, g, unknown, or other
  misc_feature (364)..(364): n is a, c, t, g, unknown, or other
  misc_feature (365)..(365): n is a, c, t, g, unknown, or other
  misc_feature (366)..(366): n is a, c, t, g, unknown, or other
  misc_feature (367)..(367): n is a, c, t, g, unknown, or other
  misc_feature (368)..(368): n is a, c, t, g, unknown, or other
  misc_feature (369)..(369): n is a, c, t, g, unknown, or other
  misc_feature (370)..(370): n is a, c, t, g, unknown, or other
  misc_feature (371)..(371): n is a, c, t, g, unknown, or other
  misc_feature (372)..(372): n is a, c, t, g, unknown, or other
  misc_feature (373)..(373): n is a, c, t, g, unknown, or other
  misc_feature (374)..(374): n is a, c, t, g, unknown, or other
  misc_feature (375)..(375): n is a, c, t, g, unknown, or other
  misc_feature (376)..(376): n is a, c, t, g, unknown, or other
  misc_feature (377)..(377): n is a, c, t, g, unknown, or other
  misc_feature (378)..(378): n is a, c, t, g, unknown, or other
  misc_feature (379)..(379): n is a, c, t, g, unknown, or other
  misc_feature (380)..(380): n is a, c, t, g, unknown, or other
  misc_feature (381)..(381): n is a, c, t, g, unknown, or other
  misc_feature (382)..(382): n is a, c, t, g, unknown, or other
  misc_feature (383)..(383): n is a, c, t, g, unknown, or other
  misc_feature (384)..(384): n is a, c, t, g, unknown, or other
  misc_feature (385)..(385): n is a, c, t, g, unknown, or other
  misc_feature (386)..(386): n is a, c, t, g, unknown, or other
  misc_feature (387)..(387): n is a, c, t, g, unknown, or other
  misc_feature (388)..(388): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (392)..(392): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (409)..(409): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (435)..(435): n is a, c, t, g, unknown, or other
  misc_feature (451)..(451): n is a, c, t, g, unknown, or other
  misc_feature (456)..(456): n is a, c, t, g, unknown, or other
  misc_feature (457)..(457): n is a, c, t, g, unknown, or other
  misc_feature (458)..(458): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (462)..(462): n is a, c, t, g, unknown, or other
  misc_feature (463)..(463): n is a, c, t, g, unknown, or other
  misc_feature (466)..(466): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (499)..(499): n is a, c, t, g, unknown, or other
  misc_feature (500)..(500): n is a, c, t, g, unknown, or other
  misc_feature (531)..(531): n is a, c, t, g, unknown, or other
  misc_feature (535)..(535): n is a, c, t, g, unknown, or other
  misc_feature (605)..(605): n is a, c, t, g, unknown, or other
tccccgcggtggcggccgctctagaactagtggatcccccgggctgcaggaattcgcacgagaccattacctagaacatcctaatcgaaaatcctggacggttcggtgtataaagctccggcgactggtgcccaccacggctagctgccgtcgtcgcagaagtaggagctctcgtttctccatcagtagtgattgggcagcatcgtcatcgatcgatcgccatgagggnctccggcggcttggctggnnnnnncccccgnnnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccncccccccccccccccnnnnnnnnncncccccccccccccccnccggnnnnnnnnccnccccccccccccccccccccccnnnnnnnnncnnccccccccccccccccccccccccccccccncttnctttttttttttccccccccccccccccccccctttttttttttttttccctcccgcgggggggggggcn

SEQ ID NO: 57477 - DNA, 682 bp, Zea mays
  misc_feature: Ceres CLONE 1505679
  misc_feature: Encodes the peptide sequence at SEQ ID NO. 57478
caaagctggagctccccgcggtggcggccgctctagaactagtggatcccccgggctgcaggaattcgcacgagaccattacctagaacatcctaatcgaaaagattgcttgagcccatcggacggccgcgtggctcccaggagccctatatcaccatccttgcccaccgcctcccctcatcaccagcgtccgccaccgccgccgcctttcgtaccgcggcccctaaacccctttcctcgttcccctccgtctctcagttaggcacaatgatgctagctaataagcttggtggtctgctcaagaatgctacgagttcaaatatgtctgtctaccaagcaatcagatgcatgtcatcatccaagctttttgttggagggctttcttatggaaccgatgatcacagtctcagagacgagtttgccaaatatggacaagttattgaagctaagattatccttgatcgtgagtctgggaggtccagaggttttggctttataacttacacgtcttctgaggaggcttcggctgccatcactgccatggatggaaagactctggatggacggaacatacgggttaatcatgctaacgagaggacaggtggcttccgcagcagcggtggttatggtggtggcggctatagctggtggtggtcgtggctattggtggagctggctatgc

SEQ ID NO: 57478 - protein, 138 aa, Zea mays
  misc_feature: Ceres CLONE 1505679
  misc_feature (33)..(104): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MMLANKLGGLLKNATSSNMSVYQAIRCMSSSKLFVGGLSYGTDDHSLRDEFAKYGQVIEAKIILDRESGRSRGFGFITYTSSEEASAAITAMDGKTLDGRNIRVNHANERTGGFRSSGGYGGGGYSWWWSWLLVELAM

SEQ ID NO: 57479 - DNA, 699 bp, Zea mays
  misc_feature: Ceres CLONE 1505709
  misc_feature: Encodes the peptide sequence at SEQ ID NO. 57480
caaaagctggagctccccgcggtggcggccgctctagaactagtggatcccccgggctgcaggaattcgcacgagaccattacctagaacatcctaatcgaaaaattgttcgtgtcgtccgacttctttctctttctaacgcaatgtgaggcacctctgggacagtcgcgacaactcttcaagaaaatttgcttccgcccagctgactacacctccagctcaggctcagtgaaggatccatactacggaaccatcagtacatggcaccaacggagaggctatagtgctcctgcatcgcacatcatcactcagctgccgtgcgacaacccgctggctgagggcgatgacatgcactccaccatcctatgtcaccccgccgaggagcctagcctcacggagaggcaggtccacgtcgcgtcgtttaaggtgttcttgtgccagtactacgtagactggaggcggtggacctacatgaagaactgtagggccttcaatgcgaggaccacgggctgggtagtaaccgctgatgccaccatcaggggcgtgccattgcagaagtcatttccgcctgcctaagacataatggcattcaaaagatcatatgtggtgcctagagggcttttagacatggttactcctttatatataccttacatgacctgaatggctctcaagaatgtccttgatggagcgatggga

SEQ ID NO: 57480 - protein, 75 aa, Zea mays
  misc_feature: Ceres CLONE 1505709
MHSTILCHPAEEPSLTERQVHVASFKVFLCQYYVDWRRWTYMKNCRAFNARTTGWVVTADATIRGVPLQKSFPPA

SEQ ID NO: 57481 - DNA, 641 bp, Zea mays
  misc_feature: Ceres CLONE 1505719
  misc_feature: Encodes the peptide sequence at SEQ ID NO. 57482
  misc_feature (352)..(352): n is a, c, t, g, unknown, or other
  misc_feature (361)..(361): n is a, c, t, g, unknown, or other
  misc_feature (372)..(372): n is a, c, t, g, unknown, or other
  misc_feature (598)..(598): n is a, c, t, g, unknown, or other
  misc_feature (599)..(599): n is a, c, t, g, unknown, or other
aaagctggagctccccgcggtggcggccgctctagaactagtggatcccccgggctgcaggaattcgcacgagaccattacctagaacatcctaatcgaaaagatctgcgaaacaaacactagtgcgtttgcgagagaaaccgagaaagagaagctacagagtcactgaccgaccgctatggcatcgaggcagaacacgcgtgaggcgcgcgccgaggccgacgcgcggcgcgccgtggaggagctggctcgggcgcgggacgagcacctcgagaaggcggaggtgaacgcccgctcggccgcggacgagatcgcgcgctcccgcgccgaccgcggtgccgccggtggcgcngcatcctgnagagcgtgcangaagggccccaggtccttggccagcggcgtgggggcgcacccttccgtggcgccaaaggaccccacccgtggaacaaaaacctcccaaacgggcccaacccgggggggaaaaagctccggggaaaaaccgggggacttaccccccccaaaaaaaggcccccgggggggccaaaaaaaaaagagtttttcccggtttaaaaaaagggggggaaaaacacggcggggnnaggacccccccccccaaaaaaaaaaaagggggggggggataa

SEQ ID NO: 57482 - protein, 154 aa, Zea mays
  misc_feature: Ceres CLONE 1505719
  misc_feature (61)..(61): Xaa is any aa, unknown, or other
  misc_feature (65)..(65): Xaa is any aa, unknown, or other
  misc_feature (141)..(141): Xaa is any aa, unknown, or other
MASRQNTREARAEADARRAVEELARARDEHLEKAEVNARSAADEIARSRADRGAAGGAASXRACXKGPRSLASGVGAHPSVAPKDPTRGTKTSQTGPTRGGKSSGEKPGDLPPPKKGPRGGQKKKSFSRFKKRGGKTRRGXDPPPQKKKRGGGI

SEQ ID NO: 57483 - DNA, 672 bp, Zea mays
  misc_feature: Ceres CLONE 1505720
  misc_feature: Encodes the peptide sequence at SEQ ID NO. 57484
aaagctggagctccccgcggtggcggccgctctagaactagtggatcccccgggctgcaggaattcgcacgagaccattacctagaacatcctaatcgaaaaatcaagccagtacccagcaaatcacaaacagctaaaacgatctcagccttcacacacacacatccatcgttctaggcttctagctagttggagatggccggaggggatgacctgaagctgctcggcgcatggccaagcccgtttgttaccagggtgaagctggcgctcgccctgaagggcctgagctacgaggacgtggaggaggacctgtacaagaagagcgagcttctcctcaagtccaacccggtgcacaagaagatacccgtgctcatccacaatggcgccccggtctgcgagtccatgatcatcgtgcaatacatcgacgaagtgttcgccggcaccggcccgtcccttctcccagcggacccctacgagcgcgccgttgctcgcttttgggtgccctacgttgacgacaagctggtagccccatggaggcagtggttgaggggcaagacagaggaggagaaatccgagggaaagaagcaggcgttcgccgcggtggaggtcctcgaaggggccctgagggagtgctccaagggagggggcttcttcggcggcgacagcgtcgac

SEQ ID NO: 57484 - protein, 159 aa, Zea mays
  misc_feature: Ceres CLONE 1505720
  misc_feature (5)..(78): Pfam Name: GST_N Pfam Description: Glutathione S-transferase, N-terminal domain
  misc_feature: SWISSPROT Homolog: EC 4.4.1.5 Lactoylglutathione lyase
MAGGDDLKLLGAWPSPFVTRVKLALALKGLSYEDVEEDLYKKSELLLKSNPVHKKIPVLIHNGAPVCESMIIVQYIDEVFAGTGPSLLPADPYERAVARFWVPYVDDKLVAPWRQWLRGKTEEEKSEGKKQAFAAVEVLEGALRECSKGGGFFGGDSVD

SEQ ID NO: 57485 - DNA, 592 bp, Zea mays
  misc_feature: Ceres CLONE 1505756
  misc_feature: Encodes the peptide sequence at SEQ ID NO. 57486
  misc_feature (47)..(47): n is a, c, t, g, unknown, or other
  misc_feature (293)..(293): n is a, c, t, g, unknown, or other
tggagctccccgcggtggcggccgctctagaactagtggatcccccngggctgcaggaattcgcacgagaccattacctagaacatcctaatcgaaaaattactactccccagtcccactcccacccgcaggccgtgccgccccagaaaatctcacgcacagaaacaccaaagccccaaaggcccaaactcaccacctcccaatggagaacggcgacgaaaccctcgcctcccccactgccgccgtcgagacagacgcgctcaactgcggcgtcgctgaggacgagcaagtcnccatcacccaccccgcaaagtactacgtcactctcgccgacgacaaccccgctcctaacggtggcgttctgaaagaggaggagggcggtgcccacacaaccccgaactcctacccagttgtccccccccagccgagattgaggaccttcgcaccaccaagctctacatggaagagaaactcactgagggccgccctgaaaaaaagatcctcgcccaagaaaacccactccacccaggggaacttcaagccccgcccggaagaaggtcccctttgccaaagttccccccacctttgtcaa

SEQ ID NO: 57486 - protein, 130 aa, Zea mays
  misc_feature: Ceres CLONE 1505756
  misc_feature (31)..(31): Xaa is any aa, unknown, or other
MENGDETLASPTAAVETDALNCGVAEDEQVXITHPAKYYVTLADDNPAPNGGVLKEEEGGAHTTPNSYPVVPPQPRLRTFAPPSSTWKRNSLRAALKKRSSPKKTHSTQGNFKPRPEEGPLCQSSPHLCQ

SEQ ID NO: 57487 - DNA, 702 bp, Zea mays
  misc_feature: Ceres CLONE 1505766
  misc_feature: Encodes the peptide sequence at SEQ ID NO. 57488
aaagctggagctccccgcggtggcggccgctctagaactagtggatcccccgggctgcaggaattcgcacgagaccattacctagaacatcctaatcgaaaaataaaatccatttgattgctctatcctcttctctgttctcacccccttgctagcaacaatcgttcacacgattgatccaatgcgtcctgcatggaaattgccgccgtccacgcctcgagtggcgggcgccgcatcatgctggccgtggacgagagcgaggagagcctgcacgcgctcaactggtagactcccaacttcttctccccggcaggacgctacacgctagtgctcttcaacgcccgcacgccgggcccggtctacccctccatggactgcggagggtacatgacttactcggacgtgctgcctagtgttgagagacacgccaactcgatctcgccggcagcgagctatcaggccaagcctgtctgcaccgaccaccagcacgtcaaggtggacaccacggtggagagcatagacccgagggacctcatctgctacgacgccaacaatatggccgcggacctgctcatcatgaacagccatgattacgtcttcatccaaaggagcgtcttgtgcagcgtcatcagccactgcgcgcacaaatgcaaatgctcggtcctcattgtcatgaggcccacggagtataagcttcctcgc

SEQ ID NO: 57488 - protein, 111 aa, Zea mays
  misc_feature: Ceres CLONE 1505766
MDCGGYMTYSDVLPSVERHANSISPAASYQAKPVCTDHQHVKVDTTVESIDPRDLICYDANNMAADLLIMNSHDYVFIQRSVLCSVISHCAHKCKCSVLIVMRPTEYKLPR

SEQ ID NO: 57489 - DNA, 687 bp, Zea mays
  misc_feature: Ceres CLONE 1505772
  misc_feature: Encodes the peptide sequence at SEQ ID NO. 57490
aagctggagctccccgcggtggcggccgctctagaactagtggatcccccgggctgcaggaattcgcacgagaccattacctagaacatcctaatcgaaaactctctctcggtagtccgatccaccaaaccatgtcgggcagacaggtcggcggcggcgggctgcgacggtggagccctttctacgtgatccgcagcttcccgtcgacgcccgagtcgctaatgtcgcagatcgacgcggccatcgtctccaccgagtacgcccgcgcctgcgccctcctcgacccctcccaagtctcagcctcgtcgccgcccgagatcgatcccgaaggccagggggaccggggagcctcccctctgcctccggcctgctacgacgcgagggtcgcggacgacgcgtaccgcgcggcgtgcgcggcgctggcagcgggacggcccgacgccaccgtgcggtcgctgcgggcggcgctagcgagctgcccgccggacaaggccgcggctgtggccaaggagaggtccatgctggccatcgcgtcagcgcagctgcacaagcagcggcgccaggcccagcagcagaagagcaggaactgaggccgtcctacttcgccatagctgctgcaatctattgatgcaattattactgctatgttttattaggccatgatcagacgcatgaaacgttcaaata

SEQ ID NO: 57490 - protein, 152 aa, Zea mays
  misc_feature: Ceres CLONE 1505772
MSGRQVGGGGLRRWSPFYVIRSFPSTPESLMSQIDAAIVSTEYARACALLDPSQVSASSPPEIDPEGQGDRGASPLPPACYDARVADDAYRAACAALAAGRPDATVRSLRAALASCPPDKAAAVAKERSMLAIASAQLHKQRRQAQQQKSRN

SEQ ID NO: 57491 - DNA, 1134 bp, Zea mays
  misc_feature: Ceres CLONE 1505776
  misc_feature: Encodes the peptide sequence at SEQ ID NO. 57492
cccgagtccccgtgcgctgcgcccccaattcccacgcgcccagacacgccgagaggggagaggaagcgacagccagcagccgaggcggccagcgcaggcatggccactcccacttccagtggcgacggctcgcccccgggctcctctgacctcgtgcccccctcctaccccgagatgatcgtcgccgccctcgccgcgctcgccgaggagaacggctccagccaggccgccatcgcgcgccgcatcgaggcggaggcccgcggcgacctgccggcctcgcacccggcgctcgtcgcagcccacctctcgcccatgtccgccgccggggagctcgtcgccgttgcggggggaaagtacgcgctgccgccgccggtcccaccgccgccggagtcaccggctgacgacgaagaagacgactacgccgacgacgaagaggaggaggaggaggctccggagccggagcctctgccgcagccgcccgctaagcgcgggcgcgggaggcccccgaagccgcggcccacgggcttccccgccggcgtgcccggagctgctggcccgggccccatcggcgtccccggagccgccgccgccgccgccgcgccgcgccggcgcggccgcccgcccaagcctcgggacccgcacgcgccgcccaagattccgcgcccgcgtggccggccgcgcaagaacccgctcccggaggggatggccccgcggccgcgccccggcgcaccagcgtcggccaaggcggcgcgcccgcagttcgccgaggtcggcttcgtctgatgcggggaggtctcgcccgccggccagccggccagggggcggcggcgagctggcgcaagctaacattttgcccctgtgttccagctcttgtctgtttggtgtgggtttcgtctcagttcgtgtgttactgtctaatcccggggagcgtgtaggggcaggagtccgagtggaggcagcttcggcggcggtggccggcggtgtgtcagtggttcgtagtatttctctaccttacgtttgggggtggtggtggccggagtggtgttgctccggcgctgtattctgtgtctccttgtcgcgctcgcgcaatgcaatgcagtagtctgatcgttccatttaaaaaaaaaaaaaaaa

SEQ ID NO: 57492 - protein, 227 aa, Zea mays
  misc_feature: Ceres CLONE 1505776
  misc_feature (21)..(90): Pfam Name: Linker_histone Pfam Description: linker histone H1 and H5 family
MATPTSSGDGSPPGSSDLVPPSYPEMIVAALAALAEENGSSQAAIARRIEAEARGDLPASHPALVAAHLSPMSAAGELVAVAGGKYALPPPVPPPPESPADDEEDDYADDEEEEEEAPEPEPLPQPPAKRGRGRPPKPRPTGFPAGVPGAAGPGPIGVPGAAAAAAAPRRRGRPPKPRDPHAPPKIPRPRGRPRKNPLPEGMAPRPRPGAPASAKAARPQFAEVGFV

SEQ ID NO: 57493 - DNA, 632 bp, Zea mays
  misc_feature: Ceres CLONE 1505798
  misc_feature: Encodes the peptide sequence at SEQ ID NO. 57494
aaagctggagctccccgcggtggcggccgctctagaactagtggatcccccgggctgcaggaattcgcacgagaccattacctagaacatcctaatcgaaaagaagttagccatcagtacgcggacacgctccatcagcgtcaggccacagccaccatggtgaagctggcgactgctcgcgagtgccgcgcataagtctcggtggcagcgcgaggtccggacgcggttgcacaaccggagggagtacatcaacgccggggtgtacatcttagcggcggtcctcctggtcggcgggctcctggagcatctcctgccgtggagcgtgcccagcagcccggggctcgtggtcgcctcgatcggcctcgtcgagcttgctggccgtcaacacgcacgacctcctcgcgaacgccgccggactcgattaccgcctcgagatggtggtcggacttgacactcagatggggctcgtcgagctcggcgtccccgccgtgcagatcgttaggcacaagctcatgctcgtcgatggcgtcttctttgtgatcagatggagagaggctacggccacccctagccatggacggcctgaactttctcttaaccggcccggaacttgggtgccatgggactgtgca

SEQ ID NO: 57494 - protein, 66 aa, Zea mays
  misc_feature: Ceres CLONE 1505798
MVVGLDTQMGLVELGVPAVQIVRHKLMLVDGVFFVIRWREATATPSHGRPELSLNRPGTWVPWDCA

SEQ ID NO: 57495 - DNA, 706 bp, Zea mays
  misc_feature: Ceres CLONE 1505815
  misc_feature (288)..(288): n is a, c, t, g, unknown, or other
  misc_feature (334)..(334): n is a, c, t, g, unknown, or other
  misc_feature (335)..(335): n is a, c, t, g, unknown, or other
  misc_feature (361)..(361): n is a, c, t, g, unknown, or other
  misc_feature (486)..(486): n is a, c, t, g, unknown, or other
  misc_feature (525)..(525): n is a, c, t, g, unknown, or other
  misc_feature (552)..(552): n is a, c, t, g, unknown, or other
caaagctggagctccccgcggtggcggccgctctagaactagtggatcccccgggctgcaggaattcgcacgagaccattacctagaacatcctaatcgaaaaaacgcaaaaccacttttccttcacgcatcgcaacgcatctacacttcccaaaacgcagcagcacttctttcctccacttcccaaatcgcagaaggaccagggaacagaagagacccttcgttttcagtccggaactggcgagatcaatggacgccgccggggaggcctcgtcgccgtcgtccccngtcgaagctgcgggacaagctgcggaccacggtgtgctgttgttcnngcgcgggcggcggcccggagaggacnaaggtggcggcggcggggcgcggccgcggccgcgggcgagttccgctacgacgcgctcagctacgcgctcaacttcgacgaaggcgacgacgacgacgcgtacgcggaccccgccgcggtctccnggtacaggaactcaacgcgcgcctcccgtcctcgcgggnccgccgctgccgcggttggggaccaancgcaaaccaacacggccatcgcctagaacgttaaaacgggagggctctcttggatttttttgggcgaactttcggaatttttttggggccccccccttaacgggggcaattctcaaaaggggggaaaaagtttttaaacccccttggggacaaa

SEQ ID NO: 57496 - DNA, 568 bp, Zea mays
  misc_feature: Ceres CLONE 1505818
  misc_feature: Encodes the peptide sequence at SEQ ID NO. 57497
  misc_feature (271)..(271): n is a, c, t, g, unknown, or other
  misc_feature (284)..(284): n is a, c, t, g, unknown, or other
aaagctggagctccccgcggtggcggccgctctagaactagtggatcccccgggctgcaggaattcgcacgagaccattacctagaacatcctaatcgaaaaattttttcctttccatttctgttgctctcctctctttacccgtcgccgccctcgccctcgccaccacccgcacccgccgcgcggcccccattcgcctcgatttcgccggcgtcgatgtacggcaacgacaactggatcaacagctatctcgacgccatcctcgatgccngcaagggcgtcgncgccgacgccgacggcgccaccaggtgccgggactgatgctgggggcgggacccgacctggctgctcctccgaaagccggccacttttcccccgggggttaatttgcccaagaagggaaccccgggtaaaaaaagaccaccccttcaaaaccggccccgggaaccaaagaaaaagccccccccccggggcccaaaagggggggggaaaacccccccccatccaaaacccggggggcccgtcctcaaaccccataaacccccctgtggggggggaccccccgaaa

SEQ ID NO: 57497 - protein, 34 aa, Zea mays
  misc_feature: Ceres CLONE 1505818
  misc_feature (19)..(19): Xaa is any aa, unknown, or other
  misc_feature (23)..(23): Xaa is any aa, unknown, or other
MYGNDNWINSYLDAILDAXKGVXADADGATRCRD

SEQ ID NO: 57498 - DNA, 695 bp, Zea mays
  misc_feature: Ceres CLONE 1505831
catagctggagctccccgcggtggcggccgctctagaactagtggatcccccgggctgcaggaattctcaccagaccttgtacctacaacatcctagtcgaaacaccaggacattcgataagtataaatttgaatgatatttttggacaagcatatgtcaatgctagcggtcaaagatcaagtcaaacagggaattcaaataaccatactccatctgcttctttctcaactggtgctgctgttcctcctccctttgccttctcgagctcacgaaatgaatgaactcaggcacgccaagcttctaatggacttgaaggggaacatggtgaaccagccatacacaggcatgatgacgtccatataaatttggctggacccgagcaggctgccgaggctttgacagctgtgatgcatatgcttgggccacagatgggtcaacatgagggtgcacctagaggaccagcttaagcgtgcgaggtaggaaaatgtgttacctggcgtattgtggtctgcaggagtcttatacgggacattattttgtcttctccatcctgacgaagaatggagattctcgtgcgccttattattatagccgcttatctgtgtgctacaacaattccaccgtaatggttaccggcgttcaacttatctgccctgttcatattggcgtatgagtgtcattagctgtgctggag

SEQ ID NO: 57499 - DNA, 707 bp, Zea mays
  misc_feature: Ceres CLONE 1505856
  misc_feature: SWISSPROT Homolog: EC 6.1.1.3 Threonine--tRNA ligase
aaagctggagctccaccgcggtggcggccgctctagaactagtggatcccccgggctgcaggaattcgcacgagaccattacctagaacatcctaatcgaaaactacgagaccagagaagtatctaggtgaaattgaaacttggaacaaagcagaacaacaattgacagaagctttgaatgagtttgggaagccgtggaagattaatgaaggggatggtgctttctacggtccaaaaattgatattggtgtgtttgatgcccttaagaggaaatttcaatgtgcaaccttacagctggattttcagctgcccattcggttcaagctgacttattctgctgaggatgaagcaaaaattgaaaggcctgtgatgatacacagggcagagcctaggttctgttgaaaggatgtttgccattctttttggagcattacaatggcaaatgggcccttatggctaagccctcgccagggccattgtttgttcagtatcttcctgggtcagtggaatatgcgaaacaaggttctttgccatgctacctgaaagctgatttccatggtggatattggaaggtgagtggacagacaataccaaaagaaaggtccgggaagcccccaggtagcctccaattcaacctacctttctttgtcggaagggggccccaggagggcccaaaactgggaaaatggcctcccttttggggaaag

SEQ ID NO: 57500 - DNA, 437 bp, Zea mays
  misc_feature: Ceres CLONE 1505859
  misc_feature: Encodes the peptide sequence at SEQ ID NO. 57501
  misc_feature (220)..(220): n is a, c, t, g, unknown, or other
aaactggagctccccgcggtggcggccgctctagaactagtggatcccccgggctgcaggattcgcacgagaccattacctagaacatcctaatcgaaaacctccctgccgttccccttcttcagttctcccgctgctgctgccgctgccacccttcggtcgcgtcagatcgcacccatcgattgcgctcacatgcgcgggcggggcaaggcaaaggacnggaccctgcgctggcttcgtgctccgcctagggggggccaatttccagggggaaggttttggggtttcccccaaaattttttagggaccccccggggggggttttttaaaaaatggggaaccccgctttttaaaacccccggcggggtgtcccttccctggggagcgaaaaaccccccccccccctaaaatgggggaaaaaaaaatttcggggcccc

SEQ ID NO: 57501 - protein, 71 aa, Zea mays
  misc_feature: Ceres CLONE 1505859
  misc_feature (10)..(10): Xaa is any aa, unknown, or other
MRGRGKAKDXTLRWLRAPPRGGQFPGGRFWGFPQNFLGTPRGGFFKKWGTPLFKTPGGVSLPWGAKNPPPP

SEQ ID NO: 57502 - DNA, 738 bp, Zea mays
  misc_feature: Ceres CLONE 1505860
  misc_feature: Encodes the peptide sequence at SEQ ID NO. 57503
caagctggagctccccgcggtggcggccgctctagaactagtggatcccccgggctgcaggaattcgcacgagaccattacctagaacatcctaatcgaaaaagatcccctcacagtcatcctccacccaccccacccaccgcctccgcctctctctctttcgtttgttcgtctcggcttccggtcgccgattcttctctgcgcaaaagattcctggtggtggtgcccgtaccttgctccacgcctcgctcgcgtcgcgtgcatggggctggacgtcggcggcatcgggatgggcctggatctgggtctggacctcgggctgttcgccgcgcggagcgccggagggatggcggccgcggccaagggtgcgcctgcggatatcaactcctgcatcaagagtctcgaggaggagtgccccaagatctaggtgttcaggcgcgagctcccactctgcgtgcgtctcccccccgatggggagaagtggactcctggcgggcccttcatgaacttcttcctatcctaccctgtatacgcgccgcgcgcgaggttggggtggtagtctctttcttcggcccccgggttctgcttcaacccggaggcaggtgatgggtctgtgacgggtctggctcctctttccgatcacattgtaatggccttaacgcctcacccactcaaaagcgcggaagaaccacgggacaggcacaacgggactgaactaaccggaagaaatcacggctg

SEQ ID NO: 57503 - protein, 54 aa, Zea mays
  misc_feature: Ceres CLONE 1505860
MGLDVGGIGMGLDLGLDLGLFAARSAGGMAAAAKGAPADINSCIKSLEEECPKI

SEQ ID NO: 57504 - DNA, 629 bp, Zea mays
  misc_feature: Ceres CLONE 1505879
  misc_feature (158)..(158): n is a, c, t, g, unknown, or other
  misc_feature (252)..(252): n is a, c, t, g, unknown, or other
  misc_feature (406)..(406): n is a, c, t, g, unknown, or other
aaagctggagctcaccgcggtggcggccgctctagactagtggatcctcgggctgcaggaattcgcacgagaccattacctagaacatcctaatcgaaaactcactctcgtctcctgttcgccagagccacctcgctccagaagctttcctcccctanatctccctcccgtgcctggtcgcgctgccgacccggcctggcgacaaggggaactcggggactagtgtgggagcccgggtgcaggcggccgcancggtggctttcgtggccgcggcgccgtctcgatcccgccgtcggggcaggctcgggccgtggtgtcattcttctggccgctgctcgcctcccgggcctctttctgccccccggcggggggggggggggggaactcccccccctccccctgggcnacaacgaggaagtctggggggggagcttttcaacctccctcggccgggggccgcccgggagcccccccgtccccggatggcggcaccccccggcgggccgttttccccccggtggagggagccccccccccaccctgcaaagtctaccggggttcccccgccaagaaaggggccgccacccccgcgccaccagagccccgccagggacgggccggtcggcggg

SEQ ID NO: 57505 - DNA, 721 bp, Zea mays
  misc_feature: Ceres CLONE 1505883
  misc_feature (342)..(342): n is a, c, t, g, unknown, or other
  misc_feature (386)..(386): n is a, c, t, g, unknown, or other
aaagctggagctccccgcggtggcggccgctctagaactagtggatcccccgggctgcaggaattcgcacgagaccattacctagaacatcctaatcgaaaaagcgaaggcacagccgccgctgtttcttcatcttccttgcagcgccggcgctccatcttactctccctcccttactagcgcttgacacgcaggtgacggcggcagcgacggcgctcagactcgggcttttagtgacggcatcagcggtttcccctcccgcctcttgccagtcccatcgcgccctcgcctcgggtcctctgcacaccgtccagtgaccttgcgtgatggactgggataaangtttgcagcgattttacccgcagtgatgggaaacagcatgcatngcttgataaatctaatcaggaattgtccaagaagtctgtactaatggggtgatgggttttaaactggcagctgctgaaaatggatggggttgcaactggtcatcccttttgggacccgggggtagggacccccaatttccaaaaattccccagtgtccggcggggggaggaaataaatttcaaaacctggttggggctgggaaaacttttcacaaaaaaaaatggggcccaagttgaaatttttacccccctttttcctccggggaaccgttaaaaaaaaaggggtaaacagttttaaaaaaaccctttcccccaaaaaaaaacggtaaaaaaaa

SEQ ID NO: 57506 - DNA, 616 bp, Zea mays
  misc_feature: Ceres CLONE 1505889
aaagctggagctccccgcggtggcggccgctctagaactagtggatcccccgggctgcaggaattcgcacgagaccattacctagaacatcctaatcgaaaaattttcttctcctgcggtccttccttcgcttccccgttcttccagaatcctgtcgagacctgaatccaccctcacccagcggtccccatggcctccggcgaaggtgtagttgatcagctgtacgaggcggctggcggcgaggcgtggccaagatagagggggaggcaagtggagcggaggccagatggagacggagagcggtgctgtactcgactgacgagctacagctgcacgatctaagcgaggtggagatcccaccacgctgggagagggtcgacctcaccgcaacccgctctcttctgttgatcctcgcatcggccaactcccccatctcccgaagctctcttcccgccagaacctcctcaacaatgacgccttccgcccctcacgtcctgggaagctatttgcggggttaaaggaaattactactcgaaaccttgtatggccaaccccttttttgattggccctgaaccccgaagggggggaagccccattttgggcaattaaaagcct

SEQ ID NO: 57507 - DNA, 696 bp, Zea mays
  misc_feature: Ceres CLONE 1505891
  misc_feature: Encodes the peptide sequence at SEQ ID NO. 57508
aagctggagctccccgcggtggcggccgctctagaactagtggatcccccgggctgcaggaattcgcacgagaccattacctggaacatcctaatcgaaaagtaaaaaaaaaaccttgacaagaacgaattcgcctccggctctcctcttctcgagcgttttcggcaccacggcgcagtaggatggcggcggcggccccgacgagagcagaggtgctgtcgctcttccgttccttactccgcacggcgaagaagttctcggactacaacatccgcgagtacacgcgccgacgcgccgcggactccttccgcgaaaaccgcgccctcgccgatgcgtcggccgccgccgcggcgttctcggaggggaagagcacctacaggttgcgaggcggcaggcggtggtttactctctctacgccccccaggccaagagcgtgatggaagtgaaggtgcagtgatggctgcgaccttttcttccccacgttccgttccagatccgttgctttttggggatgatgaactataaaccggcccccttggcccattttctggataaatggcatgaaaaaatttccctcttggcgcaataattaaccaaatccacccgccaaaaaaaaaaaaaaaaaaggtttatccttcccgcccccctcggggggggggcccgggacccaaatttggccccaaagggaggcgtatg

SEQ ID NO: 57508 - protein, 84 aa, Zea mays
  misc_feature: Ceres CLONE 1505891
  misc_feature (6)..(72): Pfam Name: Complex1_LYR Pfam Description: Complex 1 protein (LYR family)
MAAAAPTRAEVLSLFRSLLRTAKKFSDYNIREYTRRRAADSFRENRALADASAAAAAFSEGKSTYRLRGGRRWFTLSTPPRPRA

SEQ ID NO: 57509 - DNA, 690 bp, Zea mays
  misc_feature: Ceres CLONE 1505901
  misc_feature: Encodes the peptide sequence at SEQ ID NO. 57510
  misc_feature (623)..(623): n is a, c, t, g, unknown, or other
aaagctggagctccccgcggtggcggccgctctagaactagtggatcccccgggctgcaggaattcgcacgagaccattacatagaacatcctaatcgaaaaaccacaactacatgtttctttaccctaacggcctaacctttctgctctagcgaaggcacagccgccgctgtttcttcatcttcctcgcagcgccggcgctccatcttactctccctcccttactagcgcttggcacgcaggtgacggctgcagcgacggcgttcaggctcgggctctcagtgacggcatcagcggcttcccctcccgcctcttgccagtcctatcgcgccctcgcctcgggtcctctgcacaccgtccagtgaccttgcgcgcgtcagtgatggactggataaagttttgcagcgattttaccgcaagtgatgggaaacagcatgcattgcttgataatcttaatcaggaattgtcccagaagtctgtactattgggtgatggttttaaactgtcagctgctgataatgatgtgtttgcaactgttcatccttttgtgatccgtgttagtgacagcgagttgcagaaatatccacatgtactgcggtggatggactacattcagaacactngtggtgctggtacaactttgcaaaagaaaatgtgaccaagtctgactttgatccaccttctcatcaa

SEQ ID NO: 57510 - protein, 91 aa, Zea mays
  misc_feature: Ceres CLONE 1505901
  misc_feature: SWISSPROT Homolog: EC 2.5.1.18 Glutathione transferase
  misc_feature (81)..(81): Xaa is any aa, unknown, or other
MDWIKFCSDFTASDGKQHALLDNLNQELSQKSVLLGDGFKLSAADNDVFATVHPFVIRVSDSELQKYPHVLRWMDYIQNTXGAGTTLQKKM

SEQ ID NO: 57511 - DNA, 711 bp, Zea mays
  misc_feature: Ceres CLONE 1505911
aaagctggagctccccgcggtggcggccgctctagaactagtggatcccccgggctgcaggaattcgcacgagaccattacctagaacatcctaatcgaaaaaacccaaacggaacgcccgaacgctgagggagagtgacactcactcctcttatcctcttcatcggcgaggcgtgcgaccgggcagcgtcgctggaccaacccctggcgaaagccagctccacagtccaccgcccgcgcgtctccgattaggagaatttggcgctgaagaaagaggacgagcgacttctctctgctctggtggagtgcaacttaatgacaaggttttgagcttgtgtctgaattccctgggatggatgccaagaacttactgcagatggtcgaattactataagaatagactccttgagaagaacgaagccccactgacatggctccagagactggaatcgggaattaaggtcactgatgacaacgagcaagaagctcatcgtctgcctgctgaggaggcgaagctattcttcctaacagactgatcttgaatcccagagcgacagagatcggaaaatcttgacgaggaaggaccgcacaaggcacaggatacttggccactctgctctctgatggtgccagatacgttcagcacaggtcaaatatgaagagcttgcactctactgatgagagccactgtgacgaacatgatgagctaac

SEQ ID NO: 57512 - DNA, 848 bp, Zea mays
  misc_feature: Ceres CLONE 1505911-R
cgattgggtaccgggccccccctcgaggtcgacggtatcgataagcttttttttttttttctttgctggagaaacatctggtgtcgccaaatttttcagtacaacaagtacaggcttcagaagtcgcagcagagccgagacagtaacattatgaaagatacatgctttcattcagcaactagccaactggggcaaaccttcccgtcacagagcccagtgatgacgccaatcaggttctgaggcattaacaacttacacgagttgcttcccgtcactgggttcagcagagttgccatggtgatcatgatggggatggtgatggcagaagtggtgccacaactagtgggatccctgaccagcggatcacacggccgggagatccggagcatcctctgactacgaaagaaaaagtgtccggtcacattaataggggtcggaaagatagagcttggcataatcacttgataggcgattcttctcctgcctcggatggaccttgtctccacatcggctctctctagattgtcggtgaccctggaggctccgtgagcggccgctcctggtagacagcgaatagacttgttagtccagaggctccaactgagacatattggtcacgcagaatagcagaacatgctaagccgggtttctggtcatcatcatcgggagcagattttgggagttcctagacctggtaacgtttatccctccttctttgaccagggcgggccaccaatggcccttacccaggagtggagctttttccctgggggccattaaaaggcgggactgggagaatggccaccccggggcccgtttgggtggggaaatacgaatattgtgggggg

SEQ ID NO: 57513 - DNA, 1294 bp, Zea mays
  misc_feature: Ceres CLONE 1505911-R2
  misc_feature (12)..(12): n is a, c, t, g, unknown, or other
  misc_feature (15)..(15): n is a, c, t, g, unknown, or other
  misc_feature (1039)..(1039): n is a, c, t, g, unknown, or other
tggtgtcgtttnccnaaaattaaaaatcaataccacataaataaaatctataaaatacattaaaacaaaaaccaaaaaagggatgatctggtgtcgccgatttttcagtacacaagtacaggcttcagaagtcgcagcagagccgagacagtaacattatgaaagaacatgctttcattcagcaactagccaactggggcaaaccttcccgtcacagagcccagtgatgacgccaatcaggttctgaggcattaacaacttacacgagttgcttcccgtcactgggttcagcagagttgccatggtgatcatgatggtgatggtgatggcggcggtaggtgccggcatttgtgagaccccttaccagtagacatcacgtctggcacaccaggagcaccctcatataaggacataaaaccgctcctgtgacgcttatagaggtcggaatcatatagcttgtcatcgtcacttaatctgtgaatcttcccatgccacctaacggatccatgtcctcggattcatcgatctaatgaattggtggctgaggccggcagggtatgtgctgcgggtcccccccctgttttaatacaccgcctccgcccattagttcatctcgcatggaaaatatgtaaattgcggcacaaactcctgggattattatgaaagaagttggtcagagtacaactagcgaaaacaccacccggaattctatcaaagagtccttttccaatgcccgatagggagaggagggcaagtcattacattatttaaacaaagtttcccgcgcttcagaagcacacactttggtgtattgacgtgtatattatggacttgtattaaacagaaatgaaatacgactgccctatatgtaaaagacagtaggaatctctagaggggcgcccattatccccgtaccggcgagagtctgtctcgtacgtgcccttctgcgcgagcacccaccgatgaagacaaaaagcggctcgtatataaatacgtccatcgactcgcaaaacagatccaagagccccacagataaganaatggagtaaaaaaaaatagagtatcacccaagcacttggcgggataacaggttaatctctgcccggggcggacaaaacgccccgctggtatgtgtcggtcggggaccatgttatccacggagaaaataaagcgggtgaacacctcgtagccgtggagcgggaacacaaatataatcggtccttaacagcctggggagccgcaaaaattaaaaacatcaatcgagcggtacatcccactgattgtaacgagaata

SEQ ID NO: 57514 - DNA, 521 bp, Zea mays
  misc_feature: Ceres CLONE 1505915
  misc_feature: Encodes the peptide sequence at SEQ ID NO. 57515
aaagctggagctccccgcggtggcggccgctctagaactagtggatcccccgggctgcaggaattcgcacgagaccattacctagaacatcctaatcgaaaaaaaacagagcatatattccctcttcactagctcgtggtaataagggaagcttgatcatctttccttatgggcgtgatgaagagcagcacaatcgtcgcgcttctattgggctgtgccattctgtcctcactgtctccatgctacgaagccgggcggctgcatcgggaaaccccaaaaattcccccgcccccccccaaaaaaggcaaaactttccggcccttttcccggggaccccccaaaaggccccccccaaattcccccctttgtttttaaacccccccggggttttcagaagagggggggtggtgggttaaaaaaaaagggtgggaaaaaaaaaagtgggccccccccccccccttaaaaaaaaaaaaaaaaccccccccttttttttttttgtcaagaaaaaaataaattacgcc

SEQ ID NO: 57515 - protein, 68 aa, Zea mays
  misc_feature: Ceres CLONE 1505915
MGVMKSSTIVALLLGCAILSSLSPCYEAGRLHRETPKIPPPPPKKGKTFRPFSRGPPKRPPPNSPLCF

SEQ ID NO: 57516 - DNA, 683 bp, Zea mays
  misc_feature: Ceres CLONE 1506105
  misc_feature: Encodes the peptide sequence at SEQ ID NO. 57517
  misc_feature (1)..(1): n is a, c, t, g, unknown, or other
naaagctggagctccccgcggtggcggccgctctagaactagtggatcccccgggctgcaggaattcgcacgagaccattacctagaacatcctaatcgaaaagctcgcggagccgtggcgcatcgcgactcaggcactcaccgaccgcggatatggccccgccgccatggcctctccttgcgacttccctcctcctcatcctattccaccactcgcctcgcgccgcggtggcgtttccgccgtctctgggcgccgcccgcgcgccgggtttcgcggcttggctgcgcggcttgcggcgccgcatccacgagcgccccgagctcgccttccaggaataccgcacgagcgagctcgtccgcgacgagctcgacgcgatcggggtgccgtacgtgtggcccgtcgcgcagacgggcgtcgtggcgaccatcgccggcggcagcgatggccccgtcgtcgcgctccgagccgacatggacgcgctacccttgcaggaattggtagactgggaacacaagagcaaggagaatggaaagatgcatgcttgtggacatgatgctcacacaacgatgcttcttggggcagctaaattgcttcatgctcggaaggatgatctgaagggtaccgtgaagcttgtcttccagccaggcgaagaaggctacggcggcgcttaccatgttctcag

SEQ ID NO: 57517 - protein, 176 aa, Zea mays
  misc_feature: Ceres CLONE 1506105
  misc_feature: SWISSPROT Homolog: EC 3.5.1.14 Aminoacylase
MAPPPWPLLATSLLLILFHHSPRAAVAFPPSLGAARAPGFAAWLRGLRRRIHERPELAFQEYRTSELVRDELDAIGVPYVWPVAQTGVVATIAGGSDGPVVALRADMDALPLQELVDWEHKSKENGKMHACGHDAHTTMLLGAAKLLHARKDDLKGTVKLVFQPGEEGYGGAYHVL

SEQ ID NO: 57518 - DNA, 687 bp, Zea mays
  misc_feature: Ceres CLONE 1506112
  misc_feature: Encodes the peptide sequence at SEQ ID NO. 57519
aagctggagctccccgcggtggcggccgctctagaactagtggatcccccgggctgcaggaattcgcacgagaccattacctagaacatcctaatcgaaaaaatctcttgtctcttgcacatcccccagcttcattcatggccgtttctcccctgctgatccgtgctacccagattgcgttgtggctgcttggcgccagatctacctatccaccgcaccaaagtactccacagcgcgcgcttacaatggcggtcgccgccgctcaccttcttcttcgcgtcgtcctcctcgctctcctcgcagacgcactgaaagtcgtcacggaagagcgacctagctgtctctgcgggagttagatggacgacgaaggagtgccactaccacagatacccgaagcaccccctactacgtatacacgatgctcgctaaatcgctagagtgagcacatgaaagctggggaagcaacaagcatgctagagatcaagcgccactccctcactgccgtcgctgaatacctcgtcgaccgcgagcgctacatccgccgtatcatctatgcgacgagtagagcgacactacttacagccaccgcgtaacacgataggcgatgacttgcatgaagtacgactcagctcacgttcctgtgactacggcatcctggtccagactctaactacgtcacagcatcac

SEQ ID NO: 57519 - protein, 48 aa, Zea mays
  misc_feature: Ceres CLONE 1506112
MKAGEATSMLEIKRHSLTAVAEYLVDRERYIRRIIYATSRATLLTATA

SEQ ID NO: 57520 - DNA, 683 bp, Zea mays
  misc_feature: Ceres CLONE 1506116
  misc_feature: Encodes the peptide sequence at SEQ ID NO. 57521
caaagctggagctccccgcggtggcggccgctctagaactagtggatcccccgggctgcaggaattcgcacgagaccattacctagaacatcctaatcgaaaaaaatcccaacgatcccccaaccttcgcgacgcgcacaccagctcgccgtcggacgcaagcgctcacaggctgctgctgctccgtctcccgggcgccaactctgactccgtacgcgttacgtgaaggcatccatggcacgcgtgctctgctcccggtcagcggtcctggcgcgccgcctcggggcccagccccagccccagcccggcgtggttctgagccgccggcacaaccacactcgccggcgcgcggtgaaggttcttgaagaggacgccgcggggccttcttcacctgcgacggacgcctccgagcagtcccggcggttggaggaggcgatcgacagcgccatggcgcggatggccgagcccgactgggcgcccttccggcccgggacatcctacttcgctccgccccggcccgccggcgcggccctgggggttctcgcgcttatcggccacgctggcgggttcatgggctcctcggcagcgccgaggcggggactctctgccgacgaggcccgcgccgtcgccgcctcctcccgcggttacccgtgctcgacctatttcatcgaaggctgctttcc

SEQ ID NO: 57521 - protein, 149 aa, Zea mays
  misc_feature: Ceres CLONE 1506116
MARVLCSRSAVLARRLGAQPQPQPGVVLSRRHNHTRRRAVKVLEEDAAGPSSPATDASEQSRRLEEAIDSAMARMAEPDWAPFRPGTSYFAPPRPAGAALGVLALIGHAGGFMGSSAAPRRGLSADEARAVAASSRGYPCSTYFIEGCF

SEQ ID NO: 57522 - DNA, 699 bp, Zea mays
  misc_feature: Ceres CLONE 1506120
  misc_feature: Encodes the peptide sequence at SEQ ID NO. 57523
  misc_feature (551)..(551): n is a, c, t, g, unknown, or other
  misc_feature (699)..(699): n is a, c, t, g, unknown, or other
acagctggagctccccgcggtggcggccgctctagaactagtggatcccccgggctgcaggaattcgcacgagaccattacctagaacatcctaatcgaaaaacctccatccagctcgagccagcccgccgcctgcgcgcatctctctacacttctactgcttcatactctcgtagagagatcccgcgcggcccaataaaaacccgactcgctagctacactacacactcgcagatggccggcctcaggatgaagttcgtcgccgtcgccgccatggccgccgcgctcgtggcgtccgccgcagccgccgaggcccccgccccggcccccgcctccgacgccgcggccgccgtgcccctcgccgcggcctccctcgccgccggcgccttcggctacctcttctgctagatccgcgctggacgcgtggtttgtgcttgatttgtgattcgtctggcgcgagtggagtccgtgtcgtgcgcgtgtctgtgtgagttgtttcggcgggcgtgtgtctgtatgtatggagtcggcggcggaggaggaggtgtgcncgtggtggtacctgcgtcaacgctcctttgtttgtggcggcgatcatgtgcctggccccgttttcgggttatcaatgaaatgatttatttggattcaaaaaaaaaaaaaaaaaagtttatcaatcccgccgaccccgaagggggggcn

SEQ ID NO: 57523 - protein, 57 aa, Zea mays
  misc_feature: Ceres CLONE 1506120
MAGLRMKFVAVAAMAAALVASAAAAEAPAPAPASDAAAAVPLAAASLAAGAFGYLFC

SEQ ID NO: 57524 - DNA, 699 bp, Zea mays
  misc_feature: Ceres CLONE 1506126
  misc_feature: Encodes the peptide sequence at SEQ ID NO. 57525
catagctggagctcaccgcggtggcggccgctctagaactagtggatcccccgggctgcaggaattcgcacgagaccattacctagaacatcctaatcgaaaagaggtggacggactttcggattcggaggtgatctgacctgtgaggggctgaggaggaggaggaggaggaggagggatggggcggcggcagaagcagcaggctttgatggcggcattcgcgttggcgctgctcatgggcaccgccgtctacttccgcatctgggcccgccagtccagcgacccctacttcaccgctgacgaccgctaggagctcccgaggcaatttgaacaagcaaacctataagccatggatcaatctgcctaatggaggatgcaatatgacaaagaagtagagaaaaacaggcacttgcatgatgagctttcaaaggttaaggcctcattagctggcacagcccggcgtcttgagttgttgcagaaggataacgagttgcagaagcggcagactgaatcgctgaggcagcaatgcaattgcactctccattgaaagctatgcaagattaagggcatggaaggagtttttcagcttctttggcggattagctaactttttttcctacacccagggaggaaaaccagatcgagttctaggattgagaactggcatatgataatgattgagaacatatatagtggcta

SEQ ID NO: 57525 - protein, 43 aa, Zea mays
  misc_feature: Ceres CLONE 1506126
MGRRQKQQALMAAFALALLMGTAVYFRIWARQSSDPYFTADDR

SEQ ID NO: 57526 - DNA, 677 bp, Zea mays
  misc_feature: Ceres CLONE 1506160
  misc_feature: Encodes the peptide sequence at SEQ ID NO. 57527
  misc_feature (625)..(625): n is a, c, t, g, unknown, or other
  misc_feature (626)..(626): n is a, c, t, g, unknown, or other
ctggagctccccgcggtggcggccgctctagaactagtggatcccccgggctgcaggaattcgcacgagaccattacctagaacatcctaatcgaaaagatgcggtcaccagtcgaatggacggcgcggatatcccctcccactccgccgccgatggcgaccggcctccggagaacgcggacgacggcggcgtggaggacgagcgtgccgccgcgccccctccagagcggtgcggggcgttggcttccgcaatcgcaggggtgctggccggcgcgctgcgggagcacgaggagcgggcggccgccaccgcccggagccaggacgaggtcgccgctgccatcgaccgcctcaacggagagctagacaggctattagagaatgcacccacaatggtaataatgcatcattcagcaaggatttccagcatccgcaagaggatttcagcaatgaacatgctgctcaagtccatacaacgacgcatagatagcatggatagaattatttctactgaccattcatctcctgtacagaaagccggtaatgaagttggaacaaggttctagcagaattctggtggtgtcccatcaattgcgcaccatttctgttttggtagagctgccatccnnacatcacacggtgctgtgcatagaagtgagacgtcataatgtcgatttttc

SEQ ID NO: 57527 - protein, 148 aa, Zea mays
  misc_feature: Ceres CLONE 1506160
MDGADIPSHSAADGDRPPENADDGGVEDERAAAPPPERCGALASAIAGVLAGALREHEERAAATARSQDEVAAAIDRLNGELDRLLENAPTMVIMHHSARISSIRKRISAMNMLLKSIQRRIDSMDRIISTDHSSPVQKAGNEVGTRF

SEQ ID NO: 57528 - DNA, 657 bp, Zea mays
  misc_feature: Ceres CLONE 1506165
  misc_feature (199)..(199): n is a, c, t, g, unknown, or other
  misc_feature (200)..(200): n is a, c, t, g, unknown, or other
  misc_feature (226)..(226): n is a, c, t, g, unknown, or other
  misc_feature (238)..(238): n is a, c, t, g, unknown, or other
  misc_feature (257)..(257): n is a, c, t, g, unknown, or other
  misc_feature (261)..(261): n is a, c, t, g, unknown, or other
tggagctcaccgcggtggcggccgctctataactagtggatcccccgggctgcaggaattcgcacgagaccattacctagaacatcctaatcgaaaaaaaacaaggagcgctacatccaggccagcagtttccatttgcaatccgaccccatcttcatcccgttgtcgcagcagcagccatccaagcagcgatgggacnnggcggcaagaaagagccggaaacccngcacaagggctnctccgcggaaactaaccgncagncggacccgcaaagtccaggcccttccgggggatgaagcggcaacccccaagaaggggcggggccctccgggggggcaaagtttcaccctggggaggggcgcccaacgactaacggttaacggttacccccgaaagaaagaaaccttcgggcctccctctccccaagaagaagggggaaaatttcaaaaagggggaaagcgcccttaagccccagggggtcccacgggggaagagggccccccccccccccccttttaaaaaaggggcccacccccacccaaggtttgaggccccccctccgcgcgcgccctctctgggggattctcccccccccccccccccccgcgggggggccccccccgccaacgtctttaataaaacggagcccccccaaaa

SEQ ID NO: 57529 - DNA, 735 bp, Zea mays
  misc_feature: Ceres CLONE 1506168
  misc_feature (219)..(219): n is a, c, t, g, unknown, or other
  misc_feature (230)..(230): n is a, c, t, g, unknown, or other
  misc_feature (231)..(231): n is a, c, t, g, unknown, or other
  misc_feature (266)..(266): n is a, c, t, g, unknown, or other
  misc_feature (735)..(735): n is a, c, t, g, unknown, or other
caagctggagctcaccgcggtggcggccgctctagaactagtggatcccccgggctgcaggaattcgcacgagaccattacctagaacatcctaatcgaaaaattgattgatcggacggacgcgcgtctccggtcccgtccgtaataacactgatccgatccacgccggccggcgatggagctcatcaagtccagggcgaccgtgtgcgcgctcctccntgggcgccttnngctcccttggctctcacacctaacgaacggggggnggggggtgtttttttgtgttttcttttttcctactccgttttcctctcctctcataacatatcgcataaaaaataagcatataaaaaaaaaattattgtcagaggtcggagacaaacacaattcctaataaatggaagccaaaaaaccaattaccctctccatcaatgaagagttagtaaattttttataatgattaatatcttctctatattattattttgagtcaacatagataaactacttcgctttaacactctatctttactctcccatcctttcatcagttaataacgcccttttcctcaactttcaatacctcttatcactacttctctcttatcacttaatgctctcctccccttccgcgtgacataaaacataaaatatgaactaaacttgtcacttattatgctatgaagcgtagaaggtgaagacacactctacgtgtgtcgcgcggtcttcgttgtn

SEQ ID NO: 57530 - DNA, 829 bp, Zea mays
  misc_feature: Ceres CLONE 1506182
  misc_feature: Encodes the peptide sequence at SEQ ID NO. 57531
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (542)..(542): n is a, c, t, g, unknown, or other
gaggggaaagcaaattataaaaagacaggggtgcnnnggccccagccagaaaactggagctccccgcggtggaggccgctctttactagtggatcccccgggctgcaggaattcgcacgagaccattacctagaacatcctaatcgaaaaaccacactctcaagtcccaactcccaacattacgagacgcctcgccggccgcgccgcgcccaactcctctgatcctcttccttgtccccaccctcttctccgatggcgacgctgcagctcaaccacatcgcgcgggagaccttcgacgtggcccgactcgccgccttctaacgaggccgtgctggggttcgagcgcatcccttcgcccacctactcgggcttccaagtcgcatggttccgcctcccgagctcccccgacgtcgggctccacctcatggagaggaaacccgccacggcacccgtcggcggttgggcccccaccccttcaccaaccatcacaactgcacccgagcgccaccaaccatcgcctttctccgttcggctgaataacnaaaggagttccgcgacccagggattaaaagggaaatgcgggtcaccgaatcctgtcccgaaaaaagccgcattcccggaatgggacgcatcgcctcccagggtctttgccttccttccaccccgggaacggcaatgggaccctaaaacatgtaactacacccctgctgggctttgggaattgtaaagagctgaaacacaagaaccgtggatatttgcacaatcataacttcctgtgcttaaaacaggtgaaaatacccttaggcaaacccccctgctctaaaaggaa

SEQ ID NO: 57531 - protein, 100 aa, Zea mays
  misc_feature: Ceres CLONE 1506182
  misc_feature (40)..(40): Xaa is any aa, unknown, or other
MERKPATAPVGGWAPTPSPTITTAPERHQPSPFSVRLNNXRSSATQGLKGKCGSPNPVPKKAAFPEWDASPPRVFAFLPPRERQWDPKTCNYTPAGLWEL

SEQ ID NO: 57532 - DNA, 668 bp, Zea mays
  misc_feature: Ceres CLONE 1506183
  misc_feature: Encodes the peptide sequence at SEQ ID NO. 57533
  misc_feature (668)..(668): n is a, c, t, g, unknown, or other
gcggtggcggccgctctataactagtggatcccccgggctgcaggaattcgcacgagaccattacctagaacatcctaatcgaaaaaaaaaaagttggccgcagcgccgcccttcagacccttctcttcatcttcactctcctggtttattcctccgtgccgatctcgtcttctccggcgggaccatggcgccgtcctcctcccgattcgacgatccggcggcggtgaggcgcccccccgcagcatgaacggaagccgccgtatatgttgcttctcccgctcgtctacgcccccgtcctccccctcatcaggatcgggctgcggcacaatcccgtagtgagggaccgtctcttctacggcgtcctcgccggcgcattcgcccacggcgcctacctcatatcgcaactgtatgatgtggagagcaaatgatgggcatccctcgaaggatgaggggataagttttcaggtagcaaaatttgattccatcgggattccagattgttggatgagagctgacatggcaattcagactaactagtgtgctatgtacccatatgttttctttggtcttgctattatgtttggcaaaaggatggaatggttgagcaaataaagtaattccagattgagaaacaaaaaaaaaaaaaaaaaagcttatcgataccgtn

SEQ ID NO: 57533 - protein, 54 aa, Zea mays
  misc_feature: Ceres CLONE 1506183
MLLLPLVYAPVLPLIRIGLRHNPVVRDRLFYGVLAGAFAHGAYLISQLYDVESK

SEQ ID NO: 57534 - DNA, 801 bp, Zea mays
  misc_feature: Ceres CLONE 1506184
  misc_feature: Translation starting site: 221
  misc_feature (34)..(34): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (801)..(801): n is a, c, t, g, unknown, or other
ttgttgcggcgcccctgtccccagccccccgctntttttattttnnnnnnnaaaagctggagctccccgcggtggcggccgctctagaactagtggatcccccgggctgcaggaattcgcacgagaccattacctagaacatcctaatcgaaaagttttccccgccgccgcctccaagcgcccccgcgagccagctccggcgaagtcgacagcaccaagcatggcggacacgaaggcgtcacccgcggtgacgctccgcacgcgcaagttcatgaccaaccgcctcctctcccgcaagcagttcgtgctcgaggttctccaccccggccgcgccaacgtctctaaggcggagctcaaggagaggctggctaagatgtacgaggtgaaggatcccaactgcatcttcgtcttcaagttccgcacccacttcggaggcggcaagtctaccggattcggtctcatctaggacaaccccccactcaccccaaaaagttcgaagccaagtacaggccttatcaaggaacggtcttggctacccaaggtggaagaaatccccccacgcagaatgaaggaaaagggaaaaacagggcccaaaaaaagatcccgcggtggggaaagaaaaacaaagggttggggcgacgcccaagaaagaaaatggagccaagggttttccagtggaacttttagcccgtccttggagtttcaaagaaaaccccctgggttcgcccggataaaaaaatttttgtgaaccccccttggtccgccaattggcttttgaaacccaaaaaaaaaaaaaaattn

SEQ ID NO: 57535 - DNA, 798 bp, Zea mays
  misc_feature: Ceres CLONE 1506198
  misc_feature: Encodes the peptide sequence at SEQ ID NO. 57536
  misc_feature (13)..(13): n is a, c, t, g, unknown, or other
  misc_feature (39)..(39): n is a, c, t, g, unknown, or other
  misc_feature (44)..(44): n is a, c, t, g, unknown, or other
  misc_feature (45)..(45): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (327)..(327): n is a, c, t, g, unknown, or other
  misc_feature (384)..(384): n is a, c, t, g, unknown, or other
  misc_feature (386)..(386): n is a, c, t, g, unknown, or other
  misc_feature (387)..(387): n is a, c, t, g, unknown, or other
  misc_feature (398)..(398): n is a, c, t, g, unknown, or other
  misc_feature (422)..(422): n is a, c, t, g, unknown, or other
  misc_feature (447)..(447): n is a, c, t, g, unknown, or other
  misc_feature (448)..(448): n is a, c, t, g, unknown, or other
  misc_feature (450)..(450): n is a, c, t, g, unknown, or other
  misc_feature (486)..(486): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (532)..(532): n is a, c, t, g, unknown, or other
  misc_feature (559)..(559): n is a, c, t, g, unknown, or other
  misc_feature (718)..(718): n is a, c, t, g, unknown, or other
taataagaaaccncccccacaaccaaaagaggagtgganccccnncnnnnaataactggagctccccgcggtggcggacgctctaaaatagtggatcccccgggctgcaggaatgcgcacgagaccattacctagaaatcctaatcgaaaaatttccccgccgcctccagatcacgactctgtccttcccaattctcaggcaaccccgtcgtcttccgccatgatccggttcatcctgctgcagaaccggcaggggaaaacacggctggccaagtactatgtcgctctcgaggactccgagaagcacaaggttgagtacgaggtggntcggctcgtggtcaaccgggaccccaagttcaccaacttcgtcgagttccgttggcncnnagttatatatnggagatatgcaggacttttttttntgtttttgagggggcgtcacccgannangagttggggtgggttgtgatgcacccccaccccccntcgaacatttcggacacattccgtcannnatggtgggatgaacctngaatgaaggcttggagtttccaacaangggttgagcagagagattgcgatggacgaggcatccataggagacgagccgtcgctgcaaaggcggcgaagaggggcgaatgcagacgcacacgagatggggaaaggggtcgtcaacgcttggcgcgggcggagaggaagagggagggaaggagggcgncgcaaggaggccacctggagcgcgggaagaggcccagagccgcggtggccggggccgaaagacgcaagtacacctcagca

SEQ ID NO: 57536 - protein, 82 aa, Zea mays
  misc_feature: Ceres CLONE 1506198
  misc_feature (1)..(83): Pfam Name: Clat_adaptor_s Pfam Description: Clathrin adaptor complex small chain
  misc_feature (36)..(36): Xaa is any aa, unknown, or other
  misc_feature (55)..(55): Xaa is any aa, unknown, or other
  misc_feature (56)..(56): Xaa is any aa, unknown, or other
  misc_feature (60)..(60): Xaa is any aa, unknown, or other
  misc_feature (68)..(68): Xaa is any aa, unknown, or other
  misc_feature (76)..(76): Xaa is any aa, unknown, or other
  misc_feature (77)..(77): Xaa is any aa, unknown, or other
MIRFILLQNRQGKTRLAKYYVALEDSEKHKVEYEVXRLVVNRDPKFTNFVEFRWXXVIYXRYAGLFFXFLRGRHPXXSWGGL

SEQ ID NO: 57537 - DNA, 671 bp, Zea mays
  misc_feature: Ceres CLONE 1506202
  misc_feature: Encodes the peptide sequence at SEQ ID NO. 57538
agtggatcccccgggctgcaggaattcgcacgagaccattacctagaacatcctaaccgaaaaaaaccataagagcttctgagtctagacactagatacagtaagccttagcaccaacagaggttagtatctcaacaaggatacttcaaatatgtccgcctcacgcagctcctctcccaactccatctcacagtggagccagaaagagaacaagatgtttgaagaggcactcgcatactacggcgagggcacatccaaccggtgggacaaggtgtccagagccatgggaggcatcaagtctgctgaggaggtgcgctgccactatgaagatcttgactatgacgtcaagatgattgaatcaggccacgtgccgtaccccaagtaccaccacatatggattctggacctgaggttgaaatgttggagggctcaaggaggcagaaaacaaagctctatgaatctaaaatggacctaggttctagaaggaagcaaagaaatccagccttggttggaaaataaattgatgaaacagtgtcgctatgtatagaataggttatgagcaagttaatgtttaccgtgcggctggtaggatctagcggaccttcacaaactggaggatttctttattcccctgaaccaaattaagggaagatgtaaacttcatggattta

SEQ ID NO: 57538 - protein, 86 aa, Zea mays
  misc_feature: Ceres CLONE 1506202
MFEEALAYYGEGTSNRWDKVSRAMGGIKSAEEVRCHYEDLDYDVKMIESGHVPYPKYHHIWILDLRLKCWRAQGGRKQSSMNLKWT

SEQ ID NO: 57539 - DNA, 694 bp, Zea mays
  misc_feature: Ceres CLONE 1506206
  misc_feature: Encodes the peptide sequence at SEQ ID NO. 57540
ctggagctccccgcggtggcggccgctctagaactagtggatcccccgggctgcaggaattcgcacgagaccattacctagaacatcctaatcgaaaaatccacgtgccgccgcaccggccaaccccgcgcccctcgaccgtctccgtcgccgcgccacccgcaccgggacccagtatggccgcctccggcgcatatccgggcacggcgttcaagatactcctctcctgccccgacggcctccctcgctcccgcgtttcggtgaagtttggtcggtcattcgacaggattccccatcctgatgcagccttggaggaatctataagtgaggtgtgggaccaaagccttcagcggaacccatatctatacagcggtacaaagtttcggtatggaggaaatgccttgcactacaaagatgactcagatcatgatcttgagtactgtgtctcacttcattgggtctcccagactacaggaaatttgggggaccaatctccatcattgggggaatttttttgggtccatccgaaaatagatctggactttgccaactttgccaaaatgcttgggaaatgggggtttattaaaacctttgaaaaaaaatttttgttttgcaaaggaccccagggggggaaattccaaaaacttgttttcccgggaaaaaccccgacccccaaaatattggaatttggggt

SEQ ID NO: 57540 - protein, 172 aa, Zea mays
  misc_feature: Ceres CLONE 1506206
MAASGAYPGTAFKILLSCPDGLPRSRVSVKFGRSFDRIPHPDAALEESISEVWDQSLQRNPYLYSGTKFRYGGNALHYKDDSDHDLEYCVSLHWVSQTTGNLGDQSPSLGEFFWVHPKIDLDFANFAKMLGKWGFIKTFEKKFLFCKGPQGGKFQKLVFPGKTPTPKILEFG

SEQ ID NO: 57541 - DNA, 673 bp, Zea mays
  misc_feature: Ceres CLONE 1506209
  misc_feature: Encodes the peptide sequence at SEQ ID NO. 57542
  misc_feature (673)..(673): n is a, c, t, g, unknown, or other
gctctttactagtggatcccccgggctgcaggaattcgcacgagaccattacctagaacatcctaatcgaaaagcccactccaacacgtgacaccccgcgcggcaccctcgcctccgccgcacgcccccactctctcaccgccaccgccgagaatggcctgctcccacctcgccgccgcgggtggctcttcccctgccgccgccgcagtggttcgttccccgacgcattccccagccgccgccttcgcgcgcctccggtcgacgccgcgtttctcgagcgccggcctgtcggttaagggaagcagggcggctttcccgtgggtcgccgccgcggggccggccgcggcggcgccggtggccgacctgaacggccgcccggacacggagaaccaccccatcattgtcatcgataactacgacagcttcacctacaacctatgccagtatatgggggagcttggattgaacttccaagtataccgcaatgatgaactgaccatagaagatgtaaagaggaagaacccaagaggaatacttatttctccaggtcctggtgaaccacaagattcagggatatcattgcagactgttcttgaattaggcccaaccatcccaattttcggagtttgcatgggcctgcagtgcattgggggaggcatttggaaggagcatn

SEQ ID NO: 57542 - protein, 173 aa, Zea mays
  misc_feature: Ceres CLONE 1506209
  misc_feature: SWISSPROT Homolog: EC 4.1.3.27 Anthranilate synthase
MACSHLAAAGGSSPAAAAVVRSPTHSPAAAFARLRSTPRFSSAGLSVKGSRAAFPWVAAAGPAAAAPVADLNGRPDTENHPIIVIDNYDSFTYNLCQYMGELGLNFQVYRNDELTIEDVKRKNPRGILISPGPGEPQDSGISLQTVLELGPTIPIFGVCMGLQCIGGGIWKEH

SEQ ID NO: 57543 - DNA, 701 bp, Zea mays
  misc_feature: Ceres CLONE 1506214
  misc_feature: Encodes the peptide sequence at SEQ ID NO. 57544
  misc_feature (650)..(650): n is a, c, t, g, unknown, or other
  misc_feature (651)..(651): n is a, c, t, g, unknown, or other
gctggagctccccgcggtggcggccgctctagaactagtggatcccccgggctgcaggaattcgcacgagaccattacctagaacatcctaatcgaaaaactgcagcgcaagcgaaatcgccgaaggaaaggagaccccgagacgagcaaggcggcgagggagggcaaagaccacgtaccagcgcgcacgcacaatgtcgggagcacagggcgcgcacccggtcggccagacgacgccgacgacgtacgagtcggtgggcggcggggagaaccgcacgcgcacggacctgcggtcgcgggaggaccagggcgccatccagatcgagaaggtgcaggacaaggtcgacgatgccgcggggcgtggggtagaccacagcaccttcggcgccaacaaggagggccgcgacgacaatgccgatgccggggcaaccggcaccggcacaggcgcgtgattttgtgcccttccgcagtgtacctgatcgtgtgtgtacgatagctttgtgtccgctgcttggctgctctgtatccgcggcgcggggagtgtgtgaaaacctttctggaaaaaatgcccatgtttagattgaaataaaaccaggaaccgactgggcctgaatccccccttggtactccccccaattggggaaatctannaggaaaaaaaaaaaaaaaaaagctttaccgataccggccaacctcaaggg

SEQ ID NO: 57544 - protein, 85 aa, Zea mays
  misc_feature: Ceres CLONE 1506214
MSGAQGAHPVGQTTPTTYESVGGGENRTRTDLRSREDQGAIQIEKVQDKVDDAAGRGVDHSTFGANKEGRDDNADAGATGTGTGA

SEQ ID NO: 57545 - DNA, 848 bp, Zea mays
  misc_feature: Ceres CLONE 1506217
  misc_feature: Encodes the peptide sequence at SEQ ID NO. 57546
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (49)..(49): n is a, c, t, g, unknown, or other
tgtgggggggtgtggggtgggtcctcagaaaaccannngcaagggttgngagagctggagctcaccgcggtggcggccgctctaaactagtggatcccccgggctgcgggaattcgcacgagaccattacctagaacatcctaatcgaaaaacaaaacccctcctcgcctccctcccctccatccaatcctcgaaacgagcgcgcgggcgaggaggtccccctctccgagatggctagggtttttcgcgggtccctcctcctgatgtccccagcggcggcggcggcggcggcggcggcggcaggggccaagaaggcggcctccacgaagccgagggcgccggccgggatcacgaagccgatgccggtctccgaatcgttccgcatgttccccggtggcgcgcgcaaggtctcacgctccaagggcatcaaggacgaactggattaacatcaagggcccacgtgactccaaaaccccgtccaaacaaaacccgaggatccaacgtgtggacgcagtacgctccaaaaagccttggcctcggggggatggatgtacaaagatctcggggaatgaagggggagggcctcctaaaggctaaatggaggcccctaaactttctctggaaagaaaatatacaagcgggctgccatgggaacccaagccgggaatccattttctagagttgtgatttctgatggaaaaggttttgagtcctggtcaaaatggggaaaagctccccaaccccccgggtaacattcaacgagaactacttggagaaacggagtggaacgattcggctgcgggagcccttcgatggagttactacaactcaacctccccacagcacag

SEQ ID NO: 57546 - protein, 71 aa, Zea mays
  misc_feature: Ceres CLONE 1506217
MARVFRGSLLLMSPAAAAAAAAAAGAKKAASTKPRAPAGITKPMPVSESFRMFPGGARKVSRSKGIKDELD

SEQ ID NO: 57547 - DNA, 706 bp, Zea mays
  misc_feature: Ceres CLONE 1506218
  misc_feature: Encodes the peptide sequence at SEQ ID NO. 57548
  misc_feature (437)..(437): n is a, c, t, g, unknown, or other
  misc_feature (447)..(447): n is a, c, t, g, unknown, or other
  misc_feature (462)..(462): n is a, c, t, g, unknown, or other
ctggagctccccgcggtggcggccgctctagaactagtggatcccccgggctgcaggaattcgcacgagaccattacctagaacatcctaatcgaaaaacattcacatcgcactctcctccagcctccaggcttggcaagcgtgcttcacatgaccacatccatgtcgaacagcgccgctagcgagaagcaatcgcagcaggcaggccacaggcagcggcccccggcggcgtcggccgcggacgcggagatgcagagggtgttctgccgcatcgacgcggacggcgacggccggatctccgcctcggagctggccgcggtgacgcgcgccatctccccgccagcgagctcctcgcacgggcgccgcgaggtggccgccatgatggacgagctggacacggaccgcgacggcttcgtggacctcggcgagttcagggncgtccacccncgcgcggcgggcgcntgaacaacaacgcgaactccgcgccgccttcgacgtctacaaaggtcaacggggacggcgcgtcccgggggcccaactgggcaaagggctccccgccatcgccaagggcggatgcccccccaaagaatgcaaaggaataggcccccgggttaaaacccaaaggttgggttgggttcaaaaaatttaaaaaaaaaaaggggcccccccccccaaaacaaaaaccgcggcccccccgggggaaaaa

SEQ ID NO: 57548 - protein, 100 aa, Zea mays
  misc_feature: Ceres CLONE 1506218
  misc_feature (29)..(57): Pfam Name: efhand Pfam Description: EF hand
  misc_feature: SWISSPROT Homolog: EC 2.7.11.1 Non-specific serine/threonine protein kinase
  misc_feature (92)..(92): Xaa is any aa, unknown, or other
MSNSAASEKQSQQAGHRQRPPAASAADAEMQRVFCRIDADGDGRISASELAAVTRAISPPASSSHGRREVAAMMDELDTDRDGFVDLGEFRXVHPRAAGA

SEQ ID NO: 57549 - DNA, 689 bp, Zea mays
  misc_feature: Ceres CLONE 1506221
  misc_feature: Encodes the peptide sequence at SEQ ID NO. 57550
  misc_feature (456)..(456): n is a, c, t, g, unknown, or other
  misc_feature (689)..(689): n is a, c, t, g, unknown, or other
ggagctccccgcggtggcggccgctctagaactagtggatcccccgggctgcaggaattcgcacgagaccattacctagaacatcctaatcgaaaaaacaccagctccaccctcgccaccaaccgcccccgcaccacggccagaaccctagtcacttccccgccgcccactccatggaggacgacgccatcgcgacgctcatggacatcgacgactcgccgctcagcgctgcgggggccgggttcctcgacgaggaggacggggagggcgagatgttcttcgccccgcaccgcgcggcccgcggcggcgctggcgatgcccgcgggcccctccccttttccgggttcttcaacagcttcgacggcgccgatttcgacgacgacgacctcgcctgagggaactgccgcccggttcggtaacggatgttgttcgtggatcgcgaatcccgttatgtcnataccgcgatggggtctcttaattaccgcatcgattccaactcggttggacactctgaagatgtttaagggatcaacattaaccttttgtgtacttttgtggccctatgggttcggaggatggccccttggatcgaatattaaataccctttgtggccccaaggttttccttggaatcacctggggaatgaacctcctttcccgcggacatttggaggaaaatttttgggccn

SEQ ID NO: 57550 - protein, 73 aa, Zea mays
  misc_feature: Ceres CLONE 1506221
MEDDAIATLMDIDDSPLSAAGAGFLDEEDGEGEMFFAPHRAARGGAGDARGPLPFSGFFNSFDGADFDDDDLA

SEQ ID NO: 57551 - DNA, 652 bp, Zea mays
  misc_feature: Ceres CLONE 1506224
  misc_feature: Encodes the peptide sequence at SEQ ID NO. 57552
  misc_feature (363)..(363): n is a, c, t, g, unknown, or other
  misc_feature (416)..(416): n is a, c, t, g, unknown, or other
aaagctggagctccccgcggtggcggccgctctagaactagtggatcccccgggctgcaggaattcgcacgagaccattacctagaacatcctaatcgaaaaatttcttctcctctctgctctgttcacttcgttctagtggggagcgccgccgctgcagttgccgccgccaccagagcagtccacctcggtctgatatggcgaccgggagtgcaagtgccatcgcgtccttctccgtggcggcggcagcggctgctgctctgcgcgtcaagcggccatgcgctcgcgcttgcgcttgggccccctcgcagcgaccgcagcaaggggcactcgtcagcctcaagccttggcgcctcactggcnacacaagctcctctgtggcgcgcgaaatcggatgcccccggggggtggggccngcccccgcaaatgcctgggccccccccctcccggaaagcataatccttccccgggaaaaaaaaactaagaaattccctgggggaaaccggttttaaacaaatccccttcccttttgagcccttctaaccgggaaggagaaatccccccctttttggaaaactcccggggggggaccccctttgggaaaaaagggggccctttttaaaaaaaaagcccccttttggggggaaaaaaa

SEQ ID NO: 57552 - protein, 104 aa, Zea mays
  misc_feature: Ceres CLONE 1506224
  misc_feature (56)..(56): Xaa is any aa, unknown, or other
MATGSASAIASFSVAAAAAAALRVKRPCARACAWAPSQRPQQGALVSLKPWRLTGXTSSSVAREIGCPRGVGPAPANAWAPPLPESIILPREKKTKKFPGGNRF

SEQ ID NO: 57553 - DNA, 875 bp, Zea mays
  misc_feature: Ceres CLONE 1506228
  misc_feature (748)..(748): n is a, c, t, g, unknown, or other
aaaagcacaaataataataacacaaaaaaaaaacaaaaaaacggtggcgctcaaaagctggagctccccgcggtggcggccgtctctaaaacaaaagaatcccccgggctgcaagaattcgcacgagaccattacctagaacatcctaatcgaaaaaacatctcctcacttcacaaccactcccgccattgtcctgcgcctttcagaaccgccacacacaccccgctccaatccaatggcgcctcgccaagccgtcctcgcgaacatggacctcgccgcactgctcccgttcgccctctcacgcgggcagaggatttggtctccaaagcgcccagccgcacccgaggccgcacggccacacacagatacaaaggtgacaacgtgacacatcgagaataacaacccccatactacagaataatgcagaagcgatccggcacacatggacacacaaacaaagaaagaaagaaaaaaaaaattaaaacatccccccccccaaccctatacttattctacggggggtagcttgaaacacaaagaacaacatacttactaacattcgggttccaaaaaactaatcgggaatccctaggacattcgtaaagactacacggatcctggaactacttactctaggggatcgagaaagagcccagctcaaaaaaacaaaaaatggtcctaccacaccgtaggccaaaccaaccccccccaaacatactggtcccgacccaaaataacatccgcttcncatcacacaaaaaaaaagggggtaagtaaaaaaaaactgaaagagacgcaaaacaaaaacaatgttttctaagctacaagatacaaaaccaaacaaagagttggaaaaaaataagaaaaggaccaag

SEQ ID NO: 57554 - DNA, 690 bp, Zea mays
  misc_feature: Ceres CLONE 1506229
  misc_feature: Encodes the peptide sequence at SEQ ID NO. 57555
  misc_feature (498)..(498): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (554)..(554): n is a, c, t, g, unknown, or other
  misc_feature (555)..(555): n is a, c, t, g, unknown, or other
  misc_feature (569)..(569): n is a, c, t, g, unknown, or other
tggagctccccgcggtggcggccgctctagaactagtggatcccccgggctgcaggaattcgcacgagaccattacctagaacatcctaatcgaaaaatcaggacgcggacgcggacgcggacgcggctcacatcaaacacccccttcagctgtgctcagtgctcactgccgcaaaaccacagccacacagggaagcgcccagcgccctttcacatcaccacatccacgctcctccgttccatggccatgtcgagcagcgccagcaagaagcaagcccaggcccaggcccaggcccagaaggccgggcggaggcccccggcggtgtcgtcggccgcggccgcggacgcggagatgcagagggtgttctcgcgcatcgacgcggacggcgacgggcggatctcgccgtcggagctggcggcggtgtcgcgcgccatctccccgccggcgagctcctcgcacgggcggcgcgaggtgggcgccatgaatgaagagctggnacacgaccgcgacggcttcgtggacctgggcaaagtcaggnnncgtcacgcgcgcnngcggcgcgtttgcnggaaaaaacaacaagaacgcggagctcccgcgcggccttcgcgttgacaaaccccaaacgggaacggcggatccacggcggccaaactggggcaaagggctcccccccatccggcaagggg

SEQ ID NO: 57555 - protein, 124 aa, Zea mays
  misc_feature: Ceres CLONE 1506229
  misc_feature (37)..(65): Pfam Name: efhand Pfam Description: EF hand
  misc_feature (86)..(86): Xaa is any aa, unknown, or other
  misc_feature (100)..(100): Xaa is any aa, unknown, or other
  misc_feature (105)..(105): Xaa is any aa, unknown, or other
  misc_feature (110)..(110): Xaa is any aa, unknown, or other
MAMSSSASKKQAQAQAQAQKAGRRPPAVSSAAAADAEMQRVFSRIDADGDGRISPSELAAVSRAISPPASSSHGRREVGAMNEELXHDRDGFVDLGKVRXRHARXRRVCXKKQQERGAPARPSR

SEQ ID NO: 57556 - DNA, 709 bp, Zea mays
  misc_feature: Ceres CLONE 1506233
  misc_feature: Translation starting site: 147
  misc_feature: SWISSPROT Homolog: EC 1.11.1.7 Peroxidase
  misc_feature (407)..(407): n is a, c, t, g, unknown, or other
aaagctggagctccccgcggtggcggccgctctagaactagtggatcccccgggctgcaggaattcgcacgagaccattacctagaacatcctaatcgaaaaattcgtttgtcacataagcagtggtggtcggtcggccggcgacaatgagcggccgtgtgttcgtcctggccgctgccttcggcgtgctgctcgccgcagccgccgtgtcctcgaggcccgtcctgactccgctgggtactagccgccctgctgccggcgacctgtccgtgtacttccacgcggactcgtgcccgcagctggagacgatcgtgcggtccagcgtggacgcggcgctccagcagaacgtccgtctgacggcgggtctcctccgcctcttggggaggggtgcttcccgcaaggctgcnacacgtccatcctcccggacaacggcgagcgcggcctcccgcccaacgtggggctgcagcaggaggccgtgcagctggtggaggacatccgcggcaaggtgcacgcggcgtgcgggcccaccgtgtcgtgcgccgacatcacggtgctgggcacccgcgacgccgtgagcctgtccggcgggccttccttcacggtgccgctggggcggctggacagcgccggccccggcgtccagcaacgacgtggttcacgctgccggccgccgaacggcgtacgggggaacgacctggttgacggcgta

SEQ ID NO: 57557 - DNA, 668 bp, Zea mays
  misc_feature: Ceres CLONE 1506240
  misc_feature: Translation starting site: 340
  misc_feature: Pfam Name: ETF Pfam Description: Electron transfer flavoprotein domain
ggatcccccgggctgcaggaattcgcacgagaccattacctagaacatcctaatcgaaaaagtgctcatcccctgctggcccgttctcagtcccagtgagaggctccatgaagatcctggtcgcggtgaagcgggtggtggactacgctgtcaaagtgcgcgtgaggccggacgggaggggcgtggagacggccaacgtgaagatgtccatgaatccattctgcgagatcgccgttgaggaggcgctgcggctccgggaggccggcgtcgccgctgagggtcgtcgccgccaccgtaggccctgcccagtccgccgacacgctccgcaccgcactcgccatgggcgccgatcgcgccgtccacgtgctccccgacccggaccctgcgcggcccctcctccctctcgccgttgccaagatccttcgcgccgtcgcgctccaagaaagcccggcctcgtcatccctcggcaagcaagcaatttgatgatgattgcaaccaaactggacaaatgttagctggattgctcaagtggcaccagggacccttggcctccagagttaccttgggacccaaaaaaccaaaaggctcctggttgagcgaaaagttgatgggggaaattgaaaccctcctgccttgatctggccggagggggatcccaccgattttag

SEQ ID NO: 57558 - DNA, 738 bp, Zea mays
  misc_feature: Ceres CLONE 1506354
  misc_feature: Translation starting site: 328
  misc_feature (319)..(319): n is a, c, t, g, unknown, or other
tggagctccccgcggtggcggccgctctagaactagtggatcccccgggctgcaggaattcgcacgagaccattacctagaacatcctaatcgaaaaatatacgccgccatcttcgcaagccaccgcaaccgaagcccgccttcgccgccgccgcctctgcgatccccgcaaggtcgcaaacatgtctaccgtgctccagcgcccgacccccggcacggtccagtgcttcggccgcaagaagacggctgtggccgtcgcctacaccaagccggggcgcgggctgatcaaggtgaacggcgtcccgattgagctcatcangcccggagatgctccgccctcagggcttcgagcccatcctgctggcggggcgctcccaggttcaggacatcgacatgaggatccgcgtccgaagcggcgggaagacttcccagatctacgccattcgccaggccgtcgccaaggggctcgtcgcctactacccaaagtacttccacaagccccccaaaaaggaagtcaggaaatcttccccccgaaaaacggcccctttttggtccaaaaccaggggttggaaaccaaaaaatctgggggtccgggcccccgccccggttcaaaaaacccaccctttaacccctggtttccccccttttcaaacaaaacgtgggttggccccatttccatttaaaccgggccccgggtttttttttttcttccggaacaccttggggggtactaaaaaa

SEQ ID NO: 57559 - DNA, 737 bp, Zea mays
  misc_feature: Ceres CLONE 1506355
  misc_feature (401)..(401): n is a, c, t, g, unknown, or other
tggagctccccgcggtggcggccgctctagaactagtggatcccccgggctgcaggaattcgcacgagaccattacctagaacatcctaatcgaaaattttttctggattttaggctgttcgtaacccctacaacaatgatccgtatcagctccggtaaatttagcggagccctccggacggtttctccatcgcccgctatcgcgtcgcctttgacttttctccgacggtaaatttattcgtcacgccgtcggccgcatataggactgtctacggatctgagtgagcatctctcgggcggaatcgccgagccgacgcagcttcgccaccaactccgcggcgttcgacgccgggcaccgccgtgcgcacggcagcgaacttcctctgctcgcactgatgctngcgctacacatcctcctgcgctccttcgacgaaccgctcgaaccaccatggtggccgcggcgttcgaccgtcgccacaccgtgcgcagggcgggcaactgccgtgctccaccttcggcccaggggacatgggaaaacacgacaaattcccgcctttttaggttgttgcttcctccgggggaagtaatccttggctccttttccgaaaaaccttggggtttgacccccaaattgagaaaaacactttccggttcaaaaaaggtcccaagacaaaaaaaaaaaaaattttttttttccccaaaaagtttttgtcaaaaaacttttaaagatttttctc

SEQ ID NO: 57560 - DNA, 729 bp, Zea mays
  misc_feature: Ceres CLONE 1506359
  misc_feature: Encodes the peptide sequence at SEQ ID NO. 57561
aaagctggagctccccgcggtggcggccgctctagaactagtggatcccccgggctgcaggaattcgcacgagaccattacctagaacatcctaatcgaaaaattcattcatcactcaccagtcaccaccactgccgcgaccgagagagtcagagagagcaggcggcggcaatggctggcgctggggacgagtactactacggcgggccgggccagcgcggcgcgccccacggcctgctgctggcggtggtggtgggcctcgtggtggcgggcccgctgttcctgggcggcggcggcgaggcgctgacggaagctgtggcggagctgctgagcccggtggggctcctcctcctcgcgtgtgcctgctgttcctcatccgcatcctctcgtacgaactgcgcgccgcggcgctcgccgacgccttcgacttcggcgggtccccccgacgcgtcccatgcgtggaaggggtccccggtcggggtcccggtcttgctcctcctcatcctcgggctggcttattaacgaatcttcgttctttcgggggaaacgggggggaacaaaaaataggaaaggaaacctgggcggttcccaaccctggctgcctggtggggtggtttccgtaaaggaaggctccaagggccctttggcaaagggccgtggtaaaacaacgggaggggaaacttgtttgttctgggggggttgccaaaaaaaaaaaaaattttttctccc

SEQ ID NO: 57561 - protein, 116 aa, Zea mays
  misc_feature: Ceres CLONE 1506359
MAGAGDEYYYGGPGQRGAPHGLLLAVVVGLVVAGPLFLGGGGEALTEAVAELLSPVGLLLLACACCSSSASSRTNCAPRRSPTPSTSAGPPDASHAWKGSPVGVPVLLLLILGLAY

SEQ ID NO: 57562 - DNA, 657 bp, Zea mays
  misc_feature: Ceres CLONE 1506372
  misc_feature: Encodes the peptide sequence at SEQ ID NO. 57563
  misc_feature (499)..(499): n is a, c, t, g, unknown, or other
  misc_feature (614)..(614): n is a, c, t, g, unknown, or other
tccccgcggtggcggccgctctagaactagtggatcccccgggctgcaggaattcgcacgagaccattacctagaacatcctaatcgaaaactgcggcagcaccactccacacccacactccgcccatcggctgccatggcgaccagggcggcggcggcagccacgctcacggcggctacgtcctctcttcttaggcgctctacctcgctgcggccgcagggtctccgggtcccccaccgcgtgcctccccaaaggtttgtgcgccatattgcttcatcatcaaacgaggaagctgctgccagagcagccgccgccactgctgacgctggaggaccaaccattttcgacaagatcattgcgaaggaaatcccttcgagcatcgtatatgaagatgaaaatgtgctggcatttagagatattaatccacaagcccctgtgcacgttctagtcatcccaaaagcgagagatgggctaaccggattagacaaggctgagccnaggcatacagaaatcctgggccggctcctttacgcagcgaaagtagtggcaaaaaaggaagtgtagcgagtgggtaccgggtgtcatcacaatggtgctgaaggatgcaaatctnctatcatctgcccttgctgtactggggggaggccaatgagtgg

SEQ ID NO: 57563 - protein, 142 aa, Zea mays
  misc_feature: Ceres CLONE 1506372
  misc_feature (75)..(143): Pfam Name: HIT Pfam Description: HIT domain
MATRAAAAATLTAATSSLLRRSTSLRPQGLRVPHRVPPQRFVRHIASSSNEEAAARAAAATADAGGPTIFDKIIAKEIPSSIVYEDENVLAFRDINPQAPVHVLVIPKARDGLTGLDKAEPRHTEILGRLLYAAKVVAKKEV

SEQ ID NO: 57564 - DNA, 594 bp, Zea mays
  misc_feature: Ceres CLONE 1506397
  misc_feature: Encodes the peptide sequence at SEQ ID NO. 57565
  misc_feature (184)..(184): n is a, c, t, g, unknown, or other
  misc_feature (185)..(185): n is a, c, t, g, unknown, or other
  misc_feature (226)..(226): n is a, c, t, g, unknown, or other
  misc_feature (272)..(272): n is a, c, t, g, unknown, or other
tccccgcggtggcggccgctctagaactagtggatcccccgggctgcaggaattcgcacgagaccattacctagaacatcctaatcgaaaaatcgtctatgtccatggccctctcaagctcgctccgtggcctggtggccctgaccccgctggccctcccttccgctcgcccgagcggggccgnncgcgcggccccgggcatacgcgcgtcggggtccgacggggnagagggggcgggggtcgtggcctctggcggcggcttctgcccttcngaccccccattggtctgaaccggcttgcccggaaaaaaaaaaaacccccttgtacccccaccaggcctggccggggtttcggggggggggttggcccaccctcggggttttccccaatccccccgggggaacccccccccccttttgggtttccccaaaaaaaaccccccttttggggggggggggggttttcccccctcctgtgggggccccccccccccccccccctcttggggtttttttttaaaaaggggggcgccccgggggatttttttgttggaaaattttttgggaaaaaaagtttttgtttcccccccccccc

SEQ ID NO: 57565 - protein, 63 aa, Zea mays
  misc_feature: Ceres CLONE 1506397
  misc_feature (29)..(29): Xaa is any aa, unknown, or other
  misc_feature (43)..(43): Xaa is any aa, unknown, or other
MSMALSSSLRGLVALTPLALPSARPSGAXRAAPGIRASGSDGXEGAGVVASGGGFCPSDPPLV

SEQ ID NO: 57566 - DNA, 698 bp, Zea mays
  misc_feature: Ceres CLONE 1506400
  misc_feature: Encodes the peptide sequence at SEQ ID NO. 57567
  misc_feature (433)..(433): n is a, c, t, g, unknown, or other
  misc_feature (460)..(460): n is a, c, t, g, unknown, or other
  misc_feature (552)..(552): n is a, c, t, g, unknown, or other
  misc_feature (580)..(580): n is a, c, t, g, unknown, or other
  misc_feature (625)..(625): n is a, c, t, g, unknown, or other
  misc_feature (637)..(637): n is a, c, t, g, unknown, or other
  misc_feature (640)..(640): n is a, c, t, g, unknown, or other
  misc_feature (646)..(646): n is a, c, t, g, unknown, or other
  misc_feature (651)..(651): n is a, c, t, g, unknown, or other
ggagctccccgcggtggcggccgctctagaactagtggatcccccgggctgcaggaattcgcacgagaccattacctagaacatcctaatcgaaaactatatacacactcgatacctagggtttccttctctcacttctgtacccaacagaagagcggcggcgcggacggacaaggagcaggcggaagaggagttgtgccaaggcacaatgggtatctcgcgtgactcgatgcacaagcgccgagccaccggtggaaagcagaaggcctggaggaagaagcgaaagtatgagcttggtcgccagccagccaacaccaagttgtcaagcaataagacagttaggagggtccgtgttcgtggaggtaatgtgaaatggagggctcttcgccttgatactggtaactactcatggggaagtgaagctgttacccgncagacccgtatcctcgacgtggtctancatgcgtcaaacaatgagcttgtgaggacacaaaccctttgtgagagtgccattgtgcaagttgatgctgccccatttcagcagtggtaccntcactcactagggagttgacattggtangaagaagaaaaaccctggctgcaagaagataatgctgagggacangaggtttgagcnccncctgangaacnaaaaaaaaccaccctggccccagaaaccttgagagccccagggaggg

SEQ ID NO: 57567 - protein, 120 aa, Zea mays
  misc_feature: Ceres CLONE 1506400
  misc_feature (1)..(118): Pfam Name: Ribosomal_S8e Pfam Description: Ribosomal protein S8e
  misc_feature (84)..(84): Xaa is any aa, unknown, or other
  misc_feature (115)..(115): Xaa is any aa, unknown, or other
MGISRDSMHKRRATGGKQKAWRKKRKYELGRQPANTKLSSNKTVRRVRVRGGNVKWRALRLDTGNYSWGSEAVTRQTRILDVVXHASNNELVRTQTLCESAIVQVDAAPFQQWYXHSLGS

SEQ ID NO: 57568 - DNA, 744 bp, Zea mays
  misc_feature: Ceres CLONE 1506404
  misc_feature: Encodes the peptide sequence at SEQ ID NO. 57569
  misc_feature (399)..(399): n is a, c, t, g, unknown, or other
  misc_feature (739)..(739): n is a, c, t, g, unknown, or other
atatgtggagctccccgcggtggcggccgctctagaactagtggatcccccgggctgcaggaattcgcacgagaccattacctagaacatcctaatcgaaaaaaaaattctcacagagaaccggaggactgagaccagaggaggagacgtcacgcctgcgcggctgcgcccaccatggacgaggatgagtttcggcgcatgctcgacctcttcccggtcgtccgctcccgagactactgctgctccgatcttggaacatccagcagaggaaccagacagcgatcacgagttcaggaggcaactaagggcgataataaggactcgtccggtggacgagatatgtttatgcagaaattgaagatggctgcggacaataagattggagcgacaaaggcaaanttcttctgcaagacattcgaagaagttcatgagaaaacttgttcacagagagctgaatttggatgctgctaaaaatttcctgagcgcatatgaaagctgatgatgaaccataggtagatggctgcttaaggggtcggaatttgcccaggatctggaaagttttttaaagctgttaaaaattttgaatcccgggcaatctttataacccgggtaaatgcttgttgagcccaaatcggaacccccccggattggtttcccccaacgccccggaccccactcggaaaggaacccggttgtttcaaaaaattgtttttttggcccaaaaaaggggcgccccccnaaaaa

SEQ ID NO: 57569 - protein, 98 aa, Zea mays
  misc_feature: Ceres CLONE 1506404
  misc_feature (75)..(75): Xaa is any aa, unknown, or other
MDEDEFRRMLDLFPVVRSRDYCCSDLGTSSRGTRQRSRVQEATKGDNKDSSGGRDMFMQKLKMAADNKIGATKAXFFCKTFEEVHEKTCSQRAEFGCC

SEQ ID NO: 57570 - DNA, 732 bp, Zea mays
  misc_feature: Ceres CLONE 1506406
  misc_feature: Translation starting site: 221
tggagctcaccgcggtggcggccgctctagaactagtggatcccccgggctgcaggaattcgcacgagaccattacctagaacatcctaatcgaaaaaaccctagccgccttcccgtccttttcctttcataaaccccaagccgcgccgcaatagctcgccccctcgttcgccgcctctcctgctcctaccgcagctctccctcaggtttagtgttcgcaatggcggccttcaacaagcttggtggccttctaaggcacagtgctctggtgagcggtatcactggtggctcttctcctgcagtgttcaatgctgcacggctcatgtctaccaagctatttattggtggtcttgactggggtgttgatgacgtgaaactaagagaagcatttagcagcttttggagaggtaactgaaacgagggtgatcacagacagggagactgggaggtcaagaggctttggctttgtgaactactccgacagtgatgctgccaagaaagctatttctgcaatgaatgcaaggaaattgatgggcggcaggtacgtgtcaacatggctaatgaaagaccggctgggaacgtggtggtgggggctatgggggcggcggctagggagggggggggtacggaagggggggggggtaacgaaggggggggaatgggggggggcacccaatctataaagtttgggggggcaggaacccataaggggcttttccccccaaaaatttg

SEQ ID NO: 57571 - DNA, 925 bp, Zea mays
  misc_feature: Ceres CLONE 1506418
  misc_feature (27)..(27): n is a, c, t, g, unknown, or other
tggcgccctcagctcccctttatcctnaccccaaaccccgcccaaaacgtaaattccacgcagcggcggccgctctataataggggatccccgggttgcggatttcgcacgagaccattacctaaaactcctaatcaaaaatcttctgttcgtgagctctctctctctctctctctgtctctctctctctctcgtctccttctcgctctcagacgagcggtgggccgctggcgccgacaccgccccaatcccacgtgctgaagctcttgttggggtcgtctttaaccagcgaccccccacgggggaaagttccgggcttttccatttaggagcatccagggtcgcctgaacctgaagggttccatgattggtgaatttgaaggttcccgccgttccccggtttcccgggtattaataagagggcaccctcgccccatataaaattttaggttgaggagggtggccaagcgccccccccccccaattctgaaaacaaacacccctttcggaggtaacctgccggttaaaggctattcatacactgttggaagttgtgttgggtctgacactccccgtaaccggtgatggtgtttagaacgacatccttttttacgttgtcgaatagagggagtgtatttggccgggctaattcgtctttctccccgcggctggaggcccccttttttgtgtcttgtcgcggtttcattttatcccccgcccgccacacttatttttcggggattcgccactattacccccccccgcattattgggtggccgccccgatatgttcgccggcagtacttttctaaacatatatctacgtggccatgattagcgtattcatcgcccgccgcccctctattttattttgttaccccggccgaaatctcattattgagggcgcgtcgccccccttaccgtg

SEQ ID NO: 57572 - DNA, 747 bp, Zea mays
  misc_feature: Ceres CLONE 1506422
  misc_feature: Encodes the peptide sequence at SEQ ID NO. 57573
tccccgcggtggcggccgctctataactagtggatcccccgggctgcaggaattcgcacgagaccattacctagaacatcctaatcgaaaagcgccgccacttccctcccgacccactagcccaaaaccgtagcgcccgccgccgtcgttgcgagctccccatcttcctccgtcaaccatggcgacccagatcagcaagaagaagaagttcgtcagcgacggcgtgttctacgccgagctcaatgagatgctgacgcgggagctcgcggaggacggctactccggcgtggaggtgcgcgtcacaccgatgcgcacggagatcatcatccgcgccacgcgcacgcagaacgtgctcggcgagaagggccgcaggatcagggagctcacgtctgtcgtccagaagaaggtccacttccccgagaacggcgtcgagctctacgccgagaaagtcgtcaaaccgcggcctctgggccatcgcgcaggttgagtccctccgctacaagctccctcggaaggcttgccgtccggagggcccggtaagggggtcttccccttcggtaattgaacagggggtccccggctctagtatgcctctgaatacgcccccccctattgataatatacggacccccgaataacgcctctgcgcatgggtgtggaatccaccacctattacgatctcgcgcagggattctactttttacccattaccccgcctccgctttttaaatccgctctgtgacgggg

SEQ ID NO: 57573 - protein, 102 aa, Zea mays
  misc_feature: Ceres CLONE 1506422
MATQISKKKKFVSDGVFYAELNEMLTRELAEDGYSGVEVRVTPMRTEIIIRATRTQNVLGEKGRRIRELTSVVQKKVHFPENGVELYAEKVVKPRPLGHRAG

SEQ ID NO: 57574 - DNA, 720 bp, Zea mays
  misc_feature: Ceres CLONE 1506424
  misc_feature: Encodes the peptide sequence at SEQ ID NO. 57575
  misc_feature (451)..(451): n is a, c, t, g, unknown, or other
  misc_feature (452)..(452): n is a, c, t, g, unknown, or other
  misc_feature (489)..(489): n is a, c, t, g, unknown, or other
  misc_feature (490)..(490): n is a, c, t, g, unknown, or other
  misc_feature (512)..(512): n is a, c, t, g, unknown, or other
  misc_feature (678)..(678): n is a, c, t, g, unknown, or other
  misc_feature (707)..(707): n is a, c, t, g, unknown, or other
ggagctccccgcggtggcggccgctctagaactagtggatcccccgggctgcaggaattcgcacgagaccattacctagaacatcctaatcgaaaaacagagaaccggaggactgagaccagaggaggagacgtcacgcctgcgcggctgcgcccaccatggacgaggatgagtttcggcgcatgctcgacctcttcccggtcgtccgctcccgagactactgctgctccgatcttggaacatccagcagaggaaccagacagcgatcacgagttcaggaggcaactaagggcgataataaggactcgtccggtggacgagatatgtttatgcagaaattgaagatggctgcggagaataagattggagcgacaaaggcagagttcttctgcaagacattcgaagaagttcatggagaaacttgttcacagagagctgaatttggatgctnngctagaagttcctgagcgcatatgagagctgatgatnngacataggtaatgctgctttangggtcggtagtttgccatggatcctggaagttgttgatgctgttggagattttgatcaccggcaactttttacaaccggcgaatgctgttgacgcatactgataccggctgattgggtcaccgatcgcccgtaccagctcgtatgcgccagctgtcagagactgtnattggggcgtaaagtgatgcactccattnatgtggcgttact

SEQ ID NO: 57575 - protein, 102 aa, Zea mays
  misc_feature: Ceres CLONE 1506424
  misc_feature (98)..(98): Xaa is any aa, unknown, or other
MDEDEFRRMLDLFPVVRSRDYCCSDLGTSSRGTRQRSRVQEATKGDNKDSSGGRDMFMQKLKMAAENKIGATKAEFFCKTFEEVHGETCSQRAEFGCXARSS

SEQ ID NO: 57576 - DNA, 736 bp, Zea mays
  misc_feature: Ceres CLONE 1506431
  misc_feature: Encodes the peptide sequence at SEQ ID NO. 57577
  misc_feature (376)..(376): n is a, c, t, g, unknown, or other
  misc_feature (399)..(399): n is a, c, t, g, unknown, or other
  misc_feature (414)..(414): n is a, c, t, g, unknown, or other
ggagctccccgcggtggcggccgctctagaactagtggatcccccgggctgcaggaattcgcacgagaccattacctagaacatcctaatcgaaaaatggagcagagaaaaagtgaaaacggcgatgttggccgtcccattttgtaagctccccttccccgtctggccgtctcgactgccccagtcctttctcagatccatgtctacccagaatctgctaactggcgcgtgcacgagctccgccccgaccccgtccgaggcggaggaaggggacaggacgcctttggctgacgctgcgaacgcggcggaagagctgtaccgcctccgtgacacctttttcccgcgggacccttccgagaaagtcggcgcactccgngccctgcgcgacgccgtcctcgngctcctcgacgcttncccgtccgaacaaaagaagtctcgaacactgcgtggtgtttattgaatttttgagggaaaaaaactggatgtcttccctgatatcttagggagctgaagatactttattcaagttgaaaaggtgaaacaattccctgaaaagcaaggaaggtttgggaaaacgcttttggaaaaaggggaatttttttggacaaaaatatttttttcttatacccaaaaagggggtccaaaaaaaaaaaagtgggccaaatccctcgtttaaaaaaaatggtcccagggagggaaaaccgcccttttttaaaaaaagaattttttctccaaa

SEQ ID NO: 57577 - protein, 86 aa, Zea mays
  misc_feature: Ceres CLONE 1506431
  misc_feature (67)..(67): Xaa is any aa, unknown, or other
  misc_feature (72)..(72): Xaa is any aa, unknown, or other
MSTQNLLTGACTSSAPTPSEAEEGDRTPLADAANAAEELYRLRDTFFPRDPSEKVGALRALRDAVLXLLDAXPSEQKKSRTLRGVY

SEQ ID NO: 57578 - DNA, 718 bp, Zea mays
  misc_feature: Ceres CLONE 1506432
  misc_feature: Translation starting site: 213
  misc_feature (370)..(370): n is a, c, t, g, unknown, or other
  misc_feature (419)..(419): n is a, c, t, g, unknown, or other
  misc_feature (499)..(499): n is a, c, t, g, unknown, or other
aaagctggagctccccgcggtggcggccgctctagaactagtggatcccccgggctgcaggaattcgcacgagaccattacctagaacatcctaatcgaaaaaggccgccgcctctcctactgcatctccctcgctctcgtcgcctcgttcgcttcgcctcctccccgccccgccccgagccgagcagagcgcagccctatccggagctgggatggcggacgcgaagcagcagcagcagcagccacagcaggcggcagcggcagccaccggcgtgtggaagacggtcaagcccttcgttaacggcggggcctctgggatgctcgcgacctgcgtcatccagcctatcgacatgggtcaggtgaggatccnattgggtgaggggctcgctggtcagggtcacaggacatgcttgcaatgnagggtgtccgtctttctacagggtttgtctgcccgattgctgaggcaggacttaccaattgctcgtctggatcctttagnttcaactaccaagcctttaaaaaaggaggggacccttgccctatttccaaagttttatggggcaaaggggggaaattggggcttgtttggggccccgggaatggggcccttaaaaaggggggcacttccccttggggggggcaagggccccctaaaagggtttccgggccccccccccaagggggagagggggtctttcttttggggggggcccccccg

SEQ ID NO: 57579 - DNA, 746 bp, Zea mays
  misc_feature: Ceres CLONE 1506435
  misc_feature: Encodes the peptide sequence at SEQ ID NO. 57580
  misc_feature (417)..(417): n is a, c, t, g, unknown, or other
  misc_feature (433)..(433): n is a, c, t, g, unknown, or other
  misc_feature (444)..(444): n is a, c, t, g, unknown, or other
  misc_feature (472)..(472): n is a, c, t, g, unknown, or other
  misc_feature (550)..(550): n is a, c, t, g, unknown, or other
ggagctccccgcggtggcggccgctctagaactagtggatcccccgggctgcaggaattcgcacgagaccattacctagaacatcctaatcgaaaaactgcgactgtgagcttcgttcgttcagttcatccgtgttcttgtttgcgaggtcgagagagagaggatgtcgtgctgcggaggcaactgtgggtgcggctccggctgcaagtgcggcaacggctgcggagggtgcagcaagatgtacccggacatggctgagcaggtgaccaccaccacccaggctctcatcatgggtgtcgcaccatccaaggggcacgccgagggcgggttcgaggcggccgccggagctgagaacggcgggtgcaagtgcggcggcaactgccagtgcgacccctggcactgcggcaagtgagctangtgctccaccctgcangccgggccggnagaagctagctaaatatttatagctaantaaagtatagcggcgtcgctgtgtgtgtttcgagtcagtcagtcagttagttgcgtggcatggctggcatgctctgantctgaaatgatgaagaatgcctgatggcgcctccggccttgaagccctccctggccccttcgggggctttttggggccaaacatggggtttgttttgttttggggggttcccaccggaaaagggttacccgggcccgcggtggtgggggcccccccccccctaaaaaccttttttcttaaaaaaaaaaaaaaaaaa

SEQ ID NO: 57580 - protein, 82 aa, Zea mays
  misc_feature: Ceres CLONE 1506435
  misc_feature (1)..(80): Pfam Name: Metallothio_2 Pfam Description: Metallothionein
MSCCGGNCGCGSGCKCGNGCGGCSKMYPDMAEQVTTTTQALIMGVAPSKGHAEGGFEAAAGAENGGCKCGGNCQCDPWHCGK

SEQ ID NO: 57581 - DNA, 774 bp, Zea mays
  misc_feature: Ceres CLONE 1506437
  misc_feature: Encodes the peptide sequence at SEQ ID NO. 57582
  misc_feature (652)..(652): n is a, c, t, g, unknown, or other
  misc_feature (692)..(692): n is a, c, t, g, unknown, or other
  misc_feature (714)..(714): n is a, c, t, g, unknown, or other
  misc_feature (715)..(715): n is a, c, t, g, unknown, or other
  misc_feature (717)..(717): n is a, c, t, g, unknown, or other
  misc_feature (772)..(772): n is a, c, t, g, unknown, or other
tggagctcaccgcggtggcggccgctctagaactagtggatcccccgggctgcaggaattcgcacgagaccattacctagaacatcctaatcgaaaagttgtttcagatcaatttgcagccagccacacactcacgcgcttcttctcccttcaattcgatctccttttgcgccttccttttggttctttcggaaaaaaaagagccagcttttctgacatcttcttgcgcttgcttgctcgctcgcatgacgtccagcagtagtgacagtctcttggttcttgcttggatagtttgggtttgttcttgccttgcctgaattggagaccgctgcttgtttttggtgaagggagggtagagagaagatcgacagccctgctagtgtcccaccacccagagggcaagggtggctaccgaaagggaaaaagattcccttgttctttgaccggcttctcaggaacaaaatctggagggggggaagggatcccaattaatcacgggcccttggggacccctggtttggattagggatggccgacccccaaaaccaaagaaagcgttggtttgggcacaaaccccccccccggccccaaagggccccgggggccgggggttaaaggcttttttttgggggggggggggcgcaccctccgnaccgcgaaaaacaccaaagtgcggggggcagcgggggtgncggacaaacaaccccccgccgnntntttttttttttgttggggccggttttttttaagaagaaatcaacacaagaaaagnaa

SEQ ID NO: 57582 - protein, 86 aa, Zea mays
  misc_feature: Ceres CLONE 1506437
GAHRGGGRSRTSGSPGLQEFARDHYLEHPNRKVVSDQFAASHTLTRFFSLQFDLLLRLPFGSFGKKRASFSDIFLRLLARSHDVQQ

SEQ ID NO: 57583 - DNA, 773 bp, Zea mays
  misc_feature: Ceres CLONE 1506440
  misc_feature: Encodes the peptide sequence at SEQ ID NO. 57584
ggagctccccgcggtggcggccgctctagaactagtggatcccccgggctgcaggaattcgcacgagaccattacctagaacatcctaatcgaaaagtgtcaaacgttatccggttcaaagccgagcggcgtctcctctctccagcggctccagccaatccggcaatcccgctcccccagctcgctgctcgcccgctctcctccgccctccgccatggcggccttcccctccgcctccccgtcgccggcgatctccgcctcgacctggagcatggcttccctccgtacgtccctccccgcactccgcccctcccccgcgggcaggctccgttcgtcgttctcgcccgcggcggcggccacggctgcatcggtcggctgcctcgggtctttctccggctcggggcggtccccaaactccttctggtcggggttaaaatttcagctttgaacatccggttgttgggaaatgaagcccgtggaaagaaaattccccatgccacatggaaaaacccttcccaaaaatttaaagggcctccgaaaaaagagaaaaaacttgtgtgggggggttatcacacaaatttgttaaaaacgggaagaaaaaaaaaataaaaacccccgggccaaaggcaataaaaaaaattttccaaaaaaaaaatcccctttggaaaaaaaggggtttcttctcaaaaaaaaaaaggggctggggttttttttttaaaaaaaacacccccccccccctgttttggggggggccaaaaacggtgggaccccaa

SEQ ID NO: 57584 - protein, 77 aa, Zea mays
  misc_feature: Ceres CLONE 1506440
MAAFPSASPSPAISASTWSMASLRTSLPALRPSPAGRLRSSFSPAAAATAASVGCLGSFSGSGRSPNSFWSGLKFQL

SEQ ID NO: 57585 - DNA, 847 bp, Zea mays
  misc_feature: Ceres CLONE 1506442
  misc_feature: Encodes the peptide sequence at SEQ ID NO. 57586
gggacctccccgcattatcccccaacagtttatgaaaaacacacccaacaaaaatcgactcaccgcggtggcggccgctctaaaactagtggatcccccgggctgcaggaattcgcacgagaccattacctagaacatcctaatcgaaaaagggtttcctcctcccgccgccacttgccgccccacgagcccattcccctcagcccttcaccatctccggcggccgcagtggcatcagcagctccggctcacgcgcagtgaatgaacgacaatatggcgaccatcgtaaacacgacggaggaggagccgatgctggccgtggtccgcttcaccgctgagctcgcctgggccgacacgggcccggaggtcgccgaccccgaggtcaccccgcctatgtctcgaggcgcatgagcatatccttcgggggcggaggctccaacatggcctccccttaggatcggcttagagggagccccccctccccttccccgtccgcgtgtttccggacaaaaaacctggaaggggcgttcctctcccgtgatcctgcaacccttgtttcctaaaggccgggaccccaagggaaccaaggggttttgtaaacccacccgaaacatatcctggggcctaagcctccccccatcacacaccggtggaaaaagacaagggcctggcgcctttaaaaggtcttttttcccgcttgtctcccatcccgggtttttcaaacccctgtatcgggtaacggggattttcttttcctaaagcaagggcctcttttgaactactcccccactctatggagccagggtcggtggtaagaaaaatacattcctatatcttttctagaaaa

SEQ ID NO: 57586 - protein, 45 aa, Zea mays
  misc_feature: Ceres CLONE 1506442
MATIVNTTEEEPMLAVVRFTAELAWADTGPEVADPEVTPPMSRGA

SEQ ID NO: 57587 - DNA, 718 bp, Zea mays
  misc_feature: Ceres CLONE 1506445
  misc_feature: Encodes the peptide sequence at SEQ ID NO. 57588
  misc_feature (683)..(683): n is a, c, t, g, unknown, or other
tggagctccccgcggtggcggccgctctagaactagtggatcccccgggctgcaggaattcgcacgagaccattacctagaacatcctaatcgaaaaagactcccaattccaaaacctagactagaggttggcggcgatgacaggttgacagctccagccggcagacagccaggcagccagccacgagcccacgacgaccctccgccggacttgacgacgggtgactgactgcatggcatctgcaagtggcagtgggtgcgcaagcactggagcatcccttgttgctgcgaacaccctgactgtggctgtgcaagaaacaactccagttaatggagatggagaaggagaagatggagaaagaacaactgatattggagtgaaagagtctgatacaaagaaaaggaaaccaaaaagacaaacctctggggtttgggactactttatcaagtccactgtgacagagaagggagataaaggcgagaccgaggaacaaatttgggcaaaatgcaagaagtgcaagttcaaaactcgtggtgaagcctaagatgatgcttaaatcttggttttcgacattttggcgctagctggtagctgctacacttaatccttaatgtagtaatgacaatgtagttctagtttggagaggcatgtactattgtgacattttggcgctagctggtangtggtagctgctacgacattttggctgctagctgg

SEQ ID NO: 57588 - protein, 103 aa, Zea mays
  misc_feature: Ceres CLONE 1506445
MASASGSGCASTGASLVAANTLTVAVQETTPVNGDGEGEDGERTTDIGVKESDTKKRKPKRQTSGVWDYFIKSTVTEKGDKGETEEQIWAKCKKCKFKTRGEA

SEQ ID NO: 57589 - DNA, 727 bp, Zea mays
  misc_feature: Ceres CLONE 1506447
  misc_feature: Encodes the peptide sequence at SEQ ID NO. 57590
  misc_feature (719)..(719): n is a, c, t, g, unknown, or other
tggagctccccgcggtggcggccgctctagaactagtggatcccccgggctgcaggaattcgcacgagaccattacctagaacatcctaatcgaaaagagtccagctcggcaggtcagtcagtagtggatagctccgctcgcggtcgcgggcggctcgagtcgcaccccagatcccaatgcgccccgccgcgccgctctaggccgcggaacggaagctaggtgcgtcacacgccggggccggtcgcggtcaccggaccggacgcacaggggcgccgtacgtgcagtcatcggccatgaaggtcctcgtcctcgccgtgctggcgctcgtcgccgccgccgccgccgccggtcagcagcctctaaaactggagtaaatgcggtcctctgaaaataacctacataaatgatgcttcaacgcgacgctgatgctggagatgctgcgggggaagcggatgctgttcgtgggtgactcgctgaaccgggggcagtacgtgtccctcctctgcctcctgcaccgggccatccccgacggcgccaagtcgttcgagacggtggactcgctgagcgtcttccgggcgaagaactacgacgccaccatcgagttctactgggcgccgatgctggccgagtccaactccgacgacgccgtggtgcactccgccgacgaccgcctcatccgcggcgcgcccatggacaggcactacagcttctggaaggncgccgacg

SEQ ID NO: 57590 - protein, 100 aa, Zea mays
  misc_feature: Ceres CLONE 1506447
  misc_feature (98)..(98): Xaa is any aa, unknown, or other
MLEMLRGKRMLFVGDSLNRGQYVSLLCLLHRAIPDGAKSFETVDSLSVFRAKNYDATIEFYWAPMLAESNSDDAVVHSADDRLIRGAPMDRHYSFWKXAD

SEQ ID NO: 57591 - DNA, 762 bp, Zea mays
  misc_feature: Ceres CLONE 1506450
  misc_feature: Encodes the peptide sequence at SEQ ID NO. 57592
tccccgcggtggcggccgctctagaactagtggatcccccgggctgcaggaattcgcacgagaccattacctagaacatcctaatcgaaaaccccgatcgacgctgacgacacagtcgcccgcacacacacagacagtcttacgcgacgacacacacgcaaggcggacggacatggatatgagaggagggcacaacatgggcggcatggcaccgccgccgtcccctcacggcggcatgcggaagcgctacgtccacatgaccttcttctggggcaagaactcggagatcctcttcacggtgtgacccggcgcgcgcagcggcatgtacgcgctggcgctcagcggcgtcttcgcgttcgcgctcctgctccagaacctaagctcccgccggatgggagtgctcattttcaccaccccccgccccgcaacggaaggggccgcgggcggtgccgaccgccgggcgctgcccggggccagggaagggtctcccctgccagtggttggcatccggtcgtaccaaaagcctcttggcaccctaatggcagcaaccccaattggcgctcgcggtctccggttttccaggagcccgtcgtgcaagatcaccggcccaagttaggggaaaataactttttttttgggcgcgggggcccccccccctatgtggtttcggaggggcgcccctcccccccgcgtttgggtttcgaaaaaccacagaagccctcttaaaaacacacccggaccaaggtgatttttcctcacaca

SEQ ID NO: 57592 - protein, 43 aa, Zea mays
  misc_feature: Ceres CLONE 1506450
MDMRGGHNMGGMAPPPSPHGGMRKRYVHMTFFWGKNSEILFTV

SEQ ID NO: 57593 - DNA, 742 bp, Zea mays
  misc_feature: Ceres CLONE 1506893
  misc_feature: Encodes the peptide sequence at SEQ ID NO. 57594
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (538)..(538): n is a, c, t, g, unknown, or other
  misc_feature (540)..(540): n is a, c, t, g, unknown, or other
  misc_feature (549)..(549): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (588)..(588): n is a, c, t, g, unknown, or other
  misc_feature (600)..(600): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (723)..(723): n is a, c, t, g, unknown, or other
  misc_feature (724)..(724): n is a, c, t, g, unknown, or other
  misc_feature (742)..(742): n is a, c, t, g, unknown, or other
aagctggagctccccgcggtggcggccgctctagaactagtggatcccccgggctgcaggaattcgtctcacccctagaaaaaagcgcagcaggtggcagggatgggtcgcggcggcgggatggggaacccagtcaacgtgggcatcgcggtgcaggcggactgggagaaccgcgagttcatctccaacatctccctcaacgtccgacgcctcttcgacttcctcctcagattcgaagctacgacgaagagcaagctggcaagtttgaacgagaagctggacatcctagagcggaagctggaggtgcttgaagtccaagtgggcagcgcgacgaccaacccttccgtcttcaactaggaatcgcgggtttatatgtttaaataaataaatgtaggtatgaatgttgcttgtaccaacgaattctggtcgctatcaatcatgtaatgtaatgtaatggattttgttattattattgtggtatgtgtaaagatgtgcagaaattgaaaaaaaaaannnaaaaaaaaaaaaaataaaaaananaaaaaaaanaaaaaannnnaaaaannnaaataaagaataataaaattntttttttatttnttttttttttttcttttnnnnnagaacttataaaagagagatttgccgcccttggggggtgggttactaggtgtgattaccgctgtcccctgtttatacctttctgtatatagaaaaaccccnngtgaaagcccccccgcan

SEQ ID NO: 57594 - protein, 84 aa, Zea mays
  misc_feature: Ceres CLONE 1506893
MGRGGGMGNPVNVGIAVQADWENREFISNISLNVRRLFDFLLRFEATTKSKLASLNEKLDILERKLEVLEVQVGSATTNPSVFN

SEQ ID NO: 57595 - DNA, 1050 bp, Zea mays
  misc_feature: Ceres CLONE 1506896-R
tctcgtttttcttttttttttttcaggagcacaggagctatttgtccattggaaccaagatggatgcaatgtacacgtacgcacgcacacacgttacaaagtcaccacctgcaggcacctgccggccggaggcgcgatccaggctgctgagtctgatcttaactacgacaacgtacggatcttgccgattatctggtcgagggcgccggtgttcttgagccctagcacgatgccgacgccgaggatgtggccaacagcgccgcaagccttcttgtcgccgagggtgaacccggcggggtcatccggttgcatgccggagccgcgcccctccaacttgagccgccgccgtcgacttgagtcttcgccgacagcagaagcgtgaaccgccccccgtataggagtgcggcggttgtcctccacatctttaggtctgcttccccggcccccatgcactttgaccatgatggccggccacagacgacaacctataggacccaactacgccgtttcggccgggataacccccgacgaatcctctcttttgaagggatcccacgattcggtctcttgtaaagcaggtcatccccgaaacggatactcttggcgtgacccccgctatccggcgacccgggggggggttcaatacggccaaacgtacgcgcccatttagagcccccgggcactccccctccccatttataacaaggcaccggggtgttgcgggaaatcccggggggggacactcccccagttgccacctttttcctgggtggcgggataaacaaatagcccgggcccccccgcccgccctttgagtaaaagtagaaaaaccgtcccctccttgagtcctcccgcagacatcccaaattctcttattccatgtaagggaaggtgttccattgggaccccccgggggttatctccctgtcgagtgagtgcacttttcccgttgtagacatgcggtgactccctctaatattgcccacccacccttcaacaccggtaaatgagtatcgccgttacccctgtgtgtgttcaaaagcttcatct

SEQ ID NO: 57596 - DNA, 783 bp, Zea mays
  misc_feature: Ceres CLONE 1506901
  misc_feature: Encodes the peptide sequence at SEQ ID NO. 57597
aaactggagctccccgcggtggcggccgctctagaactagtggatcccccgggctgcaggaattcgtctcacccctagaaaaaccctcgcgcaccgctcctgtccaccctgccaccgccgccgccgccccgccgcatcaactgtcaccgtcgctatggcccgtatcaaggtgcacgagctccgggggaagagcaagacggacctgcaggcgcagctcaaggagctgaagtctgagctctccctcctccgcgtagccaaggtcaccggcggcgcacccaacaagctctccaagatcaaggtggtgcgcacctcgatcgcgcgcgtgctcacagtgatctcgcacaaccagaagtcggcgttgcgggaggcctacaagaagaagaacctgctccccctcgaacctccgccctaagaagacccttgccatccgtcggcggtctgacccaggacccagcttttccctgaagacccgagaggggaaaagaagcgtggataaggaactttcccccttgaagaaaagatgcgctatccaagggcccaaggtcaaaaactgtgtgaaattcctgtgctttaaacaaaacctccgggctgggggttaaaattttaaggggttggaacgggaccattttggtttgaaagacacaaagttatttccccccgggttccccatataaatatggcctgatttgggcttttaactgggcatatttcctttttgtggcccttcatttttttgggggggaaaaaaaaaaaaaataaaaaaaaggccgcccgcctgggtgc

SEQ ID NO: 57597 - protein, 85 aa, Zea mays
  misc_feature: Ceres CLONE 1506901
  misc_feature (6)..(64): Pfam Name: Ribosomal_L29 Pfam Description: Ribosomal L29 protein
MARIKVHELRGKSKTDLQAQLKELKSELSLLRVAKVTGGAPNKLSKIKVVRTSIARVLTVISHNQKSALREAYKKKNLLPLEPPP

SEQ ID NO: 57598 - DNA, 902 bp, Zea mays
  misc_feature: Ceres CLONE 1506903
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (20)..(20): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
nnnnnnnnnnnnnaaggggntttcccnnnnnnnnnttgttctttatcatgctgggctccccgcggtggcggccgctctagactagtggatcccccgggctgcaggaattcctctcacccctagaaaaaatttctgctcttctgccgtctagtcctttgtactgaccggcgctccggtcggctcctcgcgcttgcgggttccccgtccccaccccagggcgggggtaattgttgtagaacccgcggtcgcccctcgcattggtgcgccccttcctgccccagccgcaccggttatctatcccgccgcccctcttctcgcctttcttctctgtccggccatccccctctcccccctgaggccgtccctcttgcgggggggttgtgtttgtcggtcttatcttccccgcggcgccccgcgcactctttttcttcgcccccctctctcttcggggggagggggggctccttgctgtcccctttctctccctctcctcctgtggcaccggtgatgtataggctgacgcctgctgcctgtcctgccgtgtggtgtggtgttttgtctttgtggccggcttcggcgcgctgtcgccgccgccccgcggcccccgcctccgcgctacggctcgggctgctcctgggttgtcacttgctgaatggcgggcatgtccttgtgcccgtccgtttctttctatgccgggtccggctttgccttatttgcgcgcctttttgcgtcgcttctgtcgtcccccccccctccctcctcctcgtcctctgcctcttctgctcccccgccggcctccctctccgctcccccccccccgcttgccgctccgcgcctcgcgggcggcggttcggccgcacgcgctccggccgcgaccgcgattccgcgtgcggacgtcgcgg

SEQ ID NO: 57599 - DNA, 779 bp, Zea mays
  misc_feature: Ceres CLONE 1506906
  misc_feature: Translation starting site: 250
  misc_feature (406)..(406): n is a, c, t, g, unknown, or other
acgctggagctccccgcggtggcggccgctctagaactagtggatcccccgggctgcaggaattcgtctcacccctagaaaaagagcctgacccttacgccttcgctcgcgccgccgccgccgccgccgctacgccccgcacctcgcttcatttcgtgtcgccaagatgacgaagcgcactaagaaggcaggaattgttggcaaatatggaaccaggtatggtgctagcttgcgtaagcaatcaagaagatggaggtatctcagcattccaagtacttttgcgagctctgtgggaagttgggtgtgaaaagaaaagcctgggaattttggggggcaacgcactgtgggaaggggaaagttggtttgttctcccccccgggagggggaggggggggggccccttccntaactcctttcctccccccttaaggagacaaaatgaaccttgcattttactctgttgtggtagggggggggtttccgtgtgattctcccctctccggccttgttttattgaggccacctaacccacgggaaaaagaggtgaacacccgtgtggcgcggtgttattgcccaaaaacacaaccgccccctaacgcttggcggtatcgccgccttggatatttccgaaactctctccttcgctacaacactccccacccctccatgaatcctaaaataaatctccttcgcccttgagatcgctccctaccccccctccaccgagacatatatatccacgtcttcctcttctactcttttcttatttcttatcccag

SEQ ID NO: 57600 - DNA, 896 bp, Zea mays
  misc_feature: Ceres CLONE 1506907
  misc_feature: Encodes the peptide sequence at SEQ ID NO. 57601
  misc_feature (12)..(12): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
tttttttttttnttttgttttttggnnnnnnnnnnccccccaannnagcaagctgggactccccgcggtggcggccgctctagaactagtggatcccccgggctgcaggaattcgtctcacccctagaaaaattcttttcataaaacgaccccaccccgaaaatctccccgctcacaaagcagtcctcccaccgcacgcaacgcagcctcgacctcgacctcgccgtcgccatggcgagcaagcagacccgccgcctcttcgtccttgccgccgtcgccgtatgcttcctcctcctcctcctcccagcctcctctgtcgccaccgacgtcgattactgccgacaaaagggagtacccagtgtaaggtgagcggggtgcatgatccgagcccgatcacggtcgaagcccggccaagcctggtcaatttgaagaaactccggcttcgagtggaaaaaacccctccaggaagggggaagcccgggcccccccaacggttggaggaccaccatccctcccaccgtggccactccgagagaacccgcccataaaatactgacgaaatagaataccccctgtgtccgcggggaaaccggagagatattccgttgtgggtccctcattatattataaagttttgcacctgggttcaacttccccccccggagggctgtgtgccccgctcctctctatttgtacctattcgctcctgcgtcaccatcaaccgcataggtcgcgggatctggtcgagatatattagcgccgttccgctctttgggggcaagcggaacagcgcacaaatatgaataccggacccgtgaagaggcgcccccctcaaagagcacccggtcttagagagggggacctcagtcagcgctcccccagtacacaaccgacta

SEQ ID NO: 57601 - protein, 45 aa, Zea mays
  misc_feature: Ceres CLONE 1506907
MASKQTRRLFVLAAVAVCFLLLLLPASSVATDVDYCRQKGVPSVR

SEQ ID NO: 57602 - DNA, 735 bp, Zea mays
  misc_feature: Ceres CLONE 1506908
  misc_feature: Encodes the peptide sequence at SEQ ID NO. 57603
aaagctggagctccccgcggtggcggccgctctagaactagtggatcccccgggctgcaggaattcgtctcacccctagaaaaaaaaaaactccctccttgttttcatcgctgtcgtaatctctctccttctcctggagagcgtactgcttggaagacgaccaccaggagcgggtcttagcggagaggtcagccgccgaccagattgctctcggccacaccgcccacgctcatttcccctgcgctcacaccaccattgctgcgcccctccggtgatcgtcccaaatgctgacccgacggtgccggctgaatcactgaagccccctcgagcgatcgctccacatactaaggatccagcttctacacctccgcccccatgcttctaaggaggacaacaggatctaaacaatattcctggtacctggaatctcaaggcccaaatctagaccaggcaccacaggatgaggagcttgtagaatgctccaacgacttctacatacgtctaggacgccatctccccgtcaactatgggctgcaggaccgccgtcccctgataatgtaactatttattctggataaaactcctgtgatatgtaaagatgtcaaattcgatcctgtgccactatacctaatatgtatgaagacttggtcccaaaaaaaataaaaaaaccgagaaccctaaaggcaccctcttcccccctaaaggaaggccatctttccctgcgctcactggctt

SEQ ID NO: 57603 - protein, 61 aa, Zea mays
  misc_feature: Ceres CLONE 1506908
MLLRRTTGSKQYSWYLESQGPNLDQAPQDEELVECSNDFYIRLGRHLPVNYGLQDRRPLIM

SEQ ID NO: 57604 - DNA, 760 bp, Zea mays
  misc_feature: Ceres CLONE 1506916
  misc_feature: Encodes the peptide sequence at SEQ ID NO. 57605
  misc_feature (760)..(760): n is a, c, t, g, unknown, or other
aaagctggagctccccgcggtggcggccgctctagaactagtggatcccccgggctgcaggaattcgtctcacccctagaaaaagcagccaaccatctaccagcgactcagcgagcgagagcagcacacacgcagctagctaggagcagcagcagagcagcggcgatggcggcctccatgatctcctcgtcagctctggcggtggcgcctcagggcctgccgcccctcggccgccgcgcctcctccttcgccgtcgtctgctccaagaagaagatcaagaccgacaagccctacgggattgggggtggcctgaccgtctacgtcgacgccaacgggagaaagggcaagggcaagggcgtgtaccattttgtcgacaagtacggcgcgaacgtggacggatacagcccaatctaccacgaggatgactggtctcccaccggcgacgtctacctcagtggaaccactgggcttctgatctgggccgtcacccctccctgggatcctcggggggcggggcccttcctctggtaagagaaccaggcgcccttctccgggctaaaggatatccattggcatgcgcttttcttggccatttcgtccttggaaaaacccagggttgttttgctttattaatccttgccctcccatggggttggcccaaccctttcgccatggtgaacaatgtaattccatcgcaattctctttccattcaccaaaatttgtgaatgcctgtaaaagtattaagtccgcccaacactn

SEQ ID NO: 57605 - protein, 121 aa, Zea mays
  misc_feature: Ceres CLONE 1506916
  misc_feature (32)..(117): Pfam Name: PsbR Pfam Description: Photosystem II 10 kDa polypeptide PsbR
MAASMISSSALAVAPQGLPPLGRRASSFAVVCSKKKIKTDKPYGIGGGLTVYVDANGRKGKGKGVYHFVDKYGANVDGYSPIYHEDDWSPTGDVYLSGTTGLLIWAVTPPWDPRGAGPFLW

SEQ ID NO: 57606 - DNA, 685 bp, Zea mays
  misc_feature: Ceres CLONE 1506917
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (33)..(33): n is a, c, t, g, unknown, or other
  misc_feature (39)..(39): n is a, c, t, g, unknown, or other
  misc_feature (40)..(40): n is a, c, t, g, unknown, or other
  misc_feature (43)..(43): n is a, c, t, g, unknown, or other
  misc_feature (44)..(44): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
nnnnnnnnnnnnnnnnccccccgcgggggggtntttttnnccnncnnnnccacnnnnnnnaagctgggactccccgcggggcggcgctctagaatagtgctcccccgggctgcagattcgtctcacccctagaaaaactcaaccaccggcccgagatctccccttctctctcctcgggccgttttcctctctacctctttgatccggcaatggtcgcgccccgcccctggccaacagggggggaccttcttacgcggggagccccctggggctaccgctgtccctcttgggtgtgaagaaaaagcggtctttctgggggtccgggggggggggggctaaaaacaacccggcggggcgggggtcatcgggcggcccccttttcaggggggggggaaaatattgaggaggtgcctccacgcaaaaagggattagtgggggggggggacgccccccacaaacggggggggggcgttgtgtggcggcggggggtcattatccgtttttgttttccgcggcgccccgggggaaggggagggggggggggggggggctaatattttcccccactccggaatgatggagtcagcggtggggagtaaggggtgtgggccgcaccgccacggagtggggtcgggacggggagggggggggaggtagaactcccgagggggagggatgagagggg

SEQ ID NO: 57607 - DNA, 784 bp, Zea mays
  misc_feature: Ceres CLONE 1506918
  misc_feature: Encodes the peptide sequence at SEQ ID NO. 57608
aaagctggagctccccgcggtggcggccgctctagtactagtggatcccccgggctgcaggaattcgtctcacccctagaaaaaagcaagcgccgcatccctcgcctcttcccgacttcccccctcgattcgatccgagcttacttctagggttcttggccccgctccaccgtcgcccatggcagacgatgccaaccgagcggccttcatggagctgcagtcccggatgatagataccaccgcgaagatcaagcagttacaaacccaaatgcgttctaaagaaggggaaaagaagcgtgcctaccttactttggaggaacttccccagtttgcagatgataccaacacctacaagactgtcgggaaaaggggttattctggaacccaaattccgttcttgttccatgaacagggaccaaaagcttaatgggccggggagaagggcgataagccttacaaggcaaaacatcccaaaaaatccccttggaaaaaaaccacgggcctaaatgggaaaaaaaattttagggggggggttgtttcaaaaggacccccggatatttggccgctcaaaaaccccctcataaagccgtttaaaagagaggatgttttttcccccccccatttaatttttattaaaaaaaatttgaagaggccacccacttttataaccccccgcggggtggcgcctccctttattcgggaaataactgcggggcccgtgaaatataaaggattttttcggggggaaaaagaataggggacatatattctctcacccccaata

SEQ ID NO: 57608 - protein, 82 aa, Zea mays
  misc_feature: Ceres CLONE 1506918
MADDANRAAFMELQSRMIDTTAKIKQLQTQMRSKEGEKKRAYLTLEELPQFADDTNTYKTVGKRGYSGTQIPFLFHEQGPKA

SEQ ID NO: 57609 - DNA, 739 bp, Zea mays
  misc_feature: Ceres CLONE 1506922
  misc_feature: Encodes the peptide sequence at SEQ ID NO. 57610
  misc_feature (739)..(739): n is a, c, t, g, unknown, or other
acccgcggtggcggccgctctagaactagtggatcccccgggctgcaggaattcgtctcacccctagaaaaaagccaagcaaataagacgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacgcctgcggctgcggtaccagctgcaattgcgacccctgcaactgctgatcacatcgatcgaccaccattggatataataataacctacctacctggggggggtgggttgaacaataataaagccaggcccaaactggcttcccaaacatagagaattgggtggtagtggaaaaaaaaaaaaaaaaaaaaaaatccttccattttgctaaacctctccccccagcaagttttgggggacaaaccttttgggccctaaaaagacggggctacacccccccacttttttggttaaccccaatccccctccccggatacacacaattaaaaattggcgccccccataaaaaaaatcatttctctcccataatacacacccaacacaccccccctccttcttctaaaaaaaaaan

SEQ ID NO: 57610 - protein, 76 aa, Zea mays
  misc_feature: Ceres CLONE 1506922
  misc_feature (1)..(76): Pfam Name: Metallothio_2 Pfam Description: Metallothionein
MSCNCGSSCGCGSSCKCGKKYPDLEETSTAAQATVVLGVAPEKKAAPEFVEAAAESGEAAHACGCGTSCNCDPCNC

SEQ ID NO: 57611 - DNA, 848 bp, Zea mays
  misc_feature: Ceres CLONE 1506926
  misc_feature: Translation starting site: 268
  misc_feature (1)..(1): n is a, c, t, g, unknown, or other
  misc_feature (29)..(29): n is a, c, t, g, unknown, or other
  misc_feature (30)..(30): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (46)..(46): n is a, c, t, g, unknown, or other
  misc_feature (59)..(59): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (80)..(80): n is a, c, t, g, unknown, or other
naaagggccagagcatggctgccataggnnccnnnncaagggaggnagagatatcttgnatggcgnnnnnnnnnnnnncnccatagctggactccccgcggtggcggccgctctagaactagtggatcccccgggctgcaggaattcgtctcacccctagaaaaactccggtcacaagcctccacagaactctccccgactttgccgtccactcccccgccgcagccgcgccgttcgccgggacaggagggatagtagagcaccaggatgccggcgacgccgacgatcatcggtgccctcctggggctggccacccagatgtactcaaacgctctccgcaagctcccctacatgcgccctcccatgggagcctttggttggggaaggggtcctccggtgccatggtttgtcaaccccacctggcaaaagttttgattaaaaaaactctcaagaaagaacctcccaacaaagaatctcttgaaaagccgcccaggggttaagccaaaagaaagaaggcctttacatttttcaccaaaaaatattaaaaaaaaggaggcccccccagaaattttttttttccccccgccccctcggggaattttttttttttccccacactgtgtttgtgtacaacacacccagcccccccgcggtatggagtaattccccccccccccggccgaaaaatcttccccaacgatttccccccattttaccacagtgggactttttctaataaaacaagagcggccccccaccctggtgataccccccccaggcgacaacccccccccttttggtgggtttttttaatccttagtggggttgcttctttctctaaaaaaaaa

SEQ ID NO: 57612 - DNA, 821 bp, Zea mays
  misc_feature: Ceres CLONE 1506927
  misc_feature: Encodes the peptide sequence at SEQ ID NO. 57613
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (21)..(21): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (561)..(561): n is a, c, t, g, unknown, or other
ttttttnnnnnnttttgtgtnttttttnnnnannnnnnggcgaaannnggcaaactggagctccccgcggtggcggccgctctagaactagtggatcccccgggctgcaggaattcgtctcacccctagaaaaaaccgcagcacagcgccggcaaccgccgccatcgatcgatcgcccggaaactgacctctaccgatgtctggagccggcgaggaggataagaagcccgcggagggcggcgcccacatcaaccttaaggtcaagggacaggatggcaatgaggtgttctttcgcataaagaggtccacccagctgaagaagctgatgaacgcctattgcgaccgccagtctgcggacatgaatgccattgcattcccgtttgatggccgcaggcttctcggcgagcaagacccctgatgagctggacatggaggacggcgaccagatccccgcccctgcttccccagaccggacgcagaggttcctagcccccccctaaaagcagccgcctgcggaaccccctgtttcctctccccccctgcgtaggacttaacaaaagnggaaaaagtcttttccaaggaagcttgcggaagctcctggcatacctgtagcccattgggtacaaggaactttccctcacccttttcacttataagagacaggcttgcggcactttatttttcccgtcaacccacctgttttgtactcaatcccctacaagccctgggcccccgcgagggtgtcgtccatcctccaactgcgcaatctgcgcgacccggggttcctcccgttagtgggatattaggtaagtgtggctccg

SEQ ID NO: 57613 - protein, 73 aa, Zea mays
  misc_feature: Ceres CLONE 1506927
MSGAGEEDKKPAEGGAHINLKVKGQDGNEVFFRIKRSTQLKKLMNAYCDRQSADMNAIAFPFDGRRLLGEQDP

SEQ ID NO: 57614 - DNA, 911 bp, Zea mays
  misc_feature: Ceres CLONE 1506930
  misc_feature: Encodes the peptide sequence at SEQ ID NO. 57615
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (28)..(28): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
ttttttttttnnnnnnnnnnnnngaggnacnnnnnnttttttgtnnnttcaaagctggactccccgcggtggcggccgctctagactagtggatcccccgggctgcaggaattcgtctcacccctagaaaagcgcaaacatcgaatcgtctcactcgtgtctgccctgctcatactgcttgccctcgccgtatcgtccacccgcaacgcacaggaggattccatggccaacaacaccgggacgttggtgggcggcatccaggacgtgccggggagcgagaacgaccttcacctccaggagctcgcccgcttcgcggtcgatgaagcacaacaggaaggccaatgctctttctggggtccaaaaaacttgggaaggcccaaaaaccaagtggtttgctgggcccgatgtcccatcctcacttattgaaatttaaggaatggcggaagccaaaaaacttctcccaaagctttgagggatgggataaaaccccccggggaaaagtttccaaggggacctttcgagaaattcccaacccctctcttaaaaaagggggctctaacgcccccctaaaaggattctcgcccctttcgccctgttgtgcgaacccgcgaaaccctcataaaccaaaatcttttgtataaaaaataagggggtcccgtgtgccccccctttgttgttaatattcttagaaaagactctcccctccctctttctcggcgcttttttctttcttcgttctctctctctcctcgcaaggatataaaaagagggggtaaataatttctcccctcacttatttataaataaggtgggggtttttttttttcctttcgccttttctttttttgtattctcttctcattttataaaagcaataacgcccaaaaagaaagacccccttctccactccc

SEQ ID NO: 57615 - protein, 67 aa, Zea mays
  misc_feature: Ceres CLONE 1506930
MANNTGTLVGGIQDVPGSENDLHLQELARFAVDEAQQEGQCSFWGPKNLGRPKNQVVCWARCPILTY

SEQ ID NO: 57616 - DNA, 743 bp, Zea mays
  misc_feature: Ceres CLONE 1506932
  misc_feature: Encodes the peptide sequence at SEQ ID NO. 57617
caagctggagctcaccgcggtggcggccgctctagactagtggatcccccgggctgcaggaattcgtctcacccctagaaaaactctgccgtcgcctgtccactttccccgtgcttctccgccgtcaaggccgcgtcccagtgcgaagagactccgactcagatggccagccgctgggtccgggccgaggtgtacccgctgttcgcggcgacgggcgtggccgtcggcatctgccggtttcagctcttccggaacatcactggcaacccggaagtctcggtaaacaaggcagggagggcagctggcgtgcttgagaaccatgaggaggggagacgttacgccatgcatggcctaagaagctttgtgcacgacaagactcctgagatcatgcctgcagttaacaagtttttcactgacccctaactgaagcatgtcgatttgcatactactactactacctgctactggggattttaccctttgctggcacctcattttttggggaactcccctgaccccctaaaatacttttaaccccttgggtttcaccttggcatttttccaaggggggataaatttgaaccccccccgcctgaagtgtcgaatctccccggtccccccggattttggccccctcccggggagaaaattggctttggaaaaccgggaaaaaaaaaaaaaaaaaaaaaggcgtgcaaagttcccatgtgcccctctcaggagaggattataccccccccccc

SEQ ID NO: 57617 - protein, 86 aa, Zea mays
  misc_feature: Ceres CLONE 1506932
  misc_feature (2)..(87): Pfam Name: B12D Pfam Description: B12D protein
MASRWVRAEVYPLFAATGVAVGICRFQLFRNITGNPEVSVNKAGRAAGVLENHEEGRRYAMHGLRSFVHDKTPEIMPAVNKFFTDP

SEQ ID NO: 57618 - DNA, 652 bp, Zea mays
  misc_feature: Ceres CLONE 1506937
  misc_feature: Pfam Name: TGS Pfam Description: TGS domain
  misc_feature (430)..(430): n is a, c, t, g, unknown, or other
tggagctccccgcggtggcggccgctctagaactagtggatcccccgggctgcaggaattcgtctcacccctagaaaaaatatgttgtcaacaagattgatcagataacactcgaggagctggaaatcttggacaaacttccccattactgcccggttagtgctcatcttgaatggaatcttgatggacttctggagaagtatgggaatacttggatttggttaggatatacacaaaactaaagggctgacccagattatgaggatcctgttatcgtatcatctaagaagaaaaccgtggaagatttctgcgacagaatccacaaggacatggtcaaacaatttaaatacgctctggtatggggttccagtgtgaaacataagcctcagagagttggcaaggagcatgagcttgacgatgaagacgtcgntcagatcattaagaaaaatatagcgtatcatgtggtggaccaaacctgtttttctggaaaactggaagcgtttaagattttgttaaaaaaagccctcccaaaaaaaccttgaacccggcctttgcttgttgggggagcccaaattaaaggtccccggtccccaaaaaatttctttgacccaaaaaaattgggagcgggctttttttttttaaaccaggcctg

SEQ ID NO: 57619 - DNA, 722 bp, Zea mays
  misc_feature: Ceres CLONE 1506942
  misc_feature: Encodes the peptide sequence at SEQ ID NO. 57620
aaagctggagctccccgcggtggcggccgctctagaactagtggatcccccgggctgcaggaattcgtctcacccctagaaaaaacaagccgcaccgcaattagccgcgaccctccgcagaatcggctcacgtttccgatccagaggtccagactgttccccgagttttcccactgtgtcctctcctcgcgagtcccggcgaagcaggcgaaccgcgaacatgtgccccaccggcaggtacctggggctcgacctctccggcgctggcggcgacctgaggccggcgttcgacgtgcttgacgcggaccgggacggccggatcagccgggacgacctcaagtccttctacgccgccgcgaggcccgccgccggcgaccggttcgacgacgacgacctcacttccatgatcacggccgccgacgcctaccgcgacggcttcgtgcaatacgacgagttcgagcgcctgctgagcggccgcgccgcggaggccgccgccgccgcgggaggcgctgggcgccgctcccacatggagggcgccttccggctcatggaccgggacggggaccgtatggtccgcttccaggacctcaaggactacctcgactggtccgggatgccctgctgcggacgaggacggccccgacttgatccacgtccctggcttaggggactggcggcgatagggtggggctctaggcccttactcggagtgatggcggttt

SEQ ID NO: 57620 - protein, 167 aa, Zea mays
  misc_feature: Ceres CLONE 1506942
  misc_feature (18)..(46): Pfam Name: efhand Pfam Description: EF hand
MCPTGRYLGLDLSGAGGDLRPAFDVLDADRDGRISRDDLKSFYAAARPAAGDRFDDDDLTSMITAADAYRDGFVQYDEFERLLSGRAAEAAAAAGGAGRRSHMEGAFRLMDRDGDRMVRFQDLKDYLDWSGMPCCGRGRPRLDPRPWLRGLAAIGWGSRPLLGVMAV

SEQ ID NO: 57621 - DNA, 744 bp, Zea mays
  misc_feature: Ceres CLONE 1506946
  misc_feature: Encodes the peptide sequence at SEQ ID NO. 57622
  misc_feature (51)..(51): n is a, c, t, g, unknown, or other
  misc_feature (403)..(403): n is a, c, t, g, unknown, or other
cgtagctggagctcaccgcggtggcggccgctctagactagtggatctctngggctgcaggaattcgtctcacccctagaaaaaaaccccaccgcagcacagcgccggcaaccgccgccatcgatcgatcgcccggaaactgacctctaccgatgtctggagccggcgaggaggataagaagcccgcggagggcggcgcccacatcaaccttaaggtcaagggacaggatggcaatgaggtgttctttcgcataaagaggtccacccagctgaagaagctgatgaacgcctattgcgaccgccagtctgtggacatgaatgccattgcattcctgtttgatggccgcaggcttcgcggcgagcagacccctgatgagctggagatggagggaggggcgacganatccaccccttgcttccccacaccggaggcagcgttcctagcaccccctaaaagcagcagctgcggagcctcgttttgctctccccccctgcgtatactaaaccaaaaggaaaaagccttttaaaggaacttgtgaatgctctgggtcccttgggccctttgctgagggacctcccttagccgttttctgagggggacggggtgggccctccggggccgccagcgcccccgttgaactaccccctagagccggcgccccgtgttttgttctctgtaaaacaacccgcgagaacgctggggcgcgccggggtcccccgttttggtcccccccgcgcgccccg

SEQ ID NO: 57622 - protein, 124 aa, Zea mays
  misc_feature: Ceres CLONE 1506946
  misc_feature (21)..(88): Pfam Name: ubiquitin Pfam Description: Ubiquitin family
  misc_feature (84)..(84): Xaa is any aa, unknown, or other
MSGAGEEDKKPAEGGAHINLKVKGQDGNEVFFRIKRSTQLKKLMNAYCDRQSVDMNAIAFLFDGRRLRGEQTPDELEMEGGATXSTPCFPTPEAAFLAPPKSSSCGASFCSPPLRILNQKEKAF

SEQ ID NO: 57623 - DNA, 801 bp, Zea mays
  misc_feature: Ceres CLONE 1506954
  misc_feature: Translation starting site: 198
  misc_feature: SWISSPROT Homolog: EC 1.13.11.12 Lipoxygenase
  misc_feature (7)..(7): n is a, c, t, g, unknown, or other
  misc_feature (19)..(19): n is a, c, t, g, unknown, or other
  misc_feature (30)..(30): n is a, c, t, g, unknown, or other
  misc_feature (33)..(33): n is a, c, t, g, unknown, or other
  misc_feature (34)..(34): n is a, c, t, g, unknown, or other
  misc_feature (39)..(39): n is a, c, t, g, unknown, or other
  misc_feature (43)..(43): n is a, c, t, g, unknown, or other
ggaaccnacaaaaaacaanaaaaaaaacanaannaacanccancagttacaaactggagctccccgcggtggcggccgctctagaactagtggatcccccgggctgcaggaattcgtctcacccctagaaaaagactcacactcacacagcaaataccccacaaggccactccaaagagctagtagtggaaccgaagatgttcgggaacatcggaaagatccccatcatcggcgacctgacgggcagcaacaagaatgcgcacctcaagggcaacgtggtgctcgtgcgcaagaccgtgctcggcttggacgtcaccagcatcgccggctccctcctcgacggaatcggccagttccttcggacgcggcgtcacctgccagcttatcagctccaccgtcgtggaccctaacaacgggaaccgcgggaagttgggccgccgaggcgagcctggagcagtggctgctgaacccgccgccgcttctgaccagcgagaaccagttccgcgtctccttctactggtaggtggagaagcagggcatcccgggcgccatcatcgacaagaacaaccaacgcctccaagttcttcctcaaaaccattcaccctaaacgacgtacccggtccacggcaccatccgtctttcgtctccaaactcctggtatctaccccgcaaaaccaagtaaccgcatacaaacatccgcctctcgttcctccaacaaacagtgcagggacgtccgtgaacacaccgatccggtgagctccattagggaaaaaaccaaacccttagaggaagccaaggtga

SEQ ID NO: 57624 - DNA, 737 bp, Zea mays
  misc_feature: Ceres CLONE 1506955
  misc_feature: Encodes the peptide sequence at SEQ ID NO. 57625
gagctggagctccccgcggtggcggccgctctagaactagtggatcccccgggctgcaggaattcgtctcacccctagaaaaaagtgctctctcctcttgcgattcgctcgctcgatcctagcttcccttccaagaagcgcagcgcccatggccatggccacgcaagcctccgccgccacgcgccacctgctggccgccgcctgggcgccggcggcgaagccgcggcagctgagctcgcagctcgcgctgccgtcgtcgtcctcccgcgggccggccccgctccgcgcgtccaccgaggaggcggtggaggcgcccaaggggttcgtggccccgcagctggaccccagcacgccgtccccgatcttcggcggcagcacgggcgggctgctccgcaaggcgcaagtggaggagttctacgtcatcacgtggacgtcccccaaggagcaggtgttcgagatgcccaccggcggcgccgccatcatgcgggagggccccaacctcttgaagctggcgcgcaaggagcagtgcctggcgctcggcaccaggttgcgctccaagtacaagatcacctaccagttctaccgcgtcttccccaacggcgaggtgcagtacctccacccccaggacggcgtctaccccggagaaggtcaaccccccgcagggagggcgtcgggccagaacctccgccagcatcggcaaaaaaggtcaaccccatcgaacgtccagtttcaccggg

SEQ ID NO: 57625 - protein, 196 aa, Zea mays
  misc_feature: Ceres CLONE 1506955
  misc_feature (62)..(196): Pfam Name: PsaD Pfam Description: PsaD
MAMATQASAATRHLLAAAWAPAAKPRQLSSQLALPSSSSRGPAPLRASTEEAVEAPKGFVAPQLDPSTPSPIFGGSTGGLLRKAQVEEFYVITWTSPKEQVFEMPTGGAAIMREGPNLLKLARKEQCLALGTRLRSKYKITYQFYRVFPNGEVQYLHPQDGVYPGEGQPPAGRASGQNLRQHRQKRSTPSNVQFHR

SEQ ID NO: 57626 - DNA, 713 bp, Zea mays
  misc_feature: Ceres CLONE 1506957
ggatcccccgggctgcaggaattcgtctcacccctagaaaaatacctcagcaccaccacaaaaaaatccctgctaccactgcagggtcctgaattgtctatcactcatggcatctggctggttagcgtccatattccccgtctaaccctatgctcagagaaaaccgtccaccgatcggttgagttatacggcccctggtgtgctcaccaagggattgagagtgtcctggcatttgtggtgacactcgagaatgctgtgcgaacgtctcttaaggcgagaccaactggcccaacgatcttgatgcagctggacgacaatggccatgagattgagaatccacttactctgttgaatgatcccccctctcgtgagccactctccatctgggctgagagaacgtcctactgtggcggcttcatgtttacatcactgacggaagatggtattctcaacggaggtaatttagctccttttggaggcaccggaccaccctgatagactccatgggctgaaaccaccaccgaacttccatccaaggtatatgataagatttcaaagcctgacaatagggacttgttcagaggcaacgaatccttttcctctcctaaagaaccccccataacctaaaaggggaaccctctatgggcaagatcactggaccgcataaacccccgggaaaatgtaaatgtaaaacctcgttgcaccccaaacaa

SEQ ID NO: 57627 - DNA, 957 bp, Zea mays
  misc_feature: Ceres CLONE 1506973
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (907)..(907): n is a, c, t, g, unknown, or other
tttgtgggtgttggggggggnnnnntttgtatcacaaaannnnnacaaagctggagctccccgcggtggcggccgctctagaactagtggatcccccgggctgcaggaattcgtctcacccctagaaaaagctccagctccagccccaccttccagaaactgctcgtacgatctcaagaacgccgcctccccggttcccgcacccccgtcgccgcgccggtagtctgcccgtcgccgtctcctcctccaggtgaaggcgaaagtgaagcagcaggatgggtcgggaaggccggtgtcttgtaccaaaacccaaagaagttggtggttatggtcaagccttggaggccggaaatgcgttgccttcctcccccggcccgcctcttaaacaaacggaattgggataaggggcttcaaggcttatttttgttttttggcgtgccacggggggggggggctgggataatgggaacgccccaaaaaaccctctcccccccacccccttctttatgtctgcgtctttttggtcctcattgagcgcgattggagaggggggggtggggttggggttgggtgaattatgtacgtttttttgagtattacacggcgagcggacgccgcgctccccgcggcgcgccgctcccgctccgcacccccgtctgtttgtttgtgggggcgcccctttgcgtttaattatataggcgccccgcactgcatcacttcgtgttcgcttccttttttctttacgcgcgagacttgctagctatcatccttcatagggtccaacattaccacccttccccctctatccgccctgcgcacgcccccctaacacacgccacacccccttgctccggcgcctcaccctccctgcgcccgcccccgctcccccgcgccgctttctttgggngccctttccactgcgtgaacctattccgcagacggctctgcacctcccct

SEQ ID NO: 57628 - DNA, 723 bp, Zea mays
  misc_feature: Ceres CLONE 1506981
  misc_feature: Encodes the peptide sequence at SEQ ID NO. 57629
ctagaactagtggatcccccgggctgcaggaattcgtctcacccctagaaaaaaatcaatactatactactatcacagtaggaagctaggaggaaaatcaaagcaacaaagttgccggccggccgagagaagcaaccatgagacctcaggcgtcgttactcgtcgtcacactggctgttatcgtcgtcgtccttgcagctctgccgctcagcgaagggacggaggaggaaggaggaggggcggcagtcgccgccgtggacgccgccggaacgagctcgtggccatgctgcgacaagtgtggtttctgctacatgtctgacccaccgcagtgccaatgcctggacttctcgacggtcgggtgccacccatagtgcatgcagtgcatcacgtacaccgccgacggcggcgtcgacatctcggcccgtgcacacctaccgctgcgccgacatcctcttcaacttctgctagccgccgctgcagtactcccccccccaatttctgctggcacccgcattagacggattgccttttcatggccatccgttgccccccctggggtggccgctttcccaaaaaaacctcaaataaaagtttccctccttgcctcttttttggttggcttgccccccccccccccttgaaaaaaccccacaatttccccttctttctttgctaatttggcccaaaccttccttaacaatttcaaaaacacacatggcgccc

SEQ ID NO: 57629 - protein, 77 aa, Zea mays
  misc_feature: Ceres CLONE 1506981
MRPQASLLVVTLAVIVVVLAALPLSEGTEEEGGGAAVAAVDAAGTSSWPCCDKCGFCYMSDPPQCQCLDFSTVGCHP

SEQ ID NO: 57630 - DNA, 767 bp, Zea mays
  misc_feature: Ceres CLONE 1506987
  misc_feature: Encodes the peptide sequence at SEQ ID NO. 57631
  misc_feature (398)..(398): n is a, c, t, g, unknown, or other
  misc_feature (408)..(408): n is a, c, t, g, unknown, or other
  misc_feature (424)..(424): n is a, c, t, g, unknown, or other
aaagctggagctccccgcggtggcggccgctctagaactagtggatcccccgggctgcaggaattcgtctcacccctagaaaaaatcacaattcactccactcatcttttctcgtttagaacctctaaaatttcccccactcgccagtcgcagcagcacctgtagcagtcatggacgccagcggagccggtagcaaggggaagaagggggcggccgggcgcaaggcaggcggccccaggaagaagtcggtgacgcggtccgtcaaggccgggctgcagttccccgtcggccggatcgggcgctacctcaagaagggccggtacgcgcagcgcgtgggcactggcgcccccgtctacctcgccgccgtcctggagtacctcgccgccgaaggtctggangtggcagggnaacgcggcgaaagacnacaggaagacgcgcatcatcccggcgccacgtgctcctgggcgattccccaacgacaaggagctcgggaaactgcttggccggggtcaacatcgcgcaagggggggttcctccccaaataccattcggggttccggcccaaaaaagcgggggaaaaaggcggccaaccggcgggaacaaagaaacccaagtccccccaaaaaaggccccaaacccccccaaaaaggtttaaaaaagggggggcccccctttggccctggggggcgggaaacgggttctcggcccaaaattcgggaaaagggaagagggcccccccccacaaaaaccccccgtgtgggtcttta

SEQ ID NO: 57631 - protein, 199 aa, Zea mays
  misc_feature: Ceres CLONE 1506987
  misc_feature (76)..(76): Xaa is any aa, unknown, or other
  misc_feature (80)..(80): Xaa is any aa, unknown, or other
  misc_feature (85)..(85): Xaa is any aa, unknown, or other
MDASGAGSKGKKGAAGRKAGGPRKKSVTRSVKAGLQFPVGRIGRYLKKGRYAQRVGTGAPVYLAAVLEYLAAEGLXVAGXRGERXQEDAHHPGATCSWAIPQRQGARETAWPGSTSRKGGFLPKYHSGFRPKKAGEKGGQPAGTKKPKSPQKRPQTPPKRFKKGGAPLWPWGAGNGFSAQNSGKGKRAPPHKNPPCGSL

SEQ ID NO: 57632 - DNA, 741 bp, Zea mays
  misc_feature: Ceres CLONE 1506991
  misc_feature: Encodes the peptide sequence at SEQ ID NO. 57633
  misc_feature (77)..(77): n is a, c, t, g, unknown, or other
agctccccgcggtggcggccgctctagaactagtggatcccccgggctgcaggaattcgtctcacccctagaaaaancacatgtgcatctcagcagcactagcagtgacaaactcgaagcttgccttcttgtttacaccctaaaactaaaactagagtcgtcggcggcaacaagcggtacgtacgtggaggatgaagagcaggagcagcactctgttggtgatcctagttctccaggcccttctgctctctgcggctgtggccaaaggacctgcagggccgaagaagcagtgctggtgcggcgagtgcaccagctggtccgggcgtgtggacctgcgaagacctcctcaccaagtgcgccgccacctgcaagaactgcctccccgtgtccacgggcaagggcgccaccaattacaggtgccgcggacttcctccccaaaaactgcgggtggcaaatccactaaactcatccaattccaccatggcccacagcagtccaatggtatccttcttccctttgccatgttcccctccgttccggtccgccctagcttttgctacaagcaggccgcctaatagccaaacctccctgtggtttgttttccaacggtctaactaaggctgaacccctttccctcccccggttgggtataaaataaaaggccagggcggcacggttcttgatcttgttctgccaaaaaagaaaaaaaaaaaaccgatgacgcttgccggggtcccccta

SEQ ID NO: 57633 - protein, 127 aa, Zea mays
  misc_feature: Ceres CLONE 1506991
MKSRSSTLLVILVLQALLLSAAVAKGPAGPKKQCWCGECTSWSGRVDLRRPPHQVRRHLQELPPRVHGQGRHQLQVPRTSSPKTAGGKSTKLIQFHHGPQQSNGILLPFAMFPSVPVRPSFCYKQAA

SEQ ID NO: 57634 - DNA, 704 bp, Zea mays
  misc_feature: Ceres CLONE 1506994
  misc_feature: Encodes the peptide sequence at SEQ ID NO. 57635
gctctagaactagtggatcccccgggctgcaggaattcgtctcacccctagaaaaaacctagctagtcatcactagtcacgttcgtccaccagagacaacaatggccatggagacgtgcttcagagcgtgggcgctgcacgcccccgctggcagcaaggacaggctcctcgtcggcaactggtgctgccgtcgaagcggcgctcgcgccgctgtccgtgggcgcgtcgccacgcgccgggcgcggcaacgtctgccagtcaagaacccaatgaacgaatttgttgttggcggacaaataaaactgggaacgtttggttattggctgcgaaacccccggggcttgtggaatttttggggcccccttgtttcgtgcccctccccttaatattcccccccggttaaccaacagtttgtgccaggggattcgcccgggaaaaataaccgttgctttattggggaaaaaccgggaagaaaccccccacagttgggggttttccctatatggttctcccggggattccccccccggggtcttttttttataggggggcggaaaaaaaaaaagaaaatttttttgggcccccctccataatcccctccctcccccccctccccccaaaaaacactccgggtctttttataatattccccttcctccgttttgttatatgtttttcaaaaataaaaacaaatttttgtttcg

SEQ ID NO: 57635 - protein, 94 aa, Zea mays
  misc_feature: Ceres CLONE 1506994
MAMETCFRAWALHAPAGSKDRLLVGNWCCRRSGARAAVRGRVATRRARQRLPVKNPMNEFVVGGQIKLGTFGYWLRNPRGLWNFWGPLVSCPSP

SEQ ID NO: 57636 - DNA, 711 bp, Zea mays
  misc_feature: Ceres CLONE 1506999
  misc_feature: Encodes the peptide sequence at SEQ ID NO. 57637
tccccgcggtggcggccgctctagaactagtggatcccccgggctgcaggaattcgtctcacccctagaaaaaactctgactctcatctgaagcgcgcgagagaaacgcgtatacccaggcggcggttgaggaagaggaggagaagaagaagaagatggcttcctccgcatacgcctcatggtccaagcggtggatccgtcccgaggtgtacccgctgttcgtgccgatggccgtggccttgggcatctgctcgtaccagcttgtgcgcaacatcacgggcaaccccgaggtgcgggtgaccaaggagaagagggcggccggcgtcctggacaaccacgacgagggcgagaggtacgctatgcacggcctcaggaagttcgtccgcgggaagaagcccgagatcatggcctccatcaactccttcttcgccgaccctcccaaggacgattaagctagattccgtcatggatggatggatggatggattcccgattcccgatcgtccatagtatgttttaccattcattagctgccggcggcgcgccttgattcgtagccgtcgtcggtacatttttttttgtttctaaaattctaattctcccatataaatggaacatcatggcttttgtcctgttttgcttgcttggctgccaacgatttcagcacgcctttgtgattttcatcacattatttgattgataaccggatga

SEQ ID NO: 57637 - protein, 98 aa, Zea mays
  misc_feature: Ceres CLONE 1506999
  misc_feature (10)..(96): Pfam Name: B12D Pfam Description: B12D protein
MASSAYASWSKRWIRPEVYPLFVPMAVALGICSYQLVRNITGNPEVRVTKEKRAAGVLDNHDEGERYAMHGLRKFVRGKKPEIMASINSFFADPPKDD

SEQ ID NO: 57638 - DNA, 851 bp, Zea mays
  misc_feature: Ceres CLONE 1507000
  misc_feature: Translation starting site: 236
  misc_feature (9)..(9): n is a, c, t, g, unknown, or other
  misc_feature (10)..(10): n is a, c, t, g, unknown, or other
  misc_feature (37)..(37): n is a, c, t, g, unknown, or other
  misc_feature (47)..(47): n is a, c, t, g, unknown, or other
  misc_feature (48)..(48): n is a, c, t, g, unknown, or other
  misc_feature (677)..(677): n is a, c, t, g, unknown, or other
  misc_feature (741)..(741): n is a, c, t, g, unknown, or other
  misc_feature (767)..(767): n is a, c, t, g, unknown, or other
  misc_feature (825)..(825): n is a, c, t, g, unknown, or other
aaaaaaaannaaaaaaaaaaacaactgccccccccgngggttttttnnttcaaactggggctccccgcggtggcggccgctctagaactagtggatcccccgggctgcaggaattcgtctcacccctagaaaaagctactgctagaggagaggaagcggaaagggcggcggcggcgcttgtggtcagtcaaagatccaacctccggactcgcgatggggcggcggatcctcaacgatgctctgcgcacgatggtcaacgcagaccggcggggggacccgtcggcgcttctccgacccttttccggggtcatggtccccctcctcgacgccagaaattctcttgtgtatcccccgaaagctggagtgcctttgcggatatctccgttgcggcacccgcggcggggacgggtggggggggctttttttttgtggcccccccctgagagggggggggagggggggggagggcgggggggcggggggtggtgtgcggtgtgtggggggtgggcgggtggggggggggggtggggggggtggggggggggggggggggctggggggtggtggggtgcagggggtgggtggtgggggggtgtgggggtgtgggggtgggtgtgggggtgggggtgggggggggggggggtggtggggggtggtggggggtggtggggtggggngggggggggtgggggggaggggtgggtgtggggtggtggtgggtgggtgtgtgtgcttgggggntgtgggggtgtggtgtggggtgtggntgggggggctggtgggggggtggtggggtgtggttagtggggggtgggggtgtgggtntgggggtggctggggtgacggccccg

SEQ ID NO: 57639 - DNA, 755 bp, Zea mays
  misc_feature: Ceres CLONE 1507002
  misc_feature: Translation starting site: 87
acccgcggtggcggccgctctagaactagtggatcccccgggctgcaggaattcgtctcacccctagaaatactgacgagctcgccatggcctccctctcctctgccgccgtcaccgccccttccttcgccgcaccagcgccagcccgcgccgtggtcagaaggaggtccttcaccgtgcgcgcctctctccgcaaggccaccggcaccgccgccgtggcaatggctgccagcgccctgcttgccggcggtgccatggcccaggaggtgctgctgggcgcaggcgacggcgggctcgtcttcgagcccagccagttcaccgtcaaggccggcgacacccatcacattcaagaacaactccggcttcccgcacaacgtcgttcttcaacaaatacgaagtgccaagcggccccccacgccaccaagatctcgcaggaggaggacctcaacgcgccaggtgtagacttactccgtccaccctcacctgtgccgtggaaccttacgttttcttactgccaatccctcctccagggacccgggacatggcccggcaaagaacacccgtacaacctaattaaagctaggctatcgaatacaatatctcctttcaatgtttttatccttgtttcactcccgtgcttttggtatctctcctcctgaagtcttggccatccacttaccatagctgcttccccccgtccccccccgggtttaacattataatatgataatactctctatctcctcccaaggatt

SEQ ID NO: 57640 - DNA, 697 bp, Zea mays
  misc_feature: Ceres CLONE 1507003
  misc_feature: Encodes the peptide sequence at SEQ ID NO. 57641
aagctggagctccccgcggtggcggccgctctagaactagtggatcccccgggctgcaggaattcgtctcacccctagaaaagccccgccttatccttccctcatcccccgtacaaaaacgcgctccctcccgcccgcccgccgctcaagccacctacaccaccaccccgccggccacactcgtctttctcacgagccacaggcacaggcaggctctcgagctcagtccacccagcgcaggggatggcgtcgtcgttcgccgtggcaacggtcccgtcgctggcggccccggcggccaagaagcggtccggcggcgtcacgtacgtggagggcatgaacgcctacagcggcctcaaggggctcaacaaggtgaacatgctcggggtgcgcaagaccgccgactactccttcgccaaggtcgtggcgtcgctcagccccgcgggcaggaagcggcgcggcggcgcgttcggcgcccagatgaacgccgccgccgagatcttcaggatcgccgccaccatgaacggcctcgtgctcgtcggcgtcgacgtcgggttcgtgctgctccgggtggaggccgccgtcgaggatcccgagtagggtgcgtggggcctgccactgtcggctggtcccccgggccgaagtctgcttcagaaaaccgtgattatatatataccagatgtccgctttccgattcaat

SEQ ID NO: 57641 - protein, 117 aa, Zea mays
  misc_feature: Ceres CLONE 1507003
  misc_feature (79)..(114): Pfam Name: PetM Pfam Description: PetM family of cytochrome b6f complex subunit 7
MASSFAVATVPSLAAPAAKKRSGGVTYVEGMNAYSGLKGLNKVNMLGVRKTADYSFAKVVASLSPAGRKRRGGAFGAQMNAAAEIFRIAATMNGLVLVGVDVGFVLLRVEAAVEDPE

SEQ ID NO: 57642 - DNA, 792 bp, Zea mays
  misc_feature: Ceres CLONE 1507005
  misc_feature: Encodes the peptide sequence at SEQ ID NO. 57643
atagctggagctccccgcggtggcggccgctctagaactagtggatcccccgggctgcaggaattcgtctcacccctagaaaaaagaaggcattcttcagtgatcctgagaaccggctcaagagaagcattgccatgaaaggggtgaaattttactgcagcaaatgtgggcaagaaggacatagaagcttttattgccctacagtgagggaaggttcaaccagggtgcggttcaggtgccggttgtgtggcagagaagggcataatagtcgaacatgtggaaaaccaaagtccgagaaggagcacaaacaacgacctcaccactgcagccgatgcggtgaaaagggacataaccggcgcaactgccccacatgcactgattttgggaagtgatcctccaggcctttgtggttaacaaagttaaaggcccccctattcccctgtttatccaatggaaaaaatgccttaaaaaaaggggcaataacagaacgaacatgccccgaaaaaaaaaagcctccccttacctaaaaagaaaaaaggcgggagaaaaaatttaaaaaaaagggctttccttttatcgccccgggttttttccccaaaatttattgtatctctctccctccattctcttccccctcaaatatatatataacaaacaacaaaaaaaaacaagctataattatacaactttttaatattccctgacaaatattataatattaagttgttgctcccggggtggccctccctttcccccttttttgtagagttttttataccccccccccccccg

SEQ ID NO: 57643 - protein, 85 aa, Zea mays
  misc_feature: Ceres CLONE 1507005
MKGVKFYCSKCGQEGHRSFYCPTVREGSTRVRFRCRLCGREGHNSRTCGKPKSEKEHKQRPHHCSRCGEKGHNRRNCPTCTDFGK

SEQ ID NO: 57644 - DNA, 784 bp, Zea mays
  misc_feature: Ceres CLONE 1507008
  misc_feature: Encodes the peptide sequence at SEQ ID NO. 57645
  misc_feature (79)..(79): n is a, c, t, g, unknown, or other
cttagctggagctcaccgcggtggcggccgctctagactagtggatccctgggctgcaggtattcgtctcacccctagnaaagtctcgggctctcatctctaatcttcgggttcgcgtcgcagtgtcttccgcccgggctaccaccatgccgaagcagatccacgagatcaaggacttcctgctgactgcgcggcggaaggacgcacggtcggtgcggatcaagcgggccaaggacgccgtcaagttcaaggtgcgctgctccaggtacctctacaccctctgcgtccacgacgccgacaaggccaacaagctcaagcagtcgctcccgccaggtctgactgtccaggagatttaaggtatcaagccacaaactgtgcttttttaagccgggtcagggaactttttgctccagtgctacctctcccttgtaggtgggctcccattgctcgtgtttgaatcgaattatgaaagtttggatttgcggcatgcgaaacgatgatgtcgaacacctttgaccccctgccgttgccaaatggtgtgcccccccaaccccccaaatggatggcccacccctactcgaaaggtcacaactccaatttcccgtgcaaaaacatattctttcataacacccccccacttctcctctgtcctccctccaacccccaaaaacacgctcccttaactatgactacagtgcccccccacatcctatagcaagttactgtggcttccgggggagtcccccaccttacgcccacaacagggactcgcttttttattctc

SEQ ID NO: 57645 - protein, 69 aa, Zea mays; identical to SEQ ID NO: 55025
  misc_feature: Ceres CLONE 1507008
  misc_feature (2)..(69): Pfam Name: Ribosomal_L38e Pfam Description: Ribosomal L38e protein family

SEQ ID NO: 57646 - DNA, 775 bp, Zea mays
  misc_feature: Ceres CLONE 1507012
  misc_feature: Encodes the peptide sequence at SEQ ID NO. 57647
  misc_feature (40)..(40): n is a, c, t, g, unknown, or other
  misc_feature (395)..(395): n is a, c, t, g, unknown, or other
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (401)..(401): n is a, c, t, g, unknown, or other
  misc_feature (403)..(403): n is a, c, t, g, unknown, or other
  misc_feature (404)..(404): n is a, c, t, g, unknown, or other
tccccgcggtggcggccgctctagaactagtggatttctngggctgcaggaattcgtctctaccctagaaaaaagccaagcaaataagacgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccccagtcgaggaggccccagcggagtcccgctatttctcccacccctgcggctgcggtagcagctgccatttttttttccccccccccgcagggggaaagaagggggnnnnccntnnatattatttttatccatctgggcccgtggaagaaaaatgaacactcctcaggccagggcgaggcgggcgtcggccttctaggggattgaaggcgggcgcgcgaccagaacacccgcaatccaactcgcctcgcgtggaccgaaacgccccccccccccacggcactccgcccccaacctttatcctcccattcacatccgccaccggagcaagtgtgtgggccaaaacaattctccccacccccgactcacccaccagcctcctccaccccccccccgcggccgccgcctccccgcctggcaacctcccgcccagacccgctccgccgcccctttctcctcctgctacacaaccaacaacaccaagccgct

SEQ ID NO: 57647 - protein, 98 aa, Zea mays
  misc_feature: Ceres CLONE 1507012
  misc_feature (1)..(70): Pfam Name: Metallothio_2 Pfam Description: Metallothionein
  misc_feature (83)..(83): Xaa is any aa, unknown, or other
  misc_feature (84)..(84): Xaa is any aa, unknown, or other
  misc_feature (85)..(85): Xaa is any aa, unknown, or other
  misc_feature (86)..(86): Xaa is any aa, unknown, or other
MSCNCGSSCGCGSSCKCGKKYPDLEETSTAAQATVVLGVAPEKKAAPPVEEAPAESRYFSHPCGCGSSCHFFFPPPAGGKKGXXXXYYFYPSGPVEEK

SEQ ID NO: 57648 - DNA, 845 bp, Zea mays
  misc_feature: Ceres CLONE 1507014
  misc_feature: Encodes the peptide sequence at SEQ ID NO. 57649
  misc_feature (9)..(9): n is a, c, t, g, unknown, or other
  misc_feature (15)..(15): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (44)..(44): n is a, c, t, g, unknown, or other
  misc_feature (45)..(45): n is a, c, t, g, unknown, or other
  misc_feature (47)..(47): n is a, c, t, g, unknown, or other
ggggggtgntttttntggtttttttgtttttttttnnnncacanncncccatagctggactccccgcggtggcggccgctctagaatagtggatcccccgggctgcaggaattcgtctcacccctagaaaaactcctgccgacgccgccgctcccgctcccagctcgtgttccgcttcttgcaaccgtcgccgcgaagcgctccagagaactctccgtcaacatggggaagacacgtggtatgggagccgggcgcaagctcaagacccaccgcaggaaccagcggtgggctgacaaggcatacaagaagagccatttgggcaatgagtggaagaaacccttcgctgggtcatctcatgccaagggcattgtcctgcagaacattggtattgaggcccaagcagccaactccgctatcccgaattgtgctcgtgttcagcttgataacaatgccaaggaagattgctgcccccccccccctaatgtacgttgttttgaaccaccattgaagaaaatgaagcacgcccttgatttgctgcgattttggtccttaccggggccccgcccactaggcacaatattccctgggggctcccggcttccagggccgttcatgggttttcccgggttgcgatctctcgccctggccccctgtcccagggggaaaaaaaggtgaacgccaaaaggtcctttaaaattgctccttggcccaccaaaaatatcagccagtccggtgggaacattgaaccccgggacgtggcccttcatcatgtttttaatcaactacaaggctagctctctgctctttagattgaccgaccttaatcactatgcaacattattatc

SEQ ID NO: 57649 - protein, 150 aa, Zea mays
  misc_feature: Ceres CLONE 1507014
  misc_feature (8)..(150): Pfam Name: Ribosomal_S12 Pfam Description: Ribosomal protein S12
MGKTRGMGAGRKLKTHRRNQRWADKAYKKSHLGNEWKKPFAGSSHAKGIVLQNIGIEAQAANSAIPNCARVQLDNNAKEDCCPPPPNVRCFEPPLKKMKHALDLLRFWSLPGPRPLGTIFPGGSRLPGPFMGFPGLRSLALAPCPRGKKR

SEQ ID NO: 57650 - DNA, 684 bp, Zea mays
  misc_feature: Ceres CLONE 1507016
  misc_feature (15)..(15): n is a, c, t, g, unknown, or other
  misc_feature (17)..(17): n is a, c, t, g, unknown, or other
  misc_feature (195)..(195): n is a, c, t, g, unknown, or other
  misc_feature (217)..(217): n is a, c, t, g, unknown, or other
  misc_feature (218)..(218): n is a, c, t, g, unknown, or other
  misc_feature (527)..(527): n is a, c, t, g, unknown, or other
ttttttgtttttttntntgtgtgtgggggggtgtgtgttgaagagtgataatttttatagaaaggaaggagctaaacggacttagcgagaggattgcgcggcgagatattattggtgggtttgttagttagagcttttcttttttcttgttgcgcgtggcctctttttaggtttttgttggttgcaaaaactggnagctccaccgccggggggcggnnccgctctaaaactagtggatcccccgggcctgcaggaattcgtctcacccctagaaaaagttcaatctcggttgcccgttgtgctctctctctctattcgttccccgcctcaccccgagccagccgtctcgctagggtttcgccgccgccggcgccgccgccgccgctatgcctggccgcagcttaggaaggtctggccccagccccgcttacccgtggctgcttccggggggggaacccggccaaagcccggcaggccaggggttcccccctccaggattcctggtttcaaaaaataggggggggggngggggggcccccccccaagggtggttttttttgtgcgggttaggagaggaaaaattgggggcccccaccattttgtccaaagagggggtgtggtagatgcgggggggggcgttttgtgttacatgtgagggcaccacagaggggggggggtaaaagt

SEQ ID NO: 57651 - DNA, 775 bp, Zea mays
  misc_feature: Ceres CLONE 1507017
  misc_feature (335)..(335): n is a, c, t, g, unknown, or other
gctctagaactagtggatctcttgggctgcaggaattcgtctctaccctagaaaaaaaaaaaccagcactagcagccgctcactccagccattacccgcagctagcaaacaaatggccaccgtcctgagcagcccccgcgcgccggccttctccttctccctccgcgccgcgccagcgcccactaccgtggccatgacccgtggcggtggcgccagcacccggctgcgcgcgcaggccccctacaacgtgaagctcatcacgccggagggcgaggtggagctgccagttccccacaacttctttttcttggacaccgcccaggagggaagcatcnaattttttttccccccccccccccggggggcggagggggcgggaaacctccacaccccccctccgcctccgggggagccgggcagaaaagaacggcacgtgcctgtcctcgggcgaggtcgggccccctgtctcctttgcctcccccgggggcgtgcccgaagcgtcgttttatagataccccccctgctcttgatgctgaccccgcggaccgataacactctttttccctcccctttgggctgttctcgagggggcggacagctgcgggaccccccctccccccttccctcccccccccggcatgcttcgctgtgtcgtatccccctcccctaggcgccgggtctcccctcccttcccccccctcccccaactcccgcccctagtacctccccgctgttccccccccatccctctcggaccgcccccctcgcttctcgc

SEQ ID NO: 57652 - DNA, 912 bp, Zea mays
  misc_feature: Ceres CLONE 1507022
  misc_feature: Encodes the peptide sequence at SEQ ID NO. 57653
  misc_feature (6)..(6): n is a, c, t, g, unknown, or other
  misc_feature (7)..(7): n is a, c, t, g, unknown, or other
  misc_feature (15)..(15): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
tggggnntttgggtnggnnngtgtgtatgtccttgtcttgccgtgtcttattcaaagtggagctccccgcggtggcggccgctctagactagtggatcccccgggctgcaggaattcgtctcacccctagaaaaaatctcccataacggagacgaagagagcagaagcgaagagcagcggcgcaaaggaaagggagccatgctcggctcgccggcgctcgccggcgccaactccttcgcggcgtccgtgtatggaaacatcctcgtcccctcggctcccgttcccgcgccggtacgtctcgcggcgttgtccgtcgtcgcctaaggtcatagtggcctctccccatgacggaccgcttcgttccgccacgttcttgtccttaaataatggtaatagaggtcttctgtagaggccgaaggttgaactgtaattgcatatccaaacaaaacaatcgtgtacgcatctaattcatcctaaacacccaataatcagacgttattccgtggatacagcctaacatcgcaaagccccaacgtcctccatctaccaaatgaatcgtgtgaaataaccgtcgaaattagagggaaaaaaacgaattcataaaattagacattatataaaaaatacagtttgaatagaggaaattgcgccaaaaactctattccctaaggagacaaaaggataatccagaccaacggatggagactctccgtaactagagagaaagaaattcgcctcaatgctaatgagcccagaatacagaaagccccaacgatctgaataccacaacccaaagtaacgaaacaaactagtggaaactcccgaggatatttcaccaaggcgtatttatgtacatatatacaccaggtaatacacaattcaaaattcttcaaacttactgcttcccacacg

SEQ ID NO: 57653 - protein, 41 aa, Zea mays
  misc_feature: Ceres CLONE 1507022
MLGSPALAGANSFAASVYGNILVPSAPVPAPVRLAALSVVA

SEQ ID NO: 57654 - DNA, 710 bp, Zea mays
  misc_feature: Ceres CLONE 1507023
  misc_feature: Encodes the peptide sequence at SEQ ID NO. 57655
aaagctggagctccccgcggtggcggccgctctagaactagtggatcccccgggctgcaggaattcgtctcacccctagaaaaaaaaaaagggccggttggctatatatgccacatccatcctcgtttgatgggtgctgtatggctatcaagacatatggccggcataatttgtggaaactgttagggttggctcgcttcggccgaccctcctaaaaaaaactcatacatttcgactctcaactcccaaggtccctttttttttctcgatctggaagcgccgcagtagcagccatggacgtgagcggagcaggcggtaaggcgaagaagggcgcggcggggcgcaaggccggcgggccgacgaagaagtcggtgtcgcggtcctccagggccgggctgcagttccccgtcagccgcgtcgggcggtacctcaaaaagggccggtacgcgcagcgtgtaggcacgggtgcccccgtctacctcgccgccgtcctggagtacctcccggccgaagtgctcgagctcggccgcaaacgccccaaggacaacaagaagacccgcatcatcccgcggcacctggctcctccccatcccaacgacaaaggacctccgcaagcttcttgcccggcttcaccctcgcccaagggggggtccttcccaaaaatccaccttgggctccccccccaaaaaggggccccaaaaagcccaaaa

SEQ ID NO: 57655 - protein, 139 aa, Zea mays
  misc_feature: Ceres CLONE 1507023
  misc_feature (29)..(100): Pfam Name: Histone Pfam Description: Core histone H2A/H2B/H3/H4
MDVSGAGGKAKKGAAGRKAGGPTKKSVSRSSRAGLQFPVSRVGRYLKKGRYAQRVGTGAPVYLAAVLEYLPAEVLELGRKRPKDNKKTRIIPRHLAPPHPNDKGPPQASCPASPSPKGGSFPKIHLGLPPQKGAPKSPK

SEQ ID NO: 57656 - DNA, 693 bp, Zea mays
  misc_feature: Ceres CLONE 1507024
  misc_feature: Encodes the peptide sequence at SEQ ID NO. 57657
aaagctggagctccccgcggtggcggccgctctagaactagtggatcccccgggctgcaggaattcgtctcacccctagaaaaaattcattcattcatccatcacccacccctcccggcctcccctgacctctctcgatcactcgtcatctccaccacacacatacacgcgcgagcgaatccaaggaagaagaagaggaggaggatccatggagaagtgcaggtcggtgccgcacgagcactcgtcggcgtactacggctgcggaggcgggtacgactacgaggacgtcggcggcgggcccgggcaggccggcaagtcgtacagcttcaacgggccgagcggccgggacgacccggaggctaagcggcggcaccgcgtggcggcgtacaacgtgttcgccacgcatggccggatcaagaccaccgtccgcagcagcgtcaagaggctcaagtccaagttctccgacgtccgctacggtggcctctgaactgatctgatgagcgtgagcctactgaatgcaacgcatcctactcctacgaccgctcacatatatgtgtatgcactaaccatggtgctcatatatatgcaaatatatatgcacgctcaagctatacgcgtgccaggctaaatagctgctgcgtatatatactactactacggtgtacatgtgcgtgtttgaactgtgtgtgtatg

SEQ ID NO: 57657 - protein, 92 aa, Zea mays
  misc_feature: Ceres CLONE 1507024
MEKCRSVPHEHSSAYYGCGGGYDYEDVGGGPGQAGKSYSFNGPSGRDDPEAKRRHRVAAYNVFATHGRIKTTVRSSVKRLKSKFSDVRYGGL

SEQ ID NO: 57658 - DNA, 995 bp, Zea mays
  misc_feature: Ceres CLONE 1507025
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (27)..(27): n is a, c, t, g, unknown, or other
  misc_feature (28)..(28): n is a, c, t, g, unknown, or other
  misc_feature (31)..(31): n is a, c, t, g, unknown, or other
  misc_feature (37)..(37): n is a, c, t, g, unknown, or other
nnnnnnnnnnnnnnnnnnnnttgtttnnttntttttnttgtttttttttttcaaaactggtactccccgcggtggcggccgctctagaactagtggatcccccgggctgcaggaattcgtctcacccctagaaaaaacccaaacccaagcagagaagcagagacacatttggctcactcactcacactcactcgctcatagattgtcctgtccgtccatcatctctagctagcagcttccagtgagagcggcaagcgactccacatacctgtcaacacaccaccaccgagttgtgagaataagttcgcagacaggatgggcaatctgtgttcgattctcattctctttcacttccctagcaaggcacaaaagtgcatactgcttgtaccactctggtaccctgaccgaggcgggcagagtggaagagcaccgttctaattctgtgacgtacgattctcttgggccgcggccatgctggggattccctcttaactccactctcctcaaccgcctcatcgggaagaatggctctcttcggaggtccccttttttattgttgtggggaatccccccgatcctcagggtatccggatgcttctccaaagccttgccctgggttccctattaccggatgttggagaatcaaggctgtcttccctccccaatcctcttatagtggggtacaccaccggcacgatttcgaatccagatccagaacatattttttctgttcggttttcttccagcacggtcacaccccggggagggcggactggaccctcgacgtacgaggcacgtgttgttggatccctgccccaaacgattcgtgttccatccgaccccggttctctctgcttctcgggtcggaagggcgtgtgggggcctccttagagatgtaagggatgttccctgccggcctcttttcgtcgaccgccccccaatccagacgggagtcgcgtgggaacgccccacacctgcacaacgtgaccggtcgg

SEQ ID NO: 57659 - DNA, 756 bp, Zea mays
  misc_feature: Ceres CLONE 1507026
  misc_feature (596)..(596): n is a, c, t, g, unknown, or other
  misc_feature (728)..(728): n is a, c, t, g, unknown, or other
  misc_feature (756)..(756): n is a, c, t, g, unknown, or other
aagctggagctccccgcggtggcggccgctctagaactagtggatcccccgggctgcaggaattcgtctcacccctagaaaaaactcgtcattctagcccgggaaacacgcccggtcgaccgggggtggaaaatatcctagcctggaccgcaagcgaacgcgaagggcacgcgacttctcgtcggcgtcgatctgctccggcgaccgcttctcatcgttgtagacttccaggggtcgagttatgtatgaagtagctccaatctttagaggaagaatgtcttctcaacgggttttatgtacttgttctatcaaagagtgagatgaatcattatctagatctatgatctcgtcatgtttagtacactggatatgtattcttttgcagcgagggaggggggaacataccctgagataattgtccaggtttgtttgacaaagcattaatattgagcctgactgatttattttcgatattattcgtgattgtttcaccccctcggaaggtttaactcatcgaacatggcagccccaaccacgcaattgtccagtatagattgccgccaggacccccaacgcgcacactattagaaacttcngccaacccccccccccctatattggttagatttaactagcctgctcggcggtgccctcagcgcccttcggatccggtagtgaagtgcaccttccctccccggctgcccccacggcctaaccccttctcggancaagcccacaccactcctcgctctggcn

SEQ ID NO: 57660 - DNA, 727 bp, Zea mays
  misc_feature: Ceres CLONE 1507027
  misc_feature: Encodes the peptide sequence at SEQ ID NO. 57661
  misc_feature (595)..(595): n is a, c, t, g, unknown, or other
agagctggagctccccgcggtggcggccgctctagaactagtggatcccccgggctgcaggaattcgtctcacccctagaaaaagcgcaaacatcgaatcgtctcactcgtgtctgccctgctcatactgcttgccctcgccgtatcgtccacccgcaacgcacaggaggattccatggccaacaacaccgggacgttggtgggcggcatccaggacgtgccggggagcgagaacgaccttcacctccaggagctcgcccgcttcgccgtcgatgagcacaacaagaaggccaatgctcttctggggttcgagaagcttgtgaaggccaagacacaagtggttgctggcacgatgtactatctcactattgaagtgaaggatggcgaagtcaagaagctctacaaaactaaggtatgggagaagccatgggagaagttcaaggagctgcaggaattcaaacctgttgaagagggtgctagcgcctaacgatgtctccttctccatgtgcgagcctgaagctcaaagcaaaattgcagaataacgagccatgctcccttgtgtaatttcctaagactacaacccttattagggctngttttggtcgtgcctggatccaaaaggaaattgaaagtgataaattttcccttcaattccaaaaaaaggggttttaatctccctccaatacccttccaaaccacaccctaaccggaaccaaccccttaaatt

SEQ ID NO: 57661 - protein, 103 aa, Zea mays
  misc_feature: Ceres CLONE 1507027
  misc_feature (10)..(98): Pfam Name: Cystatin Pfam Description: Cystatin domain
MANNTGTLVGGIQDVPGSENDLHLQELARFAVDEHNKKANALLGFEKLVKAKTQVVAGTMYYLTIEVKDGEVKKLYKTKVWEKPWEKFKELQEFKPVEEGASA

SEQ ID NO: 57662 - DNA, 742 bp, Zea mays
  misc_feature: Ceres CLONE 1507028
  misc_feature: Encodes the peptide sequence at SEQ ID NO. 57663
aaagctggagctccccgcggtggcggccgctctagaactagtggatcccccgggctgcaggaattcgtctcacccctagaaaaaacaaccagcggtagtggccggcatcatccgtctcgtctcgtctcgtctcgcctctcctctccttttcccccctccctgcacagcgccgctcaccgtcaccgtaccacagcagcgatcgatggctgaggtacacaacgagcggcccgtgatggtgggcgacgtccgggacgcgccggtgggccgcgagaacgacctcgaggccatcgagctcgcgcgcttcgcggtcgccgagcacaacagcaagaccaacgcgatgctggaattcgagaggctgttgaaggtgaggcaccaggtcgtggccgggacccctgcacacttcaacgtcaaggtgaaggagggccggccgcggccaaaaagaacttgtacaaggccaaggggggggaaaaagcctgggaaaaccttcaaggaactgcaaaacttcaagctcctcggaaaaccccccggtcccctgaaggccaaaggcttttccccggggggctggggcccccaaatgaaaaaaattaattgtgctccccccggggaaaagtttgttttatggaaaaaaccccgggttctctcccaccattgttttggccccccaataagaaaaattttccacccccctaaaaaaaaaaagaaggggggaaagaaaaacaaaaaaccccctcctcttttttgt

SEQ ID NO: 57663 - protein, 180 aa, Zea mays
  misc_feature: Ceres CLONE 1507028
  misc_feature (13)..(105): Pfam Name: Cystatin Pfam Description: Cystatin domain
MAEVHNERPVMVGDVRDAPVGRENDLEAIELARFAVAEHNSKTNAMLEFERLLKVRHQVVAGTPAHFNVKVKEGRPRPKRTCTRPRGGKKPGKTFKELQNFKLLGKPPGPLKAKGFSPGGWGPQMKKINCAPPGEKFVLWKKPRVLSHHCFGPPIRKIFHPPKKKKKGGKKNKKPPPLFC

SEQ ID NO: 57664 - DNA, 723 bp, Zea mays
  misc_feature: Ceres CLONE 1507030
  misc_feature: Encodes the peptide sequence at SEQ ID NO. 57665
aaagctggagctccccgcggtggcggccgctctagaactagtggatcccccgggctgcaggaattcgtctcacccctagaaaaagagccgctctcggcttcgaatcccgacaacctccctccccaagctgcttagccgccggctgggcctcagacctgcgtcaagcttccggcggcagcccatcgagcaccacaatggcgtccggcggagcggccatctcggcggggcctacaccgccgtcggcgacggcgtcgtcggttgagtggcaccagcggccgccgaacccgaagaaccccgtggtgttcttcgacgtgaccatcgggtccatcgccgccggccgcatcaagatggagctcttcgccgacatcgcccccaagaccgcggagaacttccggcagttctgcactggggagcatagaaaaaatgctttgccacaaggttataagggctgccaattccatagagtgatcaaagatttcatgattcagggtggtgacttcttgaagaatgatggtactggatgcacatcaatctacgggaccaaattgatgatgaaaattttatagcaaagcatacaggggcctggactgctctcgatggcaaacaggggaattaactctaatggatctcagttctttataacatgtgcaaagtgtgaatgggcttgaccaacaacatgtggaatttgggaaagtgctttgaaaacggtttgctcccccggag

SEQ ID NO: 57665 - protein, 123 aa, Zea mays
  misc_feature: Ceres CLONE 1507030
  misc_feature (35)..(123): Pfam Name: Pro_isomerase Pfam Description: Cyclophilin type peptidyl-prolyl cis-trans isomerase/CLD
  misc_feature: SWISSPROT Homolog: EC 5.2.1.8 Peptidylprolyl isomerase
MASGGAAISAGPTPPSATASSVEWHQRPPNPKNPVVFFDVTIGSIAAGRIKMELFADIAPKTAENFRQFCTGEHRKNALPQGYKGCQFHRVIKDFMIQGGDFLKNDGTGCTSIYGTKLMMKIL

SEQ ID NO: 57666 - DNA, 855 bp, Zea mays
  misc_feature: Ceres CLONE 1507035
  misc_feature: Encodes the peptide sequence at SEQ ID NO. 57667
  misc_feature (18)..(18): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (38)..(38): n is a, c, t, g, unknown, or other
  misc_feature (39)..(39): n is a, c, t, g, unknown, or other
ataattatattatttttnttnnnannncnnncaacaanntttcaattttttcatagctgggctccccgcggtggcggccgctctagaactagtggatcccccgggctgcaggaattcgtctcacccctagaaaaaaggccacttacctgcagtcaccactcccaagccagtacccacagtcctacgagcagtcgcacgcaagtgtcaagagacgaaacggtcgacatggctcgcacgcaatctgccgtatcggtcgccgtggaggccgcggtgctgctgctggcagcggcggcgacgacctcggaggccgccatcacctgcgggcaggtgagctccgccatcgcgccctgcctctcctacgcccgcggcacggggtccggcccctccgcttcctgctgtataggcgtcaagtacctcgagagcgccgccagaaccggcggcgacaggtagctcctccctcatctgcctcaaagaaccccctccgtggggggtcagcggtctgtatggtctgtcaatatccttccagcgatcctcctccaaaagtgcgggcgtcaaacatctcctctaactcgctgtctggaagcacccctactggattggtcctccagggcgtgaagactaaagagccctagcacccacccccgccaacccccacgcccgtactgtgtacccgattccaacccttaccctttgcctcccgtgctggccggccgtgaacgggaatctatcttgaccggtataatcttcgtatataatacaacgatgtaaacccttccgcccgtggtacatacggcaggggtccccttccttttccctgcccctggctccctatcttctaaaaaatataccctctcc

SEQ ID NO: 57667 - protein, 74 aa, Zea mays
  misc_feature: Ceres CLONE 1507035
MARTQSAVSVAVEAAVLLLAAAATTSEAAITCGQVSSAIAPCLSYARGTGSGPSASCCIGVKYLESAARTGGDR

SEQ ID NO: 57668 - DNA, 727 bp, Zea mays
  misc_feature: Ceres CLONE 1507037
aagctggagctccccgcggtggcggccgctctagaactagtggatcccccgggctgcaggaattcgtctcacccctagaaaaaaggtgttcctgatgttcttaagtctacacatctccctccctagccaccaaaatttggtgctgtacagaggctgggcacaccatcaactgttgatgtggagaccactacagtcatgtttgccgccttgccttggacggagcgattcaagaatggtcctgccgtcgagatctatcactgcccacagcctccacgctggccgaacaactcgctctttctccaaccgtcttcacacgagcgccaaagtcttcaactggagtttgaaggacgagtctactccagtgtttgctgatcaagtgcacgacccatctatctgggtattggatagagggatctgaagcctcttctctgcaacaaacgtaatcatgactgttctaggtgtctctgtggctggaagatgcttctagtcttgaacgatgattagttaggtttacgtgtgagctttggaaaagatctaccttcctggttctgtatgtaagtgtactacctgcatactgtgaccatatcacgacttgtaataaatgtaactcttcctatgtaataaccttcatttttatagaatgatgagaaatgttttgtaaaacaagaaaaaaaaaaaaaaaaacgagacgctcgaggtacccaatacggccctatacagagtcgta

SEQ ID NO: 57669 - DNA, 667 bp, Zea mays
  misc_feature: Ceres CLONE 1507173
  misc_feature: Encodes the peptide sequence at SEQ ID NO. 57670
  misc_feature (608)..(608): n is a, c, t, g, unknown, or other
aaagctggagctccccgcggtggcggccgctctagaactagtggatcccccgggctgcaggaattcgtctcacccctagaaaaaatccacaacactcgtcgatctacacacatacatagtttcttctactacacgacgacaaacatggggaagcctgcgaagatcggagagtggggtggatacgccggcgatcgtcgggatctgagggctactccggaccggctgaccgaggtgaaggtcacggcggacaacagcagctgcatccgctccatctccttcatctacatcggagccgatggcaagccgtacgaggaggggccatggggtttcggccatgctggcacggagtacaagattgatctgtgcaggttcgacgagagcttgacggagatctccgggaccacgggcccagcctacaacattgacaatctggtcaagtctctcaaatttgtcaccaacaaacgtacttacggaccgtacggcagggacgagggcaccccgttccgtgtcaaggtgatgaacaacggccacgtcgctggcttctttggccgctctggagattgcctggacgcgatcgggctctacgtcaaccccaactaataactaanacgatggatcggatcatctgcatgcatgcatatgcagtatgctgcttgcctagctgcct

SEQ ID NO: 57670 - protein, 151 aa, Zea mays
  misc_feature: Ceres CLONE 1507173
  misc_feature (15)..(150): Pfam Name: Jacalin Pfam Description: Jacalin-like lectin domain
MGKPAKIGEWGGYAGDRRDLRATPDRLTEVKVTADNSSCIRSISFIYIGADGKPYEEGPWGFGHAGTEYKIDLCRFDESLTEISGTTGPAYNIDNLVKSLKFVTNKRTYGPYGRDEGTPFRVKVMNNGHVAGFFGRSGDCLDAIGLYVNPN

SEQ ID NO: 57671 - DNA, 724 bp, Zea mays
  misc_feature: Ceres CLONE 1507174
  misc_feature: Encodes the peptide sequence at SEQ ID NO. 57672
  misc_feature (206)..(206): n is a, c, t, g, unknown, or other
  misc_feature (252)..(252): n is a, c, t, g, unknown, or other
agagctggagctccccgcggtggcggccgctctagaactagtggatcccccgggctgcaggaattcgtctcacccctagaaaaaacccaccgagctgcctgctacacccctgccaagatccatctttccggttccgccgcctgatcgaagtgaacaagcaaggaagagccatggcgagcgagcacgcggcggggggcgatgctaancatcaccagaagcagagcctgatggacaaggcgaaggggttcgtcncggagaagatcgcccacatccccaagcccgaggctccgccggagggggtgacgttccagggcctgagcccgtgagtggatcaggctgcacagaagcggggaaagttgttttttttcccccccccccccggggggggggggggggggacttcacctccccccccccccttgttggtgggtatagggagtgggccttctggcacccctgccctaacccccggggggggataccgcctcccatccgcctcctacttgagttatggtggtttcgtggcgaagcggggcactagtcggcccccgccccgttcccccccccacggcgcacgcccgctcgtgtgaggggccgctctccagccaaccggccgagccacccggcccccgccccccgcccctccccccccttaccagtgtaatcgcctccggccgccctgcattagcctctgcgcaggcctagccgtccctcgctcttgccg

SEQ ID NO: 57672 - protein, 51 aa, Zea mays
  misc_feature: Ceres CLONE 1507174
  misc_feature (12)..(12): Xaa is any aa, unknown, or other
  misc_feature (28)..(28): Xaa is any aa, unknown, or other
MASEHAAGGDAXHHQKQSLMDKAKGFVXEKIAHIPKPEAPPEGVTFQGLSP

SEQ ID NO: 57673 - DNA, 685 bp, Zea mays
  misc_feature: Ceres CLONE 1507176
  misc_feature: Encodes the peptide sequence at SEQ ID NO. 57674
cacagctggagctccccgcggtggcggccgctctagaactagtggatcccccgggctgcaggaattcgtctcacccctagaaaacccatttcgaagcccaccgaattccctgcgattcctctcccctcgcctcctcgactccccctaggggatcggcggagaggaatcgcaaagagggccgtctcatccgagttaaggaagccatggagcacaaggaggctgggtgccaggccccctagggacccatcctctgcataaataactgtggcttcttcggcagcgcggcgaccatgaacatgtgctccaagtgccacaaggagatgataacgaagcaggatcatgccaagctggctgcctcctctatcgacagcatcgtgaacggtggtgacgccgtcatggagccggctgttgctggcaccaacacggtagtagctgttgcccagatgagttgcaaacaatgaacgtgcagcagcccgctgatgttgccggactcagcgagggcgagggcggcgatctccaaaggggggaaggtagggccttaccctgtgcagcgccaggaggtaaatggattggacttacggggattcaactggccggggggggaacttggtcttggggaacttccacgattacttctaaaaaagaaggaattgcaaaatccccattaccggaatggttgccaagg

SEQ ID NO: 57674 - protein, 56 aa, Zea mays
  misc_feature: Ceres CLONE 1507176
MNMCSKCHKEMITKQDHAKLAASSIDSIVNGGDAVMEPAVAGTNTVVAVAQMSCKQ

SEQ ID NO: 57675 - DNA, 660 bp, Zea mays
  misc_feature: Ceres CLONE 1507177
  misc_feature: Encodes the peptide sequence at SEQ ID NO. 57676
aagctggagctccccgcggtggcggccgctctagaactagtggatcccccgggctgcaggaattcgtctcacccctagaaaaaagggtttattcgctcctcccgcccgccgccgtcgccgcctcctctccccagcacccggagctcgcccgaccgccgctcaccatgatcatccccaagaagaaccgcaatgagatctgcaagtacctcttcaaggagggcgtgctgtatgccaagaaggactacaacctggcgaagcacccgcagatcgatgtgcccaacctccaggtgatcaagctcatgcagagctttaagtccaaggagtatgttagggagaccttctcctggcagtactactactggtatctcaccaacgatggcattgagcacctacgcaactacctgaacctcccgtctgagatcgtgcctgccacgctcaagaagtctgccaagccacctggccgcccatttggctctggccctcctggtgaccgcccaaggggcccaggtcgttttgacggcgacaggcccaggttttggtgacagggatgggtaccgtggtgggccttcggggtgcttcctggtgactttggtggcgataaaaatggagctcctgctgaattccagccatcattcaggaagccctggttttgggcgtggg

SEQ ID NO: 57676 - protein, 125 aa, Zea mays
  misc_feature: Ceres CLONE 1507177
  misc_feature (3)..(98): Pfam Name: S10_plectin Pfam Description: Plectin/S10 domain
MIIPKKNRNEICKYLFKEGVLYAKKDYNLAKHPQIDVPNLQVIKLMQSFKSKEYVRETFSWQYYYWYLTNDGIEHLRNYLNLPSEIVPATLKKSAKPPGRPFGSGPPGDRPRGPGRFDGDRPRFW

SEQ ID NO: 57677 - DNA, 808 bp, Zea mays
  misc_feature: Ceres CLONE 1507179-R
aacgagcaggtaacttagggatgtgtgccacagagtgctccctagcggagtggcaaatgtaccaaattaggatcgatgtctcgagagatagagagatgatccatgacgattgcaacggatcgaccggcgctagcagtacaaagcaagctactagaccatgctaatggagaagctgagcttagatcttgccgcgcgggcccggctgcggcggctcctgaggtcccttcttgatcggcaagaggtccggtgacgcctactcgctgacctaggccagaagtgagccgccgcccagcagcaggaacttgagcaacagacctctcttggtgaacggagccgcgaacgtctcgaagaacttgctctgtagcgggttgtaaggcgagggcgcgtcatagccgcagaggtcccactgtgcggtggagttgccgatgtcgtcgaggtcaaagcagacgctcttgacgccgtacttggccaccacggcggctgcgctgggcctgcggatgagagcgggcccacggcctggcgacagcgagcttccgtccggagatcgagctgccggctagacccttgatggccacaggcttcacggagacggcggcgagggaggccatggcggctagctaagcaagcttgacgcgcgcactggacagtggcgctgttgggggttgctgggtgttttttcctaggggtgagacgaattcctgcagcccgggggatccactaagttctagagcgggcggccaccgcggggggagctccaactttttgttccctttaagggaggggttaattgccgccccttggggtatac

SEQ ID NO: 57678 - DNA, 650 bp, Zea mays
  misc_feature: Ceres CLONE 1507181
  misc_feature: Encodes the peptide sequence at SEQ ID NO. 57679
  misc_feature (582)..(582): n is a, c, t, g, unknown, or other
aaagctggagctccccgcggtggcggccgctctagaactagtggatcccccgggctgcaggaattcgtctcacccctagaaaaaacaagccgcaccgcaattagccgcgaccctccgcggaatcggctcacgtttccgatccagaggtccagactgttccccgagttttcccactgtgtcctctcctcgcgagtcccggcgaagcaggccaaccgcgaacatgtgccccaccggcaggtacctggggctcgacctctccggcgctggcggagacctgaggccggcgttcgacgtgcttgacgcggaccgggacggcctgatcagccgggacgacctcaagtccttctacaccgcctcggggcccgccgccggcgaccggttcgacgactacaacctcgcggacatgatcgctgccgccgacgccgaccacaactgcttcgtgctgtacgactagttccagcgcctgctggcccgacgcgccgaggatgccgccgcctccgcgtgaggcgctgggcgtcgcatcgccatggagggcgccttcccgttcatgcacgtggacggggacggtatggtcggcttctnaggactcaaggcctacctccactggcccaggatgtccacggcggacgatgtagtcccgccatgatacg

SEQ ID NO: 57679 - protein, 77 aa, Zea mays
  misc_feature: Ceres CLONE 1507181
  misc_feature (18)..(46): Pfam Name: efhand Pfam Description: EF hand
MCPTGRYLGLDLSGAGGDLRPAFDVLDADRDGLISRDDLKSFYTASGPAAGDRFDDYNLADMIAAADADHNCFVLYD

SEQ ID NO: 57680 - DNA, 652 bp, Zea mays
  misc_feature: Ceres CLONE 1507182
  misc_feature (652)..(652): n is a, c, t, g, unknown, or other
tggagctccccgcggtggcggccgctctagaactagtggatcccccgggctgcaggaattcgtctcacccctagaaaaagcgaccccaggtcagtcgggactacccgctgagtttaagcatataaataagcggaggagaagaaacttacgaggattcccctagtaacggcgagcgaaccgggagcagcccagcttgagaatcgggcggcctcgccgcccgaattgtagtctggagaggcgtcctcagcgacggaccgggcccaagttctctggaaagggacgcctgggagggtgagagccccgtccggcccggaccctgtcgcaccacgaggcgccgtcaacgagtcgggttgtttgggaatgcagcccaaatcgggcggtaaactccgtccaaggctaaatacaggcgagagaccgaaggaaaaaaaattaaggatagaaacgagaaatggacgcatcacctgcctgccggtgtggacggcggtggtcctcgcggtccagcgagactgcgagccccgacgacggtgtgattattcacccgtgccgaccgagagagacgtgtgtagtggcgatacaaatttgattgaagacattattgtgcgttttcttagatatttattaattacacgataatacacacatgtattattan

SEQ ID NO: 57681 - DNA, 711 bp, Zea mays
  misc_feature: Ceres CLONE 1507183
  misc_feature: Encodes the peptide sequence at SEQ ID NO. 57682
  misc_feature (393)..(393): n is a, c, t, g, unknown, or other
  misc_feature (644)..(644): n is a, c, t, g, unknown, or other
aagctggagctccccgcggtggcggccgctctagaactagtggatcccccgggctgcaggaattcgtctcacccctagaaaaaagcaacccccaacagcgccactgtccagtgcgcgcgtcaagcttgcttagctagccgccatggcctccctcgccgccgtctccgtgaagcccgtggccatcaagggtctcgccggcagctccatctccggaaggaagctcgccgtcgccaggccgtcggcccgctccatccgcaggccccgcgcagccgccgtggtggccaagtacggcgacaagagcgtctactttgacctcgacgacatcggcaacaccaccggacagtgggacctctacggttcttaccccccctcccccgggagggggggggggancaagttcttccaaaacttcgcggttccgtccaccaagagaggtctgctgctccagatccctggcgctggggccgccgactcacttcttggcctaacgtcaacgccgtcggcgttacctggaccctccctgcccaataacaaaggaaccctccaggagcccccccgcagcccgggccccacgcgggccaaaaatcccaacccctagtcccccctcaatttgccaggggcccccctcaccgccgctcttttgncactgctaacccccccgtgcccacatccttttgcacaatccatcacccggcaaccaactcctacgcg

SEQ ID NO: 57682 - protein, 151 aa, Zea mays
  misc_feature: Ceres CLONE 1507183
  misc_feature (5)..(148): Pfam Name: PSI_PsaH Pfam Description: Photosystem I reaction centre subunit VI
  misc_feature (84)..(84): Xaa is any aa, unknown, or other
MASLAAVSVKPVAIKGLAGSSISGRKLAVARPSARSIRRPRAAAVVAKYGDKSVYFDLDDIGNTTGQWDLYGSYPPSPGRGGGXKFFQNFAVPSTKRGLLLQIPGAGAADSLLGLTSTPSALPGPSLPNNKGTLQEPPRSPGPTRAKNPNP

SEQ ID NO: 57683 - DNA, 807 bp, Zea mays
  misc_feature: Ceres CLONE 1507190
  misc_feature: Encodes the peptide sequence at SEQ ID NO. 57684
  misc_feature (29)..(29): n is a, c, t, g, unknown, or other
  misc_feature (35)..(35): n is a, c, t, g, unknown, or other
  misc_feature (36)..(36): n is a, c, t, g, unknown, or other
  misc_feature (38)..(38): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
attcccttcccttgttcctatttcttttntggttnntntcgcaannnnnnaaaactggagctccccgcggtggcggccgctctagactagtggatcccccgggctgcaggaattcgtctcacccctagaaaaagtgctgtttttgttttgttttgtggaggagaggaaccccgtattttgcgtggagaagaaggcaagccgctcaatgctcgtcgacgtgcggagctatgcacaaatcggatcgccaacgttcttacaaacaccgattgagtttgtttatggaccgagagatgatgatcgagccagtgatgtggtgccacccaaaagatgcagttggtggacgacccacggaaggatggacctaattagtggatgctcgccaagctagtacctccccccaaaaacacctatttttttcgccccccgagggggggggggggggtcgatcgctcgcccgtagctaactcggccttcattcccagcctccccgccttacacggcgcgctgtcgggttcctcctcctctactctctagtgccccaccccgtggaagttagttcgccccgcgcgttccccccaccttttttaccatacctcctctccgtccatatatattccccctaccctttccccgtctctattgtacgctgcctctctcttattgcgtctccgtaattcgtcaccccctcttgattacccattttacgcaccctcccccttgtcctcttcattcccctcttgcccccttctctcgtttatactcgtccttgtgtgtactacaccgtctttcccaacaccaatacccaca

SEQ ID NO: 57684 - protein, 60 aa, Zea mays
  misc_feature: Ceres CLONE 1507190
MLVDVRSYAQIGSPTFLQTPIEFVYGPRDDDRASDVVPPKRCSWWTTHGRMDLISGCSPS

SEQ ID NO: 57685 - DNA, 658 bp, Zea mays
  misc_feature: Ceres CLONE 1507191
  misc_feature: Encodes the peptide sequence at SEQ ID NO. 57686
caaagctggagctccccgcggtggcggccgctctagaactagtggatcccccgggctgcaggaattcgtctcacccctagaaaaagaagcccaccgaattccctgcgattcctctcccctcgcctcctcgtctccccctaggggatcgtcggagaggaatcgcaaagagggccgtctcatccgagttaaggaagccatggagcacaaggaggctgggtgccaggcccccgagggacccatcctctgcatcaataactgtggcttcttcggcagcgcggcgaccatgaacatgtgctctaagtgccacaaggagatgataacgaagcaggatcaggccaagctggctgcctcctctatcgacagcatcgtgaacggcagcgacgccgtcatggagccggttgttgctggcagcaacacggtagtagctgttgcccaagtcgagttgcaaacaatgaacgtgcagcagcctgctgatgttgccggacccagcgagggggtggcggcgatctcaaagggggggaaggtagggccgaaaccggtgcagcgcctgcaggaaagagggttgggctcacgggaatccaactggccggtgggggaacttgtactgggcgcttcaaccgctactcccgaaaagcacgactggcagtttcgactaacg

SEQ ID NO: 57686 - protein, 154 aa, Zea mays
  misc_feature: Ceres CLONE 1507191
  misc_feature (14)..(38): Pfam Name: zf-A20 Pfam Description: A20-like zinc finger
MEHKEAGCQAPEGPILCINNCGFFGSAATMNMCSKCHKEMITKQDQAKLAASSIDSIVNGSDAVMEPVVAGSNTVVAVAQVELQTMNVQQPADVAGPSEGVAAISKGGKVGPKPVQRLQERGLGSRESNWPVGELVLGASTATPEKHDWQFRLT

SEQ ID NO: 57687 - DNA, 658 bp, Zea mays
  misc_feature: Ceres CLONE 1507206
  misc_feature: Encodes the peptide sequence at SEQ ID NO. 57688
  misc_feature (543)..(543): n is a, c, t, g, unknown, or other
  misc_feature (544)..(544): n is a, c, t, g, unknown, or other
  misc_feature (581)..(581): n is a, c, t, g, unknown, or other
  misc_feature (618)..(618): n is a, c, t, g, unknown, or other
aaagctggagctccccgcggtggcggccgctctagaactagtggatcccccgggctgcaggaattcgtctcacccctagaaaaaaggaaggaaatctatccaagcaacaaacttggcattcttgcctgttcttaattattgccaggacaggagaaacaaagatgaggcctcagctgatactcgtcggcactctggctgttctcgccatcctcgcagctctcggcgaaggctcgtcgtcctggccctgctgcaacaactgcggtgcttgcaacaagaagcagccgccggagtgccagtgcaatgacgtgtcggtcaacgggtgccatccggagtgcatgaactgcgtcaaggtcggtgcaggaattcgtcccggcatgggccatggccccgtcgtcacctaccgctgtgacgacgttctcacaaacttctgccagagcagctgcccggaagcgccggcgccataggcgggtggccggtgtcttcttctgacgtacggcatgggacgccaagtcgagtttgcttctctccagtttcgtcagagannagaaaataaataataataaatgtcgccggccgctctngtcggtgcttgctctttgtcgtcgtccggtgtatagnactctcctttttctttttctttctagaataaagagccatt

SEQ ID NO: 57688 - protein, 100 aa, Zea mays
  misc_feature: Ceres CLONE 1507206
MRPQLILVGTLAVLAILAALGEGSSSWPCCNNCGACNKKQPPECQCNDVSVNGCHPECMNCVKVGAGIRPGMGHGPVVTYRCDDVLTNFCQSSCPEAPAP

SEQ ID NO: 57689 - DNA, 643 bp, Zea mays
  misc_feature: Ceres CLONE 1507208
  misc_feature: Encodes the peptide sequence at SEQ ID NO. 57690
atagctggagctccccgcggtggcggccgctctagaactagtggatcccccgggctgcaggaattcgtctcacccctagaaaaaatcccaaacacaacacactactaccctacccgtccgcctctctcgaaggcgcagcaccagcgagcatgtcgcctgtcaccgcactcctggcgggcacggtggtgccgccggcctcggccccggccccgtcgccggcgaggcacgcccgccattactccgtcggcttctccccgctccacggcggcgggcgcgcggcgctggcggtggagtgctcgtcgcggccgcagaagaaggggaccaagcaccacatgaagacgcggcccaagaagacgcagccgtgggacatcaagcgccgccccacgcagtacccgccgctgccgccgctcccgccggactggacgctcgtcgcctccggcgccacggtcgacgtggaggaggcggaggccccggcacccgccgcgactctcgtcctcgacgtggccgcggccgccgactgaggccgccgcggcgtgtcgccaaagttgttcccttgaacctccgcataagctgtttttctttgagatttattttataataacaatggctgcccagattttgtgattataaattaagaatcttt

SEQ ID NO: 57690 - protein, 123 aa, Zea mays
  misc_feature: Ceres CLONE 1507208
MSPVTALLAGTVVPPASAPAPSPARHARHYSVGFSPLHGGGRAALAVECSSRPQKKGTKHHMKTRPKKTQPWDIKRRPTQYPPLPPLPPDWTLVASGATVDVEEAEAPAPAATLVLDVAAAAD

SEQ ID NO: 57691 - DNA, 672 bp, Zea mays
  misc_feature: Ceres CLONE 1507210
  misc_feature: Encodes the peptide sequence at SEQ ID NO. 57692
aaagctggagctccccgcggtggcggccgctctagaactagtggatcccccgggctgcaggaattcgtctcacccctagaaaaagacggcgccgacaaaaccagaccatcaaacaagtgccagcgccctctcgcagtcgccgcaatggagagcaccttcatcatgatcaagcctgacggcgtccagaggggcctcattggtgagatcatcagccgttttgagaagaagggcttctacctcaaggccttgaagcttgtgaacgtggagaggtcgtttgctgagaagcactacgccgatctcgcctccaagcccttcttccagggcctcgtggactacatcatctctggccctgtggtggccatggtctgggagggcaagagcgtcgtcacaactggccgcaagatcattgggcgcaccaaccccctggcttctgagcccggcaccatccgtggcgactttgctgtcgacattggcaggaatgtcattcatgaaagtgacagcattgagagtgctaataaggagattggccctgttggttccccgagggccctgctgaattggcaaagcagcccagcacccccttggatctaccaagagtaaaacatgggaaaagtttcacttcaaacccttggagaacccagagggaagcatggtcccccttttgggggcttt

SEQ ID NO: 57692 - protein, 151 aa, Zea mays
  misc_feature: Ceres CLONE 1507210
  misc_feature (2)..(136): Pfam Name: NDK Pfam Description: Nucleoside diphosphate kinase
  misc_feature: SWISSPROT Homolog: EC 2.7.4.6 Nucleoside-diphosphate kinase
MESTFIMIKPDGVQRGLIGEIISRFEKKGFYLKALKLVNVERSFAEKHYADLASKPFFQGLVDYIISGPVVAMVWEGKSVVTTGRKIIGRTNPLASEPGTIRGDFAVDIGRNVIHESDSIESANKEIGPVGSPRALLNWQSSPAPPWIYQE

SEQ ID NO: 57693 - DNA, 673 bp, Zea mays
  misc_feature: Ceres CLONE 1507213
  misc_feature: Encodes the peptide sequence at SEQ ID NO. 57694
catagctggagctccccgcggtggcggccgctctagaactagtggatcccccgggctgcaggaattcgtctcacccctagaaaaacatcttttgcaacatttaaggttgttggtaatgagaatccatcaacccttatttgtttcgcctcaaagacaactaatgctgggcagatcacttcaaagttgcatgttattgaactgggtgcacagccagggaaacctggcttttctaagaaacaagctgacctcttcttcccaccagatttccaggatgattttcctgtagctatgcaggtttcacaaaagtatgggcttatctatgtaattacaaagcttggccttttgtttgtatatgacttggaaactgctgcggcagtttacagaaatagaattagtccagaccctatatttttgacagcagaatcttcctctactggtggattttatgccatcaacagaagagggcaggttttacatgccacagttaatgatgcaactgttgtaccttttgtcagtggccatttaaacaaccttgagcttgctgtgaatctggccaagagagctaaccttcctggtgctgagaacttggttgtgcaaagattccaggaactgtttgcacaaacaaaatacaaggaggcagctgagctggctgcagaatctccccagggtctcc

SEQ ID NO: 57694 - protein, 128 aa, Zea mays
  misc_feature: Ceres CLONE 1507213
  misc_feature (68)..(91): Pfam Name: Clathrin-link Pfam Description: Clathrin, heavy-chain linker
  misc_feature (33)..(67): Pfam Name: Clathrin_propel Pfam Description: Clathrin propeller repeat
MQVSQKYGLIYVITKLGLLFVYDLETAAAVYRNRISPDPIFLTAESSSTGGFYAINRRGQVLHATVNDATVVPFVSGHLNNLELAVNLAKRANLPGAENLVVQRFQELFAQTKYKEAAELAAESPQGL

SEQ ID NO: 57695 - DNA, 683 bp, Zea mays
  misc_feature: Ceres CLONE 1507214
  misc_feature: Encodes the peptide sequence at SEQ ID NO. 57696
  misc_feature (367)..(367): n is a, c, t, g, unknown, or other
  misc_feature (425)..(425): n is a, c, t, g, unknown, or other
  misc_feature (622)..(622): n is a, c, t, g, unknown, or other
  misc_feature (623)..(623): n is a, c, t, g, unknown, or other
  misc_feature (629)..(629): n is a, c, t, g, unknown, or other
  misc_feature (649)..(649): n is a, c, t, g, unknown, or other
aaaagctggagctccccgcggtggcggccgctctagaactagtggatcccccgggctgcaggaattcgtctcacccctagaaaaactctcgattcggaaaaccctccaaccctagccgggatccgacaacgcctccatccctagccgcctcctgcaagtttcagagctcaagagtcggggcgccatggcgacagagacggagactttcgcctttcaggctgagatcaaccagctgctctcactcatcatcaataccttctattccaacaaggagatcttcctccgggagctcatttccaactcttccgatgcgttggacaaaatcaggttcgagagcctcactgacaagagcaagctcgatgcgcanccggagctgttcatccacattgtaccaaacaaggcttcgaacacgctctccatcatcnacagcggcatcggcatgaccaagtccgaccttgtcaacaacctcggtaccatcgccaggtccgggaccaaggatttcatggaaccccttgctgctggcgctgatgtgtctatgattgggcagttcggtgtcggtttctactctgcctacctcctccccccaaagggtcctccttgaccaccaagcataagggagccnntagtcnaaacttgtgggaaatcccanccggggcggggccgttccctggttcactcgggga

SEQ ID NO: 57696 - protein, 138 aa, Zea mays
  misc_feature: Ceres CLONE 1507214
  misc_feature (61)..(61): Xaa is any aa, unknown, or other
  misc_feature (81)..(81): Xaa is any aa, unknown, or other
MATETETFAFQAEINQLLSLIINTFYSNKEIFLRELISNSSDALDKIRFESLTDKSKLDAXPELFIHIVPNKASNTLSIIXSGIGMTKSDLVNNLGTIARSGTKDFMEPLAAGADVSMIGQFGVGFYSAYLLPPKGPP

SEQ ID NO: 57697 - DNA, 685 bp, Zea mays
  misc_feature: Ceres CLONE 1507217
  misc_feature: Encodes the peptide sequence at SEQ ID NO. 57698
  misc_feature (685)..(685): n is a, c, t, g, unknown, or other
aaagctggagctccccgcggtggcggccgctctagaactagtggatcccccgggctgcaggaattcgtctcacccctagaaaaaacccatcactgcagctcaaacacaaagcagcatcacactagactccactggtctgcctccataataagcacagaagcgccccaataatcagcagcgcaagatcgagggatcgctatggctcagggaagaggcagtgcgacgcgggggcttgccctcggcaggctactcgccgccgctttcctcctcctcctcggcgtcgccgacgcggccacccacagggtcgacaggtccttcaacgcggacagctggaccaagggcaagagcttccgtgccggcgacctgatcgagttcaaataggaggcctccgcgcccaacgcggcggccgtggcccccagccgctacaaaggctgccgggcctccggcaccggagaatggctccgggaagaacagcatgacccgtcggcccccggaccaacgtccctgaagtgccacccctcaaacgggctcctgcgggatgggggacgaaaaaaggatgaccaaagtcgcacccccgaaaataaagcggtacatagtggcgaggaatcgtacaaaaacactatgggccttacgggcggtgtgcccccaatctaaaatctgggaccaaaatccttcaatccccctn

SEQ ID NO: 57698 - protein, 60 aa, Zea mays
  misc_feature: Ceres CLONE 1507217
MAQGRGSATRGLALGRLLAAAFLLLLGVADAATHRVDRSFNADSWTKGKSFRAGDLIEFK

SEQ ID NO: 57699 - DNA, 677 bp, Zea mays
  misc_feature: Ceres CLONE 1507218
  misc_feature: Encodes the peptide sequence at SEQ ID NO. 57700
  misc_feature (466)..(466): n is a, c, t, g, unknown, or other
atagctggagctcaccgcggtggcggccgctctagaactagtggatcccccgggctgcaggaattcgtctcacccctagaaaaaaggaaggaaatctatccaagcaacaaacttggcattcttgcctgttcttaattattgccaggacaggagaaacaaagatgaggcctcagctgatactcgtcggcactctggctgttctcgccatcctcgcagctctcggcgaaggctcgtcgtcctggccctgctgcaacaactgcggtgcttgcaacaagaagcagccgccggagtgccagtgcaatgacgtgtcggtcaacgggtgccatccggagtgcatgaactgcgtcaaggtcggtgcaggaattcgtcccggcatgggccatggccccgtcgtcacctaccgctgtgaggacgccctcacaaacttctgccaaagcagctgccccgaggggccggcgccataggngggtggccggtggcttcttctgacgtacgggatgggacgccaaagccaagtttccttccctcccgtctccgccggagaaaaagaaattaattaattaaccaaacgccccccggccccccccgttcggggctttgccctttggttcccccgtcccgggtatcaaaaaccccgcctttttccctttctcccccctagaaataaaagaaccaaa

SEQ ID NO: 57700 - protein, 100 aa, Zea mays
  misc_feature: Ceres CLONE 1507218
MRPQLILVGTLAVLAILAALGEGSSSWPCCNNCGACNKKQPPECQCNDVSVNGCHPECMNCVKVGAGIRPGMGHGPVVTYRCEDALTNFCQSSCPEGPAP

SEQ ID NO: 57701 - DNA, 698 bp, Zea mays
  misc_feature: Ceres CLONE 1507220
  misc_feature: Translation starting site: 169
aaagctggagctccccgcggtggcggccgctctagaactagtggatcccccgggctgcaggaattcgtctcacccctagaaaaaacggaagtttcggcggagccggcgtgctcgtgatctcaacccaaggcgtgcctccgctccggtcacccgtcgctccacgcaaccatgtcgaggaggaagaccagggagcccaaggaggagaacgtcacccttggacccactgtccgtgaaggagagtatgtctttggtgtcgctcacatctttgcatccttcaatgacaccttcattcatatcactgatttgtctggcagggaaactctggttcggatcaccggtggcatgaaggtgaaggctgaccgtgacaagtcctcaccttacgctgctatgcttgctgctcaagacgtcgtacaccgctgcaaagagcttggaattactgcacctgcacattaagcttcgccccccccgtaggcaacaagaccaagacccctggacctggtgcccagtctgcccttcagggcgctttgaccgattccggggataaaaaatccgaccccattggaggaccgtaacccccggttccccccctgaacagcccctccccataaaagggccggtaaaggaaggggaaaggaacgcttgtttgggacttctctttcttggcggggcctattgggccgggatcttttggcccggcg

SEQ ID NO: 57702 - DNA, 671 bp, Zea mays
  misc_feature: Ceres CLONE 1507224
  misc_feature: Encodes the peptide sequence at SEQ ID NO. 57703
  misc_feature (579)..(579): n is a, c, t, g, unknown, or other
aaagctggagctccccgcggtggcggccgctctagaactagtggatcccccgggctgcaggaattcgtctcacccctagaaaaaataaaaaagccgaagcggctgccagtaaatctgaagccgacacgaagacgacaccttcagaggaggaagctgctactcctagcgcggtgaacggggctcaggcctctctagagaacctcttgagtagagccaaagtgatcagtgcggatttctcgtgggagaagttcagcacacagtttgccgacgtgacgacccctctaacctcatcactagagaaggaacccaacaaggcacagatagccactgtgcgaggccaggaaaaagcgaagaagctggcaccgcggattgctgttgtgaagccagcagcgcagaaggcgaagcagccggatcccaaaccagaagtgagagcactgtttggtggcctcttcaaacaagaaacggtgtatgtggatgatgactaaaacgaggagcgccaatttatcctcctacgtgattttctttcttttggttttttttttttggttggcccagggccttggtgtactcttgaaatangaacgcttaaagttgtacaaaaattggctatatataagaaccaatgatcctgtgttaccagaagattgtcgataaaaaaaaaaaaaaaaacg

SEQ ID NO: 57703 - protein, 57 aa, Zea mays
  misc_feature: Ceres CLONE 1507224
KAGAPRGGGRSRTSGSPGLQEFVSPLEKIKKPKRLPVNLKPTRRRHLQRRKLLLLAR

SEQ ID NO: 57704 - DNA, 669 bp, Zea mays
  misc_feature: Ceres CLONE 1507225
  misc_feature: Encodes the peptide sequence at SEQ ID NO. 57705
taaaagctggagctccccgcggtggcggccgctctagaactagtggatcccccgggctgcaggaattcgtctcacccctagaaaaaagcggcggcgtatccctaatcccacctccagtctctgggcaccaaatttccggcggcgatggcggcggctgtggcgaggtcagggttccggcgcatgttctccgtctctgccttcgcgccgccgaaggcgcccgccgcgcgccccaaggccgacccatcccccaacctcttcgtctccggcttaagcaagcgtaccacaagtgaaggacttagagaagcctttgcggagtttggtgaagttttgcatgctcgagttgtgaccgatcgtgtcagtgggttttctaagggatttggctttgtaaggtatgctacgaccgaagaggcagccaagggaatagagggaaaggatggaaagttccttgatggatgggttatttttgcggaatacgctaaacccagaccaccaccggaggaaacatggatgaattcccagccccagcagtcatggggagctccatcaggttccttggggtgcacagtaagatgaagtgatattgtgagagccccttccctgtcccagcccctagggcttcctaccggatcgggagggatgatttttgtgtggtgtgttccaaggtgttaa

SEQ ID NO: 57705 - protein, 142 aa, Zea mays
  misc_feature: Ceres CLONE 1507225
  misc_feature (37)..(108): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAAAVARSGFRRMFSVSAFAPPKAPAARPKADPSPNLFVSGLSKRTTSEGLREAFAEFGEVLHARVVTDRVSGFSKGFGFVRYATTEEAAKGIEGKDGKFLDGWVIFAEYAKPRPPPEETWMNSQPQQSWGAPSGSLGCTVR

SEQ ID NO: 57706 - DNA, 674 bp, Zea mays
  misc_feature: Ceres CLONE 1507226
  misc_feature: Encodes the peptide sequence at SEQ ID NO. 57707
  misc_feature (439)..(439): n is a, c, t, g, unknown, or other
aaagctggagctccccgcggtggcggccgctctagaactagtggatcccccgggctgcaggaattcgtctcacccctagaaaattcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctcccacacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcngcggccgtggaagccggcggcgtgggtaccgtggtggccgtggaggcggcggctacggcgggtggcgggccccgtgattgcggcggcggctacggcggtgggggcggccgctacgggtgcggcggcggctaacggggtggtggccggcgctaccgcggtggcaaccgggggggggggttccggcacctcccacgggaactggaagaaactgagcggggggggcccccccccggcc

SEQ ID NO: 57707 - protein, 112 aa, Zea mays
  misc_feature: Ceres CLONE 1507226
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (88)..(88): Xaa is any aa, unknown, or other
MAASDVEYRCFVGGLAWATDDHSLPHAFSTYGEVLESKIILDRETQRSRGFGFVTFSTEEAMRNAIEGMNGKELDGRNITVNEAQSRXGRGSRRRGYRGGRGGGGYGGWRAP

SEQ ID NO: 57708 - DNA, 654 bp, Zea mays
  misc_feature: Ceres CLONE 1507227
  misc_feature: Encodes the peptide sequence at SEQ ID NO. 57709
  misc_feature (505)..(505): n is a, c, t, g, unknown, or other
  misc_feature (508)..(508): n is a, c, t, g, unknown, or other
  misc_feature (564)..(564): n is a, c, t, g, unknown, or other
aaagctggagctccccgcggtggcggccgctctagaactagtggatcccccgggctgcaggaattcgtctcacccctagaaaaactcccggctcagacttctgctgcagcgcctccgccgccgccgccgcatctaacgcagttccctccgccgcagcccgaggcaagatggttctccagaacgacattgatctgctcaacccgccggcagaactcgagaagctcaagcacaagaaaaagagactcgtccagtcgcccaactccttcttcatggatgttaagtgccaggggtgcttcagcataaccactgttttcagccactcccagactgttgttgtgtgccctggctgccaaactgtcctctgccaacccacaggaggaaagggcaagctcactgagggctgctctttccgcaggaagggagactagagcggatgtggtcttcaagttttgctctatgccagatactagcgtcatgaactgcctttagctaagatttccataangtngtctcgagcagctatgtgttgcatgttggctacttcaaacttatatctgggttggnttggattgtgatgaactaatggctctttgaattatattatgatggtgacgatatttggtcaaaataaaaaaaaaaaacgagacgctcgag

SEQ ID NO: 57709 - protein, 86 aa, Zea mays
  misc_feature: Ceres CLONE 1507227
  misc_feature (30)..(84): Pfam Name: Ribosomal_S27e Pfam Description: Ribosomal protein S27
MVLQNDIDLLNPPAELEKLKHKKKRLVQSPNSFFMDVKCQGCFSITTVFSHSQTVVVCPGCQTVLCQPTGGKGKLTEGCSFRRKGD

SEQ ID NO: 57710 - DNA, 659 bp, Zea mays
  misc_feature: Ceres CLONE 1507328
  misc_feature: Encodes the peptide sequence at SEQ ID NO. 57711
cgattgggtacgggccccccctcgagccactgcagtggtaaaggacagtcacacacctgctgcttcaagaaaccaccgagagcccaagcgcgcaaggcaggagagagagagagagagagcagggagagaagcgtggggccggggagcaaagatggaggggaaggaggaggacgtgcgcctgggcgccaacaagttctcggagcggcagcccatcggcacggcggcgcagggcgccggggccggggacgacgacaaggactacaaggagcccccgccggcgccgctgttcgagcccggggagctcaagtcctggtccttctaccgcgcgggcatcgccgagttcgtcgccaccttcctgttcctgtacatcagcatcctgactgtgatgggcgtgagcaagtcgtccagcaagtgcgccaccgtgggcatccagggcatcgcgtggtccttcggcggcatgatcttcgcgctggtgtactgcacggcgggcatctccggcggccacatcaacccggccgtcaccttcggcctcttcctggcgcggaagctgtcgctcacgcgcgcgctcttctacatggtcatgcagtgcctgggcgccatctgcggcgccggcgtcgtcaagggcttccaggagggcctctacatgggcgccggcggcg

SEQ ID NO: 57711 - protein, 169 aa, Zea mays
  misc_feature: Ceres CLONE 1507328
  misc_feature (50)..(169): Pfam Name: MIP Pfam Description: Major intrinsic protein
MEGKEEDVRLGANKFSERQPIGTAAQGAGAGDDDKDYKEPPPAPLFEPGELKSWSFYRAGIAEFVATFLFLYISILTVMGVSKSSSKCATVGIQGIAWSFGGMIFALVYCTAGISGGHINPAVTFGLFLARKLSLTRALFYMVMQCLGAICGAGVVKGFQEGLYMGAGG

SEQ ID NO: 57712 - DNA, 676 bp, Zea mays
  misc_feature: Ceres CLONE 1507329
  misc_feature: Encodes the peptide sequence at SEQ ID NO. 57713
  misc_feature (665)..(665): n is a, c, t, g, unknown, or other
cgattgggtaccgggccccccctcgagccactgcagtggtaaaggtcctctgcaaggccgacctgctggactacgacgccatccgccgagccgtgcacggctgccagggcgtcttccacaccgcttcccccgtcaccgacgacccggagcaaatggtggagccggcggtgcgcggcacgcagtacgtggtcaacgcggcggcggaggccggcacggtgcgacgggtggtgttcacgtcctccatcggcgcggtcaccatggaccccggccgcgggcccgacgtcgtggtcgacgagtcctgctggagcgacctcgagttctgcaagagaacgaggaactggtactgctacggcaaggcggtggcggagcaggcggcgcgggacttgtgccggcagcgcgggctggagctggcggtggtgaacccggtgctggtggtgggcccgctgctgcagccggcggtgaacgccagcatcgggcacgtgctcaagtacctggacggctccgcccgcaccttcgccaacgccgtgcaggcgtacgtggacgtgcgcgacgtggccgacgcgcacctccgcgtcttcgagagcccccgcgcgtccggcggccgctacctctgcgccgagtccgtcctcaccgcgaggacgtcgtccgcatcctcgccaagctcntctccgagtac

SEQ ID NO: 57713 - protein, 224 aa, Zea mays
  misc_feature: Ceres CLONE 1507329
  misc_feature (10)..(205): Pfam Name: Epimerase Pfam Description: NAD dependent epimerase/dehydratase family
  misc_feature: SWISSPROT Homolog: EC 1.1.1.219 Dihydrokaempferol 4-reductase
IGYRAPPRATAVVKVLCKADLLDYDAIRRAVHGCQGVFHTASPVTDDPEQMVEPAVRGTQYVVNAAAEAGTVRRVVFTSSIGAVTMDPGRGPDVVVDESCWSDLEFCKRTRNWYCYGKAVAEQAARDLCRQRGLELAVVNPVLVVGPLLQPAVNASIGHVLKYLDGSARTFANAVQAYVDVRDVADAHLRVFESPRASGGRYLCAESVLTARTSSASSPSSSPS

SEQ ID NO: 57714 - DNA, 737 bp, Zea mays
  misc_feature: Ceres CLONE 1507334
  misc_feature: Translation starting site: 421
  misc_feature: SWISSPROT Homolog: EC 2.4.1.218 Hydroquinone glucosyltransferase
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (54)..(54): n is a, c, t, g, unknown, or other
  misc_feature (439)..(439): n is a, c, t, g, unknown, or other
  misc_feature (482)..(482): n is a, c, t, g, unknown, or other
  misc_feature (485)..(485): n is a, c, t, g, unknown, or other
  misc_feature (489)..(489): n is a, c, t, g, unknown, or other
  misc_feature (509)..(509): n is a, c, t, g, unknown, or other
  misc_feature (510)..(510): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (536)..(536): n is a, c, t, g, unknown, or other
  misc_feature (538)..(538): n is a, c, t, g, unknown, or other
  misc_feature (542)..(542): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (555)..(555): n is a, c, t, g, unknown, or other
  misc_feature (556)..(556): n is a, c, t, g, unknown, or other
  misc_feature (559)..(559): n is a, c, t, g, unknown, or other
  misc_feature (560)..(560): n is a, c, t, g, unknown, or other
  misc_feature (574)..(574): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (596)..(596): n is a, c, t, g, unknown, or other
  misc_feature (600)..(600): n is a, c, t, g, unknown, or other
  misc_feature (603)..(603): n is a, c, t, g, unknown, or other
  misc_feature (606)..(606): n is a, c, t, g, unknown, or other
  misc_feature (607)..(607): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (640)..(640): n is a, c, t, g, unknown, or other
  misc_feature (651)..(651): n is a, c, t, g, unknown, or other
  misc_feature (676)..(676): n is a, c, t, g, unknown, or other
cccccgcccccgaaggtttccccccataacccttcttatattttnnnttnnntnccgattgggtaccgggccccccctcgaggccgtaggtttggtataggcgactgttagcactagaccgcccaccggccacaggtcaccgccgcgagaagaaccgaccgacgaccgagcatgaatgtcgggcctccgcacgtggccatgctggccacgccggggtagggccacctgatcccgctagcggagctggccaagcgcctggcggcgcggcgcggtgccacggccacgctcatcaccttcgcgtccgccgcgtcggccacacagcgcgcgttcctggagtctctcccgccctccgtggacgcgcgcgcgctcccgcccgtcgacctctccgacctgccccgcgacgccgccatcgagacgctgatgaccgcggagtgcgtgngctcggtcccctgcgattgtggttgtgttggtggacccccccnagnacgnccgccccgtcgcgttcgtcnncgaccnnnncgggatggagggccttnangccnccggggnnngggnnggnncggtggcctcttcnggcccgtgaccctcnnngcctntccnccncgnntttcnnnctccccgaacctggcccccttnnngncccggcccagntcccgggaccctggctcaaaccggntgcacgctgccccggcttggcctggcctttctcgaggtccctttacatccttcttctcccc

SEQ ID NO: 57715 - DNA, 659 bp, Zea mays
  misc_feature: Ceres CLONE 1507337
  misc_feature: Translation starting site: 275
cgggccccccctcgagccactgcagtggtaaaggctgggagtcccacatctgggattgcgggaagcaggtgtacttaggtggattcgacactgctcatgccgctgcaagggcgtacgaccgagcggcgatcaagttccgcggcgtcgacgccgacataaacttcaacctcagcgactacgacgacgatatgaagcaggtacatacacgagtgttcttgcagctagcaccgactgaaacatctgctgaacgtacacgcatggccctgtgcaccagatgaagagcctgtccaaggaggagttcgttcacgccctgcggcggcagagcaccggcttctcccgcggcagctccaagtacaggggcgtcaccctgcacaagtgcggccgctgggaggcgcgcatggggcagttcctcggcaagaagtacatatatcttgggctattcgacagcgaagtagaggctgcaagggcgtacgacaaggccgcgatcaaatgcaacggtagagaggccgtgacgaacttcgagcccagcacgtacgacggggagctgctgctgactgctgaagctagcgcagaagttgctgacgacgttgatctgaacttgagcatctcgcagccggcatcgtcccagagcctcaaaagagacaagaactgccttggtc

SEQ ID NO: 57716 - DNA, 691 bp, Zea mays
  misc_feature: Ceres CLONE 1507341
  misc_feature: Encodes the peptide sequence at SEQ ID NO. 57717
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (669)..(669): n is a, c, t, g, unknown, or other
  misc_feature (670)..(670): n is a, c, t, g, unknown, or other
cgattgggtaccgggccccccctcgagccactgcagtggtaaaggaccatttttagcaaacaacaataaagaaaaatatggaagcctgaccaccagctacacaacagtgcaatggacgagctcgtctgccccgccgcctcatcatgcagctctccctcgcccacctccttcttcgcggccggccacgtaccggagctcgagttcgtgtcctgggatgtcccggaggaatggatggagggcaccgactggttcgatgaacctttggatggcgacgagggctcgcgctcggcgggcaacgacctgtccggcgaaccgccggcgcctgcgccgaagcggcggcgtggccggaagcccgggccccggaccaacggccccactctcagccacgtggaggccgagcggcagcggcgggacaagctcaaccgccgcttctgcgagctcagggccgccgtgcccacggtgtcccggatggacaaggcgtccctcctcgcggacgccgtcacctacatcggggagctgcgcgaccgcgtcgagcagctagaggctgaggcgaagcaggcctcggccgctgtcaccaccgcggtggcagcggccagccactcgttcgcccccctgcacgagaaactggggctgagtgcggaatgtggcccgcttnnnaaaaannnnngnngcctttccccctgaaaaccaa

SEQ ID NO: 57717 - protein, 190 aa, Zea mays
  misc_feature: Ceres CLONE 1507341
  misc_feature (88)..(137): Pfam Name: HLH Pfam Description: Helix-loop-helix DNA-binding domain
  misc_feature (182)..(182): Xaa is any aa, unknown, or other
  misc_feature (184)..(184): Xaa is any aa, unknown, or other
  misc_feature (185)..(185): Xaa is any aa, unknown, or other
  misc_feature (186)..(186): Xaa is any aa, unknown, or other
  misc_feature (187)..(187): Xaa is any aa, unknown, or other
MDELVCPAASSCSSPSPTSFFAAGHVPELEFVSWDVPEEWMEGTDWFDEPLDGDEGSRSAGNDLSGEPPAPAPKRRRGRKPGPRTNGPTLSHVEAERQRRDKLNRRFCELRAAVPTVSRMDKASLLADAVTYIGELRDRVEQLEAEAKQASAAVTTAVAAASHSFAPLHEKLGLSAECGPLXKXXXXLSP

SEQ ID NO: 57718 - DNA, 667 bp, Zea mays
  misc_feature: Ceres CLONE 1507346
  misc_feature (212)..(212): n is a, c, t, g, unknown, or other
  misc_feature (214)..(214): n is a, c, t, g, unknown, or other
  misc_feature (216)..(216): n is a, c, t, g, unknown, or other
  misc_feature (217)..(217): n is a, c, t, g, unknown, or other
  misc_feature (228)..(228): n is a, c, t, g, unknown, or other
  misc_feature (315)..(315): n is a, c, t, g, unknown, or other
  misc_feature (478)..(478): n is a, c, t, g, unknown, or other
  misc_feature (555)..(555): n is a, c, t, g, unknown, or other
  misc_feature (569)..(569): n is a, c, t, g, unknown, or other
  misc_feature (608)..(608): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (630)..(630): n is a, c, t, g, unknown, or other
cgattgggtaccgggccccccctcgagccactgcagtggtaaagggatcaggtccggcctcgactgatttgttgccaggcatttcttcttcgcagagaaaaggagtagcagtactaagtacagtagctagccacgtaccaccagccgcagcgaaaccacctcccttttgtcttctgacttgagctcttcttgtatctatcgacatacgcgtnantnnaataaattccntaatttcccttaaatccccctaaaatttttttaaaaaaaaaagggggggggccccccccccccccccctgtttttttaacgcgggcnggtcggacctggaaggaattaaattataggccgccgtccccccccccccgaggagaaggaccctcctcttggggtggggggggagaaaaatatttttctttccggggcgggggaggagcaaaaacaacccaccccggaggggggggggggggtgttcctccanaaaaaaaaaccccccccccccccacccacagactaagacctctttttccctcctctttcacaaaaaaaacaaaagancggcgtggttgggngtggcccctgttcattcccccaaacacaacaaacacggntnnnnttgggggggggggagangatgagaaaaaaaaaaaaacacccccccccccccccg

SEQ ID NO: 57719 - DNA, 709 bp, Zea mays
  misc_feature: Ceres CLONE 1507350
  misc_feature: SWISSPROT Homolog: EC 1.11.1.7 Peroxidase
  misc_feature (33)..(33): n is a, c, t, g, unknown, or other
  misc_feature (34)..(34): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
tttctttttatacttttctatactctccccagnnaannnnatnnnnnnnnnnccgattgggtacgggccccccctcgagccctgcttcgctataggatggatgttaaccttctgcaagtcgaggagatcttcaactgaagaaaaccacgattgcagcagcgaaatactccacggtgtaccattagctgcattgcgttactgggttagcagagtggcggcgtagcagtgccgtgcgtcgagtcatggacttcctcttcttttacttccttgtcagagatggagctcttgtgcctagcggcggcggcggcggacgcggcacaactgtcgccgacattctactccacgtcgtgtcccatagctctggccaacatcaaggccgccgtgacgcgtcacggatgcgcacgacgctcgcatgagaggcctccctgctcatgctccacttccatgactgctttgtccaaggctgcgatggcccggtgctgctgaatgacacagccaccttcaccggctagcagaccgctaatccgatagtcggctccatcagagacttcggcgtcgtcaacaacatcaaggcgcacgtggaggcggcgtgaccggtcgtcatctcctgcgcctacatcctcgccgtcgccgcccgcgactccatcatctcgctgggagggacttcctggacggagcttctcaggccgagggactctacgacgatgac

SEQ ID NO: 57720 - DNA, 693 bp, Zea mays
  misc_feature: Ceres CLONE 1507353
  misc_feature: Encodes the peptide sequence at SEQ ID NO. 57721
  misc_feature (463)..(463): n is a, c, t, g, unknown, or other
  misc_feature (513)..(513): n is a, c, t, g, unknown, or other
cgattgggtaccgggccccccctcgagccactgcagtggtaaagggaaatagaaagtttgataaagagtgaaatagagagtcgctggagataatagtcgcccgcaacccatttgaaaatcacgccgtgttggcgtgtaatcggcgattcggcggccgccgggcggtggcgatggaggtgggtgacctgcacaaggtgtgggaggtccgtgcgctcaagatcaagcccgacgcgaccgccgcgcgggcaaccctcgaccgcgttgccaggccgcggaacccgaggctgctggggctcaatgtcggcgcgggcgtcgaagtcaagctgcggctacggcgcgccggccgcgaccatgacttcatcccgtacgaaagagtgctcgataccatgctacacgagctctgcccacacgagcgcgggccccacgatgcgcagtttttacagctctgggacgagctccgcanggaatgcgaagaacttgtttcaaaggttatccctggaacagggcaagggntttgatgccacgggaaagccaaattggtggattttactgtaaatcccccaccaccattttttgggggaaagttactttaacttgctgcaaaaaagcgggcaagaaatggaacttttttgccttttggaaccaaaaatttggggggaaaccgggaaatttaagaggccctttcccccaacc

SEQ ID NO: 57721 - protein, 114 aa, Zea mays
  misc_feature: Ceres CLONE 1507353
  misc_feature (7)..(116): Pfam Name: WLM Pfam Description: WLM domain
  misc_feature (98)..(98): Xaa is any aa, unknown, or other
MEVGDLHKVWEVRALKIKPDATAARATLDRVARPRNPRLLGLNVGAGVEVKLRLRRAGRDHDFIPYERVLDTMLHELCPHERGPHDAQFLQLWDELRXECEELVSKVIPGTGQG

SEQ ID NO: 57722 - DNA, 669 bp, Zea mays
  misc_feature: Ceres CLONE 1507354
  misc_feature: Encodes the peptide sequence at SEQ ID NO. 57723
  misc_feature (669)..(669): n is a, c, t, g, unknown, or other
cgattgggtaccgggccccccctcgagccactgcagtggtaaaggagtcgaggcgacgctcgacggcacggcaacagagaaagccaacagcatggctccaccaccatggccggtcgtagcgctgctgctctgcgccgcgctagcgttcgcggcgcggccgagctcggccgtggacccggtgggcacgtactgcgccaagaacttcacgggagcgcagacgcaggcgagcatcgcccaggtcctggccgcgctggtcccgcgcgcctccgcggcctactacgcgacggcgacggccggcggcggcggcggctcggccaccatctggggcctggcgcagtgccgcggcgacgtcccggcgtccgactgcgcgcgctgcgtggcggcggcggcgcggcaggcggcggcgtcgtgccggggccacgcggacgcgcgggtctggtacgactactgcttcctccgctacgacgacgccgacttcctgggcctgccggacaccgggtacgcgctcatcctcatcaacaccatgaacgccaccgacccggccgcgttcgaccgcgccgagcgcatgctcatggcgcgcgtcgctgccgacgccgccgacgccgccagcgccgggctggccagggagacggtcaggttcggctcggacgggaccaccatctacggccn

SEQ ID NO: 57723 - protein, 192 aa, Zea mays
  misc_feature: Ceres CLONE 1507354
  misc_feature (77)..(131): Pfam Name: DUF26 Pfam Description: Domain of unknown function DUF26
MAPPPWPVVALLLCAALAFAARPSSAVDPVGTYCAKNFTGAQTQASIAQVLAALVPRASAAYYATATAGGGGGSATIWGLAQCRGDVPASDCARCVAAAARQAAASCRGHADARVWYDYCFLRYDDADFLGLPDTGYALILINTMNATDPAAFDRAERMLMARVAADAADAASAGLARETVRFGSDGTTIYG

SEQ ID NO: 57724 - DNA, 644 bp, Zea mays
  misc_feature: Ceres CLONE 1507361
  misc_feature: Encodes the peptide sequence at SEQ ID NO. 57725
  misc_feature (644)..(644): n is a, c, t, g, unknown, or other
cgattgggaccgggccccccctcgagccctgcagtggtaaaggaaagggcacctgcctgtgatgtcagctgaaggttcaggaggtgtatatttcatgcgagatgcaacaggtcagaagaatattgctgtgtttaagcctattgatgaggaacccatggccaaaaacaacccaaggggtcttcctttgtccactgatggcgaggggatgaagaggggaacaattgtagggggaggtgcattcagggaggttgcagcttatattctcgaccatccagttagtgatagtaaatctggtcacagttttgggttttctggtgtgcctcccaccacattggtccgaacctcgcatagggggaagaacttcaagattggttcactgcagatgttcatggacaacaatggaagcactgaagatatgggtcctcgaccttttcctgtcaaggaggttcataaaatagcagtactagatattaggttagctaatgctgatcgtcatgctgggaatattctagtgtgcaaggagagagaaggtggcaactacaagctgattccaattgatcatggttactgcttgccagagaaggtggttatttctctgttacaatacgtatttggttcatctgcttgcaccttatttgtttcan

SEQ ID NO: 57725 - protein, 194 aa, Zea mays
  misc_feature: Ceres CLONE 1507361
  misc_feature (5)..(194): Pfam Name: PI3_PI4_kinase Pfam Description: Phosphatidylinositol 3- and 4-kinase
  misc_feature: SWISSPROT Homolog: EC 2.7.1.67 1-phosphatidylinositol 4-kinase
MSAEGSGGVYFMRDATGQKNIAVFKPIDEEPMAKNNPRGLPLSTDGEGMKRGTIVGGGAFREVAAYILDHPVSDSKSGHSFGFSGVPPTTLVRTSHRGKNFKIGSLQMFMDNNGSTEDMGPRPFPVKEVHKIAVLDIRLANADRHAGNILVCKEREGGNYKLIPIDHGYCLPEKVVISLLQYVFGSSACTLFVS

SEQ ID NO: 57726 - DNA, 661 bp, Zea mays
  misc_feature: Ceres CLONE 1507379
  misc_feature: Encodes the peptide sequence at SEQ ID NO. 57727
cgattgggtaccgggccccccctcgagccactgcagtggtaaagggaagcattcgatccgttcccttgccctaagacccacccctgatttcatttccccaatcatggcggcggctctgtcggggacggcggtgtccacggctgcgcttctagccccaatccgagctccaaccagcgcgtttatccggcgctcccagctcacctgtcatcgcctccactcactaaaatgccgccgcgctgggcccatcgtccccgcggccgctgctgccgcggcgggcagcagctcgccgtcgtcagccgttttccacggcgagtgcttcgtggtgggcgacaatatcgacactgaccagatcatccccgccgagcacctcactctggtgccctccaagccggacgagtaccgcaagctcggttccttcgccttcgcggggctcccatccgcagcctacccgacgccgttcgtcgctccgggtgaggagtcctcccgctacgccatcattgtcggcggagccaacttcgggtgcggttcctctcgcgagcacgcgcccgtcgcgcttggggccgctggcgcacgcgccattgttgcggagggctacgcgcgcatcttttttcgcaactccgtggccactggagaggtgtaccctctggagctcacggacgtt

SEQ ID NO: 57727 - protein, 186 aa, Zea mays
  misc_feature: Ceres CLONE 1507379
  misc_feature (64)..(186): Pfam Name: Aconitase_C Pfam Description: Aconitase C-terminal domain
  misc_feature: SWISSPROT Homolog: EC 4.2.1.33 3-isopropylmalate dehydratase
MAAALSGTAVSTAALLAPIRAPTSAFIRRSQLTCHRLHSLKCRRAGPIVPAAAAAAAGSSSPSSAVFHGECFVVGDNIDTDQIIPAEHLTLVPSKPDEYRKLGSFAFAGLPSAAYPTPFVAPGEESSRYAIIVGGANFGCGSSREHAPVALGAAGARAIVAEGYARIFFRNSVATGEVYPLELTDV

SEQ ID NO: 57728 - DNA, 683 bp, Zea mays
  misc_feature: Ceres CLONE 1507380
  misc_feature: Translation starting site: 181
  misc_feature: SWISSPROT Homolog: EC 3.6.3.8 Calcium-transporting ATPase
cgattgggtaccgggccccccctcgagccactgcagtggtaaaggggaaggatctcatggcgttggatgataagaagacgctgctacccaggaaaggtggcctcctgttctctaggcgggaacctaggcacaaacaagagattgtgaggttgctgaggggaagatggggaagttgtcaccatgactggacatggagtcaatgatgcccctgctttgaagctgggtgacatcggtgtagctatggacattactggaactgaggttcgcaaagaggcgtctgacatggtgttggctgaccacaattttagcaccatagtttctgcagtcggtgaaggatgatcgatctacaacagcatgaaagctttcataacatacatgatttcgttaaacattgatgaagtcccttctatatacctaacttacgtcctgggcattcctgagggtttgattctcgtgcgaattctatgggtcaatctcgtcaccgacgggccgtccgcaattgttctaggtatcaatccccctgacaaggacatcatgaaataaaccccttagggaggaccgacgaactacttgatccatcccctggatcctgttccgcttaccaggtgattggacatttaccttgggaatggccaccgttggcctccttccttcttatgggtgacccaatggggttttttccg

SEQ ID NO: 57729 - DNA, 654 bp, Zea mays
  misc_feature: Ceres CLONE 1507383
  misc_feature: Encodes the peptide sequence at SEQ ID NO. 57730
  misc_feature (579)..(579): n is a, c, t, g, unknown, or other
  misc_feature (583)..(583): n is a, c, t, g, unknown, or other
cgattgggaccgggcccccctcgagccctgcagtggtaaaggctgcctttgccttccactggttcgcttctccctctcctgtgcttggctgctgcttgcccgttgagcacagcagggaggcgatgagggactgggcgccgtcgatcatcgccacggcgctgttcgcgctcctgtgcccgggcggcgtgctgcagatgcccggccggcaccgccccgtcgacctcatgaacatgaagaccagcttcccgtccatgctcgtccacgccgtcatctacttcctgctgctcatgctcttcctcgtcatcctgcagcctcacctctacatctgacgtgagcgtgttccccaccccttcacataagcttctagcatgtttcagtttcttctttcttgggatgcagttttgggcccttttaatagctttgtaaccttatgaaccagaggattatatacgtaatatgcgttctgtagcttccgttgggcaataagaactgaagttcccctgctccctgaaaacttttagtctgcttcagagtttcaggcggcttcagtgtgtcagtttatctggacccaagtttcgntccnattttttcgtctcctgcagcatgacgtgcatgttttaaaaaaaacagtaaagaacatagcacagcgtggat

SEQ ID NO: 57730 - protein, 68 aa, Zea mays
  misc_feature: Ceres CLONE 1507383
MRDWAPSIIATALFALLCPGGVLQMPGRHRPVDLMNMKTSFPSMLVHAVIYFLLLMLFLVILQPHLYI

SEQ ID NO: 57731 - DNA, 673 bp, Zea mays
  misc_feature: Ceres CLONE 1507387
  misc_feature: Encodes the peptide sequence at SEQ ID NO. 57732
cgattgggtacgggccccccctcgagcactgcagtggtaaaggtgtcgacgatgtcccctgccgcggccgcggccatgctcctcggcgcgtcggtggcgctcatgctctgcggctccgtcaccttcgccatcggcttcctcctcatgccctgggtcgccggcctcgcgctcctcttcggcttcgccggcgccgtcaacaccctctcctcctcggggctgttcctctgcagcggcagcggcaccaagcagccccccgccgcgggcccctgcaagcacacgcggtgacggatcgtcatcgggctcgggccgccggggccccaaccccagtggtcggatccgatgcgctcctcgcctagcttgctcccctcctccggccagccggaaccgtgcctagatttatttttcttcttcgtggatggatggatgatggaaggattattataattccctgtaaaaacgcgcccatttgctgtagtactaatatgctggttaatgggaggaatgtcacaggatatttaagtgatcgtttagaatccttattgagaaaaaaaaaaaaaaaaaccagagctctgggaattcctgcagcccgggggatccactagttctagagcggccgccaccgcggtggagctccagctttttgtccctttagtgagggttaatttcgagcttt

SEQ ID NO: 57732 - protein, 94 aa, Zea mays
  misc_feature: Ceres CLONE 1507387
RLGTGPPSSTAVVKVSTMSPAAAAAMLLGASVALMLCGSVTFAIGFLLMPWVAGLALLFGFAGAVNTLSSSGLFLCSGSGTKQPPAAGPCKHTR

SEQ ID NO: 57733 - DNA, 673 bp, Zea mays
  misc_feature: Ceres CLONE 1507390
  misc_feature: Encodes the peptide sequence at SEQ ID NO. 57734
  misc_feature (656)..(656): n is a, c, t, g, unknown, or other
cgattgggtccgggccccccctcgagccactgcagtggtaaaggtctgacgcgacgcctcaaatcgctccctgcctctggtcacctcgcttccgctcccggctcccctccggccacccagacatcgtccgttcgctcgccaagagacaggaccggagaccatggcggaccagctcaccgacgaccagatcgccgagttcaaggaggccttcagcctcttcgacaaggacggcgacggttgcatcacaaccaaggagctcggaactgtcatgcgatcactgggtcagaacccaaccgaggctgagctccaggacatgatcaacgaggtcgatgcggacggcaacggcaccatcgacttcccggagttcctcaacctcatggcccgcaagatgaaggacaccgactccgaggaggagctcaaggaggcgttcagggtgttcgacaaggaccagaacggcttcatctctgcggcggagctccgccacgtgatgaccaacctcggcgagaagctgaccgacgaggaggtcgatgagatgatccgcgaggccgacgtcgatggtgatggccagatcaaactacgagagttcgtcaaggtcatgatggccaagtgagtaaaagctgcggtaacggtatagtaccccgcgggaattgaaggangaaaccaaaccgtgctt

SEQ ID NO: 57734 - protein, 149 aa, Zea mays
  misc_feature: Ceres CLONE 1507390
  misc_feature (85)..(113): Pfam Name: efhand Pfam Description: EF hand
  misc_feature (12)..(40): Pfam Name: efhand Pfam Description: EF hand
  misc_feature (48)..(76): Pfam Name: efhand Pfam Description: EF hand
  misc_feature (121)..(149): Pfam Name: efhand Pfam Description: EF hand
  misc_feature: SWISSPROT Homolog: EC 2.7.11.1 Non-specific serine/threonine protein kinase
MADQLTDDQIAEFKEAFSLFDKDGDGCITTKELGTVMRSLGQNPTEAELQDMINEVDADGNGTIDFPEFLNLMARKMKDTDSEEELKEAFRVFDKDQNGFISAAELRHVMTNLGEKLTDEEVDEMIREADVDGDGQIKLREFVKVMMAK

SEQ ID NO: 57735 - DNA, 742 bp, Zea mays
  misc_feature: Ceres CLONE 1507391
  misc_feature: Encodes the peptide sequence at SEQ ID NO. 57736
  misc_feature (1)..(1): n is a, c, t, g, unknown, or other
  misc_feature (17)..(17): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
ncccctaaaaactgggncttttataatnnnnnnnnnnnatatgtgnnnnnnnattcgattgggtaccggcccccccctcgagcactgcagtggtaaagggtcgtagctccttctcctacacagaaaagccgtcgcctactcgcctccggccaaaaaactgactccacacacgacccaaatcttttcctctccacaggcgactcccaacgcaacagcagctcgtcgagcgagtcgtcgccggccggccggtatatacgcaagaaagccaagaaaaacacttctgcctcttcctccatatccaagaaccaaaggtagctagctagccgcgactcgttggctagacgattcaagcagcagcgcaggatggtggcgccggtggtgattgcgtcggccgggctgggcatgctggccggcgtggcgatggccaaccggtcgggggggaacgggggctcccggcggcctccaggtgggacgcgcgcccgcgctgcgccacgtgcggcggctcccggccgcgtgaagtgcatcctgcaccgctggtccgacggcgactccggctggcggacctggcatgggaccgggaagaagccccggccgaagactgccgcggccccggggaagggcccgaaccctcccctgcacggggtccccgccccagaacaaaaaaaccgcccgctgcccgtccgctgaccggggttacaaactgaatcgaagggcgggatatattccggcaaccccgaactcc

SEQ ID NO: 57736 - protein, 107 aa, Zea mays
  misc_feature: Ceres CLONE 1507391
MVAPVVIASAGLGMLAGVAMANRSGGNGGSRRPPGGTRARAAPRAAAPGRVKCILHRWSDGDSGWRTWHGTGKKPRPKTAAAPGKGPNPPLHGVPAPEQKNRPLPVR

SEQ ID NO: 57737 - DNA, 689 bp, Zea mays
  misc_feature: Ceres CLONE 1507393
  misc_feature: Encodes the peptide sequence at SEQ ID NO. 57738
cgattgggtaccgggccccccctcgagccctgcagtggtaaaggaaacactaaaaagaagggagcggccgcgcctccaccccaaacccacctcgcctcctagtccccccacttcgcctcctctcccgagtcccatcggagcccggaggtctctcgcctcccgcgaggctgtgtggtgaggcgtggacgagatgaacgagcaggggctcggtggtctcggcgggggccgcggggccgtgcaggggcacgggcgggaggcgatggcgctcctgcagcaccagcagcttcaacagcaacggcggcagctggaggaggaggatgaggtgcggcgccagatgttcggcggggtggcggcgttcccggcagcgctgggccacggccagcaggtggactacggggaggacgccggcgggctcggggacagcgatgcgggcgggtcggagcccgagccaccgccggagcggacgcgcggggggtccggcggcggcggcaagcggagccgcgctgccgaggtgcacaacctctccgagaaggagaggaggagcaagatcaacgagaagatgaaagcgctgcagagcctaatacccaactccaaacaagaccgacaaggcatccctgctttgacgaggccatttgagtaatctgaagcaactgccactcccaagtgcaagatgcttgtctatgaaaaat

SEQ ID NO: 57738 - protein, 149 aa, Zea mays
  misc_feature: Ceres CLONE 1507393
MNEQGLGGLGGGRGAVQGHGREAMALLQHQQLQQQRRQLEEEDEVRRQMFGGVAAFPAALGHGQQVDYGEDAGGLGDSDAGGSEPEPPPERTRGGSGGGGKRSRAAEVHNLSEKERRSKINEKMKALQSLIPNSKQDRQGIPALTRPFE

SEQ ID NO: 57739 - DNA, 675 bp, Zea mays
  misc_feature: Ceres CLONE 1507397
  misc_feature: Pfam Name: GLTP Pfam Description: Glycolipid transfer protein (GLTP)
  misc_feature (636)..(636): n is a, c, t, g, unknown, or other
cgattgggtaccgggccccccctcgagccactgcagtggtaaagggtagtgtcctcgccgattgtgcaattctctgttgtattaggggacttccgctgcgagatccgtgaacggttcagacatggaacagacggtgatcaccccctctttggaaactatgaaccatgtcatggcagagaacggagtaattctcacctagcccatccttgatgtctgcaggaaaatataggctgtcctccataactttggaactgctatggcaattgaccagagtgatcatcctcggcaatatcacactactgcacaaccagtatacttcagaaccatcggaggatgaacacttgtacagcatgattcacgaaaaagatcacaacaccaccggtcaaggttcctcgagctgcacaagtgagcatctgtgtatgacaacggacatgtacttacttgttgacttgttacagaacgtgcttgagcatccagactgagctcatcagtcaatcttgaactgattcatacaacacgttctgactacatgccatgactggcttgcttcctctatgtttacggtggcgatgaagcatgcttctaatggaagggaaattgatggaggatattttggaatccggtgcactgaatgcngacttttgggaaattttcgacgaccgttatatcatttaa

SEQ ID NO: 57740 - DNA, 663 bp, Zea mays
  misc_feature: Ceres CLONE 1507401
  misc_feature: Encodes the peptide sequence at SEQ ID NO. 57741
cgattgggtaccgggccccccctcgagccactgcagtggtaaaggcctcgccgtctatcgccaaggacgtcaccgagttgatcgggaacacaccgctggtgtacctcaacaaggtgaccgatgggtgcgtcggccgcgtcgccgccaagctcgagtccatggagccctgctccagcgtcaaggataggattggctacagcatgatcacggacgcagaggagaaagggctgattactccaggcgtgagtgttctgattgaaccaactagcggcaacacaggcattggactggcctttatggctgctgccaggggctacaaacttacactcacaatgcctgcctccatgagcatggagaggaggatcatattgaaggcttttggtgctgaacttgtccttactgacccactcctgggaatgaaaggagctgtcaagaaagcggaagagatacaagcaaagacacccaactcgtacatccttcatcaatttgaaaatccagctaacccagagattcactatgagactactgggcctagaatctggaaagctacaacaggaaaattgctggccttgtatctggtatcgggacaggaagtaccatcaccggtactgggcgatacctcagagagcaaaaacctaatgtcaagctttattggtgtgaagc

SEQ ID NO: 57741 - protein, 220 aa, Zea mays
  misc_feature: Ceres CLONE 1507401
  misc_feature (23)..(218): Pfam Name: PALP Pfam Description: Pyridoxal-phosphate dependent enzyme
  misc_feature: SWISSPROT Homolog: EC 2.5.1.47 Cysteine synthase
IGYRAPPRATAVVKASPSIAKDVTELIGNTPLVYLNKVTDGCVGRVAAKLESMEPCSSVKDRIGYSMITDAEEKGLITPGVSVLIEPTSGNTGIGLAFMAAARGYKLTLTMPASMSMERRIILKAFGAELVLTDPLLGMKGAVKKAEEIQAKTPNSYILHQFENPANPEIHYETTGPRIWKATTGKLLALYLVSGQEVPSPVLGDTSESKNLMSSFIGVK

SEQ ID NO: 57742 - DNA, 664 bp, Zea mays
  misc_feature: Ceres CLONE 1507402
  misc_feature: Encodes the peptide sequence at SEQ ID NO. 57743
  misc_feature (118)..(118): n is a, c, t, g, unknown, or other
  misc_feature (371)..(371): n is a, c, t, g, unknown, or other
  misc_feature (664)..(664): n is a, c, t, g, unknown, or other
tcgagccctgcagtggtaaagggagtggaagggaggaggtgagccaccggaagcggagacgtgagtagtcgaccaaccccgtcggtccggcgactccggctgcggcgcggcgtgctanatcgctaccgaccatggtggtggaggagatcgccgagggggtgaaaaacctcaccgttaccggagatgcggcggcttcaggcggagaggggcagaggaggggcggcggcggcagcagcaacccgcatccaggtgtccaacaccaagaagcccctcttcttctacgtcaacctcgccaagaggtatatgcaacagcacgacgatgtagagctatccgctcttgggatgcccatagcaacaggggggggggtggnaaaaattctgaagaacatggattccccgttgaaaagaaaattaggacctccactgttgaaataaacgactaatcaagagggcgtccctttccaaaaggccactattgtagaaatctttgggaaaacaccgcccaatttttatgaacctgatggcccccttctgcacaacaatagggggtaaacttggcaaaagggtgaaaaaccatggcttgcaaaacttttaccgattgaccaagcgccctggcctgctggcgcccccgatacctgcctggttaacacttacctttcccccn

SEQ ID NO: 57743 - protein, 83 aa, Zea mays
  misc_feature: Ceres CLONE 1507402
  misc_feature (63)..(63): Xaa is any aa, unknown, or other
MRRLQAERGRGGAAAAAATRIQVSNTKKPLFFYVNLAKRYMQQHDDVELSALGMPIATGGGVXKILKNMDSPLKRKLGPPLLK

SEQ ID NO: 57744 - DNA, 685 bp, Zea mays
  misc_feature: Ceres CLONE 1507403
  misc_feature: Encodes the peptide sequence at SEQ ID NO. 57745
cgattgggtaccgggccccccctcgagcactgcagtggtaaaggaaggacgtggagtggctcaagtccatcaccagcctgccgattctgctcaagggcatcgtcaccgcggaagacgcgaggaaggccgtggaggcgggggcggccggcgtgatcgtgtccaaccacggcgcccggcagctggactatgcgccggccaccatctcggcgctcgaagaggtggtcaaggcggtggcgggggctgtgccggtgctggtggacggcggcgtccggcgcggcaccgacgtgttgaaggcgctggcgctcggcgccaaggcagtcatggtgggcaggccggtgttcttcgggctggcggcgcgcggggaaaccggcgcgaggcacgtgatggagatgctgaacaaggagctggagttggccatgcccctctgcggctgccgtaccgtcgcggaggtcaccagggcgcacgtccagaccgagggcaaccggatcaggcccctgttgtgacctataaaaaaccgacatatcccaaggcaaccccggtgctgtcggggttgcgatatgatttaattagaaacgggaggggctgcggagggcccccccaattgttgcccccaaacccgttaaccttatttacttattgcccgaacccgggggcttgaactatgcctttccgcggcttaatgcaa

SEQ ID NO: 57745 - protein, 60 aa, Zea mays
  misc_feature: Ceres CLONE 1507403
  misc_feature: SWISSPROT Homolog: EC 1.1.3.15 (S)-2-hydroxy-acid oxidase
MVGRPVFFGLAARGETGARHVMEMLNKELELAMPLCGCRTVAEVTRAHVQTEGNRIRPLL

SEQ ID NO: 57746 - DNA, 646 bp, Zea mays
  misc_feature: Ceres CLONE 1507404
  misc_feature: Encodes the peptide sequence at SEQ ID NO. 57747
  misc_feature (597)..(597): n is a, c, t, g, unknown, or other
cgattgggtaccgggccccccctcgagccctgcagtggtaaaggaaccgcctgctgctctatatcctacgactagctagctagctactgtgtagctactagcgtactctacgctgcagctgggcaagaatcgacgatcgacgccacaccacgacgacgacgatggcttatttccttgccagtaataagtgcgtgctgctgtccctcttctccgtcgtcgtgctcctctgtctcggcggcggcgcctccgccatgggcagcctgcccccgccaccgccgatggtgaacttcagcatcggcgtgcagggtgtggtgtggtgcaacacgtgcaggtacccccggctactttcgcgccccatggaacgccgtccccccgcctccccaaggggcgaaaaggggttaccttgggggggggaaaacaccggggtttaaccccccccctaaaaagagggggggggggggaaaaaaggggggccccccccggggggggtttttttttctttttttttagtataaaaaaaaaaaaattcctaaaagggggaggggggggggggggggggggtgtatatcccacaaaacacccaaccaacagagaatntgggggggggggggggggtaaataatatacccccccccccccccccccc

SEQ ID NO: 57747 - protein, 89 aa, Zea mays
  misc_feature: Ceres CLONE 1507404
MAYFLASNKCVLLSLFSVVVLLCLGGGASAMGSLPPPPPMVNFSIGVQGVVWCNTCRYPRLLSRPMERRPPASPRGEKGLPWGGENTGV

SEQ ID NO: 57748 - DNA, 681 bp, Zea mays
  misc_feature: Ceres CLONE 1507409
  misc_feature: Encodes the peptide sequence at SEQ ID NO. 57749
  misc_feature (501)..(501): n is a, c, t, g, unknown, or other
  misc_feature (574)..(574): n is a, c, t, g, unknown, or other
  misc_feature (578)..(578): n is a, c, t, g, unknown, or other
  misc_feature (579)..(579): n is a, c, t, g, unknown, or other
  misc_feature (598)..(598): n is a, c, t, g, unknown, or other
  misc_feature (616)..(616): n is a, c, t, g, unknown, or other
  misc_feature (650)..(650): n is a, c, t, g, unknown, or other
cgattgggtccgggccccccctcgagccctgcagtggtaaaggagcgcccgtcgcctccctttccccttccctccctccctctccccgcgggccgccagaggcaatttcgccctcgattcgaccccgattcgtccgcccgcgaccgggattccctccgccaagcgcggatctgaacgctgcgctccgtgtcgccgctcgaatccgccatgaagggggccaaatccaagggcgccgccaaggccgatgccaagctggcggtgaagagcaagggggcggagaagcccgccaagggcaggaaagggaaggccggcaaggaccccaacaagcctaagagggctcccagcgctttcttcgtgttcatggaggaatttcgcaaggagttcaaggagaagaaccctaagaacaagtctgtcgctgcggtggggaaagctgctggcgacaggtggaaatccctgagcgagtcggacaaggctccctatgtagccaaggctaacaagctncagctcgagtacaacaaggccatcgctgcctacaacaagggcgagagcactgcagctaagaaggctcctgccnaggnnagagaggaggaagatgaangagagtctgaccagtccnagtcggaggtcaatgacgaggatgatgaagaggntagtgagggagatgaagatgatgacgagtga

SEQ ID NO: 57749 - protein, 157 aa, Zea mays
  misc_feature: Ceres CLONE 1507409
  misc_feature (41)..(110): Pfam Name: HMG_box Pfam Description: HMG (high mobility group) box
  misc_feature (123)..(123): Xaa is any aa, unknown, or other
  misc_feature (124)..(124): Xaa is any aa, unknown, or other
  misc_feature (131)..(131): Xaa is any aa, unknown, or other
  misc_feature (137)..(137): Xaa is any aa, unknown, or other
  misc_feature (148)..(148): Xaa is any aa, unknown, or other
MKGAKSKGAAKADAKLAVKSKGAEKPAKGRKGKAGKDPNKPKRAPSAFFVFMEEFRKEFKEKNPKNKSVAAVGKAAGDRWKSLSESDKAPYVAKANKLQLEYNKAIAAYNKGESTAAKKAPAXXREEEDEXESDQSXSEVNDEDDEEXSEGDEDDDE

SEQ ID NO: 57750 - DNA, 689 bp, Zea mays
  misc_feature: Ceres CLONE 1507413
  misc_feature: Encodes the peptide sequence at SEQ ID NO. 57751
  misc_feature (689)..(689): n is a, c, t, g, unknown, or other
cgattgggtccgggccccccctcgagccctgcagtggtaaaggtctgtcttcctccgtgcgtcccggcgcgaaccctagccgagattagattgaggcgagcgccatcaccggaggaagaggaagacacgatgctgcgggttgcgggaagaaggctctcgtcttccctctcctggcgccccgccgtggcggcggccaggggccccctcgccggcgctggcgcccccgatcgggacgacggctcggctcgcggccggagccagacgcggttctccatcgactcccccttctttgtcgctgccaggggtttctcttcgactgaaacacttgtcccaggaaaccaagatgctggcctagctgacctcccagcaactgtggctgctgtgaagaatcctaaccctaaggtggtttatgatgagtacaatcatgaaagatatcctcctggagatcccagcaaacgtgcatttgcttactttgtcctgagtggtgggagaatcatatatgcatcactgctgcgtctcctcgtattgaagtttgtcctgagcatgtcagcaagtaaggacgggctttgccctttgcttcactcgaggggggacctctccggcattgagccagggaaccacgggtgactgttaaatgggcgtggaaaaggcatgtcttcctccgacgcccgggagggaggacgaactcn

SEQ ID NO: 57751 - protein, 165 aa, Zea mays
  misc_feature: Ceres CLONE 1507413
  misc_feature: SWISSPROT Homolog: EC 1.10.2.2 Ubiquinol--cytochrome-c reductase
MLRVAGRRLSSSLSWRPAVAAARGPLAGAGAPDRDDGSARGRSQTRFSIDSPFFVAARGFSSTETLVPGNQDAGLADLPATVAAVKNPNPKVVYDEYNHERYPPGDPSKRAFAYFVLSGGRIIYASLLRLLVLKFVLSMSASKDGLCPLLHSRGDLSGIEPGNHG

SEQ ID NO: 57752 - DNA, 681 bp, Zea mays
  misc_feature: Ceres CLONE 1507414
  misc_feature: Encodes the peptide sequence at SEQ ID NO. 57753
  misc_feature (464)..(464): n is a, c, t, g, unknown, or other
  misc_feature (522)..(522): n is a, c, t, g, unknown, or other
  misc_feature (523)..(523): n is a, c, t, g, unknown, or other
  misc_feature (581)..(581): n is a, c, t, g, unknown, or other
cgattgggtccgggccccccctcgagccctgcagtggtaaagatcagtcatcacccaccgcctccgccgccgacaacagcgtagtgtagtgtagttccggagagggttggggagagtagtagtgatccgcaatgtcgacggaggaggctgttgtggctgaggtcccggtgaccgaggtgccagcggaggtcccggcggcccaggtggccgaggcgcccaaggcgaagaaggcgcccaaggaggagaaggcgcctaaggagaagaagccgtccgcggcgaagaagccggcggcgcaccctccctacgctgagatgattgtagaggcgatcgctgccctcaaggagaggaaggggtcgagctcggtggccatcagcaagtacgtcgaggggaagcacggcggcaagctccccaccaacttcccgcagcagctcaccgtgcagctgaagaagctcgctgccgccggncagctgacgagggtgaagaactccttttcagctgcggccaccgacgccagccccaggnncgccagccccagggcaccaaggcccgcgccccagccccagccctcgcccgaggcgaanggccaagaccgctgcgaagcccaaggggcgtccccccaagcccaaggccaggcccaggccagggcaaaccttgttcttcttggcgcccggtcgcccaaac

SEQ ID NO: 57753 - protein, 183 aa, Zea mays
  misc_feature: Ceres CLONE 1507414
  misc_feature (54)..(124): Pfam Name: Linker_histone Pfam Description: linker histone H1 and H5 family
  misc_feature (131)..(131): Xaa is any aa, unknown, or other
  misc_feature (150)..(150): Xaa is any aa, unknown, or other
MSTEEAVVAEVPVTEVPAEVPAAQVAEAPKAKKAPKEEKAPKEKKPSAAKKPAAHPPYAEMIVEAIAALKERKGSSSVAISKYVEGKHGGKLPTNFPQQLTVQLKKLAAAGQLTRVKNSFSAAATDASPRXASPRAPRPAPQPQPSPEAXGQDRCEAQGASPQAQGQAQARANLVLLGARSPK

SEQ ID NO: 57754 - DNA, 687 bp, Zea mays
  misc_feature: Ceres CLONE 1507421
  misc_feature: Translation starting site: 271
  misc_feature: SWISSPROT Homolog: EC 1.1.1.21 Aldehyde reductase
  misc_feature (352)..(352): n is a, c, t, g, unknown, or other
  misc_feature (414)..(414): n is a, c, t, g, unknown, or other
  misc_feature (415)..(415): n is a, c, t, g, unknown, or other
  misc_feature (451)..(451): n is a, c, t, g, unknown, or other
  misc_feature (471)..(471): n is a, c, t, g, unknown, or other
cgattgggtacgggccccccctcgagccctgcagtggtaaagggctgacgcgcacccgcaccagcctctagtcggccagtcgggacgaagcctctcgaacgagcgaggccacgaggtgcccgccgcgcccagccggcctcgccgaccgggcccgccggcccctatataggcaggcgccacttcctcctcgcaaccaccagacgccagtccaccaccgcttcccgtgcagcgccctccctctacgttcccccatttcctgtgttggcggcgatggcgcggcacttcgtgctcaacaccggcgccaagatcccctccgtggggctcggcacctggcagtctgaccccggcgtcngtgggcacgctgtctacgcccgccgtcaggcgggttaccgacatatcgatggtgcagagttnnacggcacgaaaaggagatgggtttgccgctgaaaangctatttgaagagggtgtantgaaccaaaaaaattctgttatcacttctaagctttggaatgatcatcatgctcctgaaaaaatggcctgaaggccttaatgacccccctgatgatttgcacctgggagaccccggacctttaccttacccctgggcctttttaagccaaaagggggaaccaaaccccccccggagaaatttttttaacccccgaccctcccggccttttgggggg

SEQ ID NO: 57755 - DNA, 1101 bp, Zea mays
  misc_feature: Ceres CLONE 1507422
  misc_feature: Encodes the peptide sequence at SEQ ID NO. 57756
gtccactcgcgcaccacgcacggcgcggtgccgactgtcgagtaaccccccattcgcattccccagccccaccgatcggatcggcaaaatcccccaccagatcccggcgcccccaccacacagcgctcgcgcctccctgcttcccaattcccgtctgcccggccgcggagcggagctgctcctgccccccgtcgccacgccacgatggcggagtgccgcagcctcatcgagttcctccgcgcgttcgagcaccaccgcagggcggccgacagctccgcctccgcgtgctcccgatccaggcgggcgtccgccgccggtggctccttctgcgacaacaccccgatggccgtgatcgacgcggtcatgctcctcgccgtcgtcatcgcgatcggcttcctcctgatcccgtacctcaagctgctcctcctcgagatgggcgcgatgctccaccccgccgcgtcctgcctcccggccgccgccttcttcggggccgcggtcgccgtcgccgcggtggtcgtcgcgtgggagctgctgggccaccacgctcgcaagtgcggcaagcccaggtgcagggggctcaagaaggccgtcgagttcgacatccagcttgagactgaggagtgcgtgcgcggccgccccggccccacggcgcgatcagcgctgcttgcggcggcgggggcgcgtcctgtggagctaggcgacgagcagcgggagttggaggctgagctgcgaaagatggcgccgcccaacggccgtaccgttctcatcttccgcgccccctgcgggtgccccaagggccgcatggaggtctggggcgccaagaaggtgcgccggatcaaaaagtaaagcggggcaaggatcggatggttactagttagtgcaatagtaccagtgcactcttgttccttcctcaatcctcataagtagctcctgctagaaaaaaatttaaaaaaaatcctcagttagcaataataagtataagtatagggtgattaaataaacggatcacagaaccagttatatcacagatagcttatatagacaatcatatactccttgtattatgaatcatggggaatttcgacagaaaaaaaaaaaaaa

SEQ ID NO: 57756 - protein, 213 aa, Zea mays
  misc_feature: Ceres CLONE 1507422
MAECRSLIEFLRAFEHHRRAADSSASACSRSRRASAAGGSFCDNTPMAVIDAVMLLAVVIAIGFLLIPYLKLLLLEMGAMLHPAASCLPAAAFFGAAVAVAAVVVAWELLGHHARKCGKPRCRGLKKAVEFDIQLETEECVRGRPGPTARSALLAAAGARPVELGDEQRELEAELRKMAPPNGRTVLIFRAPCGCPKGRMEVWGAKKVRRIKK

SEQ ID NO: 57757 - DNA, 688 bp, Zea mays
  misc_feature: Ceres CLONE 1507426
  misc_feature: Encodes the peptide sequence at SEQ ID NO. 57758
  misc_feature (205)..(205): n is a, c, t, g, unknown, or other
  misc_feature (337)..(337): n is a, c, t, g, unknown, or other
  misc_feature (373)..(373): n is a, c, t, g, unknown, or other
  misc_feature (611)..(611): n is a, c, t, g, unknown, or other
  misc_feature (626)..(626): n is a, c, t, g, unknown, or other
caattgggtaccgggccccccctcgagccactgcagtggtaaaggagagacagagagagactgccaacgaggcgaagcagccggccaatctagcatccgcgcgcggggtctgagagcagagcggcagggcgccatggcggcatcggtggcgctgagcagcgggcaccggatgccggcggtggggctgggcgtgtggcggatgganaaaggcgacatccgcggcctcatccacacagcgctccgcgtcggctaccgccacctggactgcgccgctgactaccagaacgaagctgaagttggtgacgcgctcgcagaggcattccagaccggactcgtncagcgggaggacctgttcatcacaacccagctgtgnaactcagaccatgggcatgtgcttgaagcctgcaaggacagcctgaagaagctgcagctagactatctcgacctctacctcatccatttcccagtagccactcggcaacacgggagtcggcacgacttctagcgctcctgggtgaccaatgcgtgctggacatccaccccacctatctccctgggaaacgacatgggccgcgatggaagagctttgttcccatggggctggggcccancctttggaattcggnactaccgaactctttcttcaccaaaaaaattgcctgggcctaccccaaaaataaagccgggg

SEQ ID NO: 57758 - protein, 123 aa, Zea mays
  misc_feature: Ceres CLONE 1507426
  misc_feature (7)..(123): Pfam Name: Aldo_ket_red Pfam Description: Aldo/keto reductase family
  misc_feature: SWISSPROT Homolog: EC 1.1.1.200 Aldose-6-phosphate reductase (NADPH)
  misc_feature (24)..(24): Xaa is any aa, unknown, or other
  misc_feature (80)..(80): Xaa is any aa, unknown, or other
MAASVALSSGHRMPAVGLGVWRMXKGDIRGLIHTALRVGYRHLDCAADYQNEAEVGDALAEAFQTGLVQREDLFITTQLXNSDHGHVLEACKDSLKKLQLDYLDLYLIHFPVATRQHGSRHDF

SEQ ID NO: 57759 - DNA, 676 bp, Zea mays
  misc_feature: Ceres CLONE 1507427
  misc_feature (147)..(147): n is a, c, t, g, unknown, or other
  misc_feature (148)..(148): n is a, c, t, g, unknown, or other
  misc_feature (167)..(167): n is a, c, t, g, unknown, or other
  misc_feature (185)..(185): n is a, c, t, g, unknown, or other
  misc_feature (211)..(211): n is a, c, t, g, unknown, or other
  misc_feature (220)..(220): n is a, c, t, g, unknown, or other
  misc_feature (222)..(222): n is a, c, t, g, unknown, or other
  misc_feature (223)..(223): n is a, c, t, g, unknown, or other
  misc_feature (229)..(229): n is a, c, t, g, unknown, or other
  misc_feature (230)..(230): n is a, c, t, g, unknown, or other
  misc_feature (234)..(234): n is a, c, t, g, unknown, or other
  misc_feature (242)..(242): n is a, c, t, g, unknown, or other
  misc_feature (247)..(247): n is a, c, t, g, unknown, or other
  misc_feature (250)..(250): n is a, c, t, g, unknown, or other
  misc_feature (269)..(269): n is a, c, t, g, unknown, or other
  misc_feature (272)..(272): n is a, c, t, g, unknown, or other
  misc_feature (304)..(304): n is a, c, t, g, unknown, or other
  misc_feature (310)..(310): n is a, c, t, g, unknown, or other
  misc_feature (355)..(355): n is a, c, t, g, unknown, or other
  misc_feature (469)..(469): n is a, c, t, g, unknown, or other
  misc_feature (470)..(470): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (544)..(544): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (568)..(568): n is a, c, t, g, unknown, or other
  misc_feature (571)..(571): n is a, c, t, g, unknown, or other
  misc_feature (573)..(573): n is a, c, t, g, unknown, or other
cgaattgggtccgggcccccctcgagccctgcagtggtaaaggaacaccacaagcacatggagaagctcggcgagctcggcgccatcgccgccggcgcgtacgccctgcacgagaagcacaaggccaagaaggacccaaaaaacganncacggcaccgggtcaaggnaggaggtggccgccctcncccgccgtgggctcccgcccgcttcnctttccacnanncacacnnaaanaaaggacnccaanaancacgcccacaactgatccntcncggttgctgttccatctgttcttccaccctcntcttcntctactgtgtgccggcccagccttgatttgggctaccaatttttncatggacttaagaactgtgtttgtccgtcctcggggtttttgttcaaaatccaatccgccctgaaaaatggggggtgcaaaaccttttttttaatttttaaccccttttttttnnacccaaaaattccccaataatgggaatttccttgtgttattttaaccaatttaaaaaatgcccnnnnnnnnncnannncnnnnnnnnnccnnnnnnanaananaaaaaaaaaaaaaaaaaaaccccaaaccttctggaatttccttccccccccggggggactccctttttttttttaaacccgccccccccccccggggggggga

SEQ ID NO: 57760 - DNA, 674 bp, Zea mays
  misc_feature: Ceres CLONE 1507429
  misc_feature: Encodes the peptide sequence at SEQ ID NO. 57761
  misc_feature (339)..(339): n is a, c, t, g, unknown, or other
  misc_feature (409)..(409): n is a, c, t, g, unknown, or other
  misc_feature (508)..(508): n is a, c, t, g, unknown, or other
cgattgggtaccgggcccctcctcgagccctgcagtggtaaagggacccccattcgttctagccctccctccgacactccgatccattactcgctatggacgcggcgggcggcgaccagctaagcctggccgcggtgcgcgacgcgctggtgcggctggaggactccgtggtgttcgcgctcatcgagcgcgcccggcatccgcggaacgcgccagcctacgcgcccgccgccaccgctggagaacattcgctcgtggagttcttcgtccgggaagcagagccctcaacgcagaggctggacattatcaaagccagaagatgttccattcttccctcangatctacccctcactctctttcctacaacgccttccccaaggtcttgcacccttttgcttcattggtcanccgtgatgatgcaatatggaaaatgtattttgatgaattgctcccgttatttcactgtgatggtgatgatggcagctatgcaccaaccagtgcactggnatttagcgtgtctgcaggttctatcaccaagaatttcatatggtaaataatgttgctgaagtggagttcaaagacgctcctcaagaatatagtcgactaataaaagaaaggacagcaattctctgatggatatgctgacattcaagggctgttgaagagaaggtca

SEQ ID NO: 57761 - protein, 152 aa, Zea mays
  misc_feature: Ceres CLONE 1507429
  misc_feature: SWISSPROT Homolog: EC 5.4.99.5 Chorismate mutase
  misc_feature (82)..(82): Xaa is any aa, unknown, or other
  misc_feature (105)..(105): Xaa is any aa, unknown, or other
  misc_feature (138)..(138): Xaa is any aa, unknown, or other
MDAAGGDQLSLAAVRDALVRLEDSVVFALIERARHPRNAPAYAPAATAGEHSLVEFFVREAEPSTQRLDIIKARRCSILPSXSTPHSLSYNAFPKVLHPFASLVXRDDAIWKMYFDELLPLFHCDGDDGSYAPTSALXFSVSAGSITKNFIW

SEQ ID NO: 57762 - DNA, 671 bp, Zea mays
  misc_feature: Ceres CLONE 1507431
  misc_feature: Encodes the peptide sequence at SEQ ID NO. 57763
  misc_feature (483)..(483): n is a, c, t, g, unknown, or other
cgattgggtaccgggccccccctcgagccctgcagtggtaaaggagtcgcatctccctctccgaaatcaaggtagcgtacaccgctgcagtttctagagccctctctgccactcgtgatcccactagtcacaatgcctgccctcgccaagcccgcctcccgcaccgccaagcccgccgcggctccgaagccgaagcctgccgccgccaagccgaaggcggccaccgctggtgcctcccacccgccttacttcgagatgatcaaggaggctatcacggcgctcaaggagaggaccggctccagctcgcaagcgatcgccaagtatgtgggggacaagcacggcgcgtctctgccggccaacttcagaagatgctttccatccagctccgtgggtccgcagccaagggccagctcgtgaaggtcaaggcttcgtacaagctctcggacgccgcaagaaggcatcccccaagacaaagctaagccnggcaagggcgccgctgccaagaacacccgccccaagccggccaaagcccgccgccgccaagtcaaaaaaagcagcggctgccaagccaaaaaaggccgctgcttgctgaaccaacccaaaattgcccgagaagaagggtcgtggcaaacccaaaaaattcccccgcccccaagccaaggccaaagcaa

SEQ ID NO: 57763 - protein, 94 aa, Zea mays
  misc_feature: Ceres CLONE 1507431
  misc_feature (35)..(93): Pfam Name: Linker_histone Pfam Description: linker histone H1 and H5 family
MPALAKPASRTAKPAAAPKPKPAAAKPKAATAGASHPPYFEMIKEAITALKERTGSSSQAIAKYVGDKHGASLPANFRRCFPSSSVGPQPRASS

SEQ ID NO: 57764 - DNA, 649 bp, Zea mays
  misc_feature: Ceres CLONE 1507432
  misc_feature: Encodes the peptide sequence at SEQ ID NO. 57765
  misc_feature (527)..(527): n is a, c, t, g, unknown, or other
  misc_feature (545)..(545): n is a, c, t, g, unknown, or other
  misc_feature (592)..(592): n is a, c, t, g, unknown, or other
  misc_feature (623)..(623): n is a, c, t, g, unknown, or other
tcgagcactgcagtggtaaaggaggctcaccagagcagagaaactcgcacgcacgcactctcttccccccctcctgcccactctccaacgcagcacaagcatctagcaaagctgcgcagcgcagccagcaagcaagcttggtccggagagacaacagatataagccagccagagagcagcaggcggaggcatggcgacgtccgtggcctgcgccttcttcttcgacgcggagccgctgggcgagcccgggcggcacgcgctggacgcctgcgcgctctgcgccaagccgctcagccgcaacagcgacatcttcatgtacaagggcgacaccccgttctgcagcgaggactgccgctatgagcagatgcaccacgacgcggcgtacgcaaggcaggcggccagcagccggcggaagcagcagcagtcgcagcggagcagaggggcctcgtccgtgggcgccaaggcggacgtgtcccgtgccagctagtcagtagtagtaaaagcaagcacagcgagtccgaagaaangaggaagatgagaagaangagggccgtgctggttcaagcagcgctacagctgcaagagatcccgntggggggggggggcttccgctcgctccgaanttctcttgggctggccgcgaggggcc

SEQ ID NO: 57765 - protein, 98 aa, Zea mays
  misc_feature: Ceres CLONE 1507432
  misc_feature (14)..(66): Pfam Name: DUF581 Pfam Description: Protein of unknown function (DUF581)
MATSVACAFFFDAEPLGEPGRHALDACALCAKPLSRNSDIFMYKGDTPFCSEDCRYEQMHHDAAYARQAASSRRKQQQSQRSRGASSVGAKADVSRAS

SEQ ID NO: 57766 - DNA, 651 bp, Zea mays
  misc_feature: Ceres CLONE 1507433
  misc_feature: Encodes the peptide sequence at SEQ ID NO. 57767
  misc_feature (314)..(314): n is a, c, t, g, unknown, or other
  misc_feature (361)..(361): n is a, c, t, g, unknown, or other
  misc_feature (618)..(618): n is a, c, t, g, unknown, or other
cgattgggtccgggccccccctcgagccctgcagtggtaaaggcgccttccccgtctctcctcttctgccgaacgagacagaccgggttatgtagcctgccttgctttcggcgagagaggaagaggcggaggagatcagggcaatgggcggggcggaggcgctgggccagccggacggccatgcgaacggggccgtggtggaggagaagctggacttgctgcggcggcagctggggaaggcggacggcgacccgctccggatcgtcggcgtcggggcgggcgcctggggcagcgtcttctgcgcgctgctgcangacgcgtacggccacctccgcgagcaggcgcaggtccgcatctgggngccgccggggcgcgccgtcgagcgcgccaccgccgagcacctcttcgacgtcatcaacgcgcgcgaggacgtcctgcggcgcctgatccgccgctgcgcctacctcaagtacgtcgaggcgcgcctcggcgacggcacgctctacgcggacgagatactcggggacggcttctgcctcaacatgatcgacacgccgctctgcccgctcagggtcgtcaccaccttccgggaggccgtctgggaccctgactttgtcntcaacggcctgccttcaacggcaccggggaggg

SEQ ID NO: 57767 - protein, 169 aa, Zea mays
  misc_feature: Ceres CLONE 1507433
  misc_feature (57)..(57): Xaa is any aa, unknown, or other
  misc_feature (73)..(73): Xaa is any aa, unknown, or other
  misc_feature (159)..(159): Xaa is any aa, unknown, or other
MGGAEALGQPDGHANGAVVEEKLDLLRRQLGKADGDPLRIVGVGAGAWGSVFCALLXDAYGHLREQAQVRIWXPPGRAVERATAEHLFDVINAREDVLRRLIRRCAYLKYVEARLGDGTLYADEILGDGFCLNMIDTPLCPLRVVTTFREAVWDPDFVXNGLPSTAPGR

SEQ ID NO: 57768 - DNA, 712 bp, Zea mays
  misc_feature: Ceres CLONE 1507443
  misc_feature: Translation starting site: 154
  misc_feature (225)..(225): n is a, c, t, g, unknown, or other
cgattgggtaccgggccccccctcgagccctgcagtggtaaaggggcgtgcgcggatgaagcacagatccatcggagtgacagcgagcgagcgagagcgagagcgagagagacagagagattatccgcgcgtcaccgactcccggcgaagacgatggggaaggggttcgcatcctacctggcgatgaagacggggccggagggcggcgacgcggcggcggcgcancaggctctgatcgacgcggaccctgcggagctcggcgtcgccgcgcggaagctcgccaaccacgcattcgtcctcggcggcgggctggggttcggcacctccctcctcaaatggctggccttcctcgccgcagtgtatctcttgatattggatcgcacaaatttaaaagaccaacatgctgaccgctctctttgttcccttcattttcctcaccctgcctaaggtgctgttttctctgatcaaaggagaggtggggaaatggattgccattattgctggttattcggcgctcattcttttcccccccctttccccgaatgggttaaaagctttcctggttccctccccccgggccaccagggggtcccccccctagcctggtttcccgggaaaccctttcggggggaaaaccccccggtgggggggccttccataatgccccttggggaaccggggaggccccccccgggctcccaaaaagaccacc

SEQ ID NO: 57769 - DNA, 661 bp, Zea mays
  misc_feature: Ceres CLONE 1507444
  misc_feature: Translation starting site: 112
cgattgggtccgggccccccctcgagccctgcagtggtaaagggttggcgtacttactgctactaatggagacggcgctgcagcagagtgctgctactgcttggcggcggcatgaggccggccggcgcggcgacgacggtgaagaaggcgaggcaggagctggagctggagcaggagcgggatttgcggtttccgcaggcggcggcggccgcggatcagggcggccttgacgaggagctccggcgcgggccgtggacggtggacgaggacctcacgctcatcaactacatcgccgacccggcgagggccgctggaaagcgctcgctcgcgccgccgggctgaaccgaacggggaagagctgccgtctgccggggcgaactacctgcgcccggacttgaaaggcgctacttccccccgaagagaagttcctctctcaacctccctcccgtggggcaaccgatggcccaaataccgcccccctgcccggcagggcggaccacaagatcaaaaacttctgggcggaacccggtggaaaaaaccaccgccaaacagtttcacctggaaacggaaaccggaaagccccttttaagggaaccccggtgccctttcccctcttgggtcgcccccccctatagccaaaggggggcgcacaaaaacgtcc

SEQ ID NO: 57770 - DNA, 871 bp, Zea mays
  misc_feature: Ceres CLONE 1507447
  misc_feature: Encodes the peptide sequence at SEQ ID NO. 57771
  misc_feature (1)..(1): n is a, c, t, g, unknown, or other
  misc_feature (34)..(34): n is a, c, t, g, unknown, or other
  misc_feature (36)..(36): n is a, c, t, g, unknown, or other
  misc_feature (42)..(42): n is a, c, t, g, unknown, or other
nctcttcttccctttttttactacctatccccananaaaaanttataaaaaaaaaacgattgggtacgggccccccctcgaggaatgaaccgggtttctcttgtcggtattcttgctttcctcctcaactgcagagagaagttcagggctctatcgttggtgaaatgcatggggatcaaggatatctgctctgcgcctgcacaacttcctctttgccgatcacttcgtttccttacaatcaaggattgcccaggtttcaccgatgcaagcttggctgcggtggggatgatttgccctcaattggagcaggttgacctgagtggtcttggtgaggccactgacaacgcgcttccttccattgattccagtcttctgaacctgggtctggtccaagtttgacttgagttgcttgcaagaaacatttacaaattgttggttggtctccctccccgggaggaaggggcacatggcaaaaatcccctcaaaaaaaaatcacccctttgaagggttttgcaaccaaagataaacaagaaaaggctatcccctcctttccaccatgggtatcggaaaaagttttgcaccccaaagtcttttgccgcgaaacttttaattccttttccaaaacttggcaatggggttataggggaactacccgggtggtttggccccatccttgtggctatcctggccaaggggacaccttcccaaggctcccccgtggtttccccacaaccgtgttccgggcctgtgttccctaagcgctcaccttaaaaaacaaaacggttggttgtttcttctttgggggccacccccctggggaccaaatccataaaaaaggggcctcctccattctttcgccgttttgtgggga

SEQ ID NO: 57771 - protein, 104 aa, Zea mays
  misc_feature: Ceres CLONE 1507447
MNRVSLVGILAFLLNCREKFRALSLVKCMGIKDICSAPAQLPLCRSLRFLTIKDCPGFTDASLAAVGMICPQLEQVDLSGLGEATDNALPSIDSSLLNLGLVQV

SEQ ID NO: 57772 - DNA, 679 bp, Zea mays
  misc_feature: Ceres CLONE 1507449
  misc_feature (310)..(310): n is a, c, t, g, unknown, or other
cgattgggtccgggccccccctcgagccactgcattggtaaaggcgggctccggcttcttctcctcgccgtcgcgtgagactgcgctaaaacctaggctttgagacaccaatggcctccgcgacggcgacggcgcccacattcgctctcgcatcgtccttctcgcgcggcggcttccttccgctccctcgtcacgccggccggcccatgcttcagtctctgcgactcgtcgcgtcagccgtgaagcggcggcgcggcgcggtcgtggtggcagcgaacgcggcggcggcggccggggaagcgcgaattcngcgacgaagagaacctgtatgagcttctgggcatcaggccgcttgatagcttcgatcacattgaaatggcctacaagaagaagcgcaagacccccgagaaaactggaaaccaccaggttcttgcccagttggaacaggccctatgaccctgtcctggatcaccccctgccttttccggaaaagggagtcccttcccgggctgttccagggggcccaaggaattcaaggttggtaaaacaccacccccgggggggctttggggacccaaaattttccccctataaccaaggaaagaaaggccccaaaaaattggggggattcccccacccttttttgggtttggggaaacctttttggggggcagcggca

SEQ ID NO: 57773 - DNA, 673 bp, Zea mays
  misc_feature: Ceres CLONE 1507451
  misc_feature: Translation starting site: 323
  misc_feature: SWISSPROT Homolog: EC 3.1.27.1 Ribonuclease T(2)
  misc_feature (503)..(503): n is a, c, t, g, unknown, or other
  misc_feature (578)..(578): n is a, c, t, g, unknown, or other
cgattgggtaccgggcccccccctcgagccactgcagtggtaaaggggagttgttggttgcagggaaaccgccaattggcaaggatgaagcttgtgaccgccttcgttgtgctgctcttttctctcctccccgactcgtccaccgcggaggacttcgatttcttctaccttgtccaacaggtgctgcggcatgtcgtcgtgaccggagcggagatcgaccgagaccgatcggccagcttctcctctgaccaatttaacccagcgacgacgtacgaatctaatgtaactctaacggtgtgttctgttccctgtcgatcgattcatgcatgcagtggccgggctcgttctgcgacacgcggcagggttgctgcttccgggacggcgcgggcagtcggaggcggcgtttcgcatccacgggctgtggccccactacgccaagtgccgcggccgcccaccacgcgagggcggcggcctcgcccgcgcggtgctcggcgccgacgacngcttcccctcgcgcgtcgggcggcggggcaagtgctgggccgaatactgcggcggcggcggcaacggcgacggcngccaccagctgaccccctgggacgtccgggacctggtggcgtccctgggccgaacctggccaaccctgtcttgcaagaacggcccaactttcaag

SEQ ID NO: 57774 - DNA, 717 bp, Zea mays
  misc_feature: Ceres CLONE 1507457
  misc_feature: Encodes the peptide sequence at SEQ ID NO. 57775
  misc_feature (1)..(1): n is a, c, t, g, unknown, or other
  misc_feature (717)..(717): n is a, c, t, g, unknown, or other
ncgattgggtaccgggccccccctcgagcactgcagtggtaaaggggtcgcaacaaccccgacgagcaaacccacccatttgccaccaaccccgacgagcggcgatgaccggcacggtgtccaagctggcggcgcctcgtccggcagcaccgccgctccggccggcgtccctccgcactgccgccctcgccttcgccccctccccgcgccgggtccgcgtctccgtcgccgggcgagccaggagccccatcattgcgatggcttcggccaaggaaggaaatggtgcaccgaccaagaggactgcgcttcatgatctttacgagctccagggcctgtccccgtggtacgacaacctatgccgccctgtcacagacttgcttgccattatcgccagcgggggtccgtgcagtcaccagcaacccaacgaattttccaaaggctcttttcatccgcccccgcatatggatgatcagttcaaccagcttcattttcggtggaaaaggacccggaaaaagcgctttatggaaaaactctttataaagggatatccaaagagggcgggcaaatttttttgaaccccccttaccaaaaaaaaactggatgggcgttaaatgggtattttctccccggaagagggcgtcctcctaagggtgggggaaaatgaaacctctaagggaatattttttaaaaacccgggaaaaaggggttatacaaccn

SEQ ID NO: 57775 - protein, 156 aa, Zea mays
  misc_feature: Ceres CLONE 1507457
MTGTVSKLAAPRPAAPPLRPASLRTAALAFAPSPRRVRVSVAGRARSPIIAMASAKEGNGAPTKRTALHDLYELQGLSPWYDNLCRPVTDLLAIIASGGPCSHQQPNEFSKGSFHPPPHMDDQFNQLHFRWKRTRKKRFMEKLFIKGYPKRAGKFF

SEQ ID NO: 57776 - DNA, 689 bp, Zea mays
  misc_feature: Ceres CLONE 1507458
  misc_feature: Encodes the peptide sequence at SEQ ID NO. 57777
  misc_feature (1)..(1): n is a, c, t, g, unknown, or other
  misc_feature (387)..(387): n is a, c, t, g, unknown, or other
  misc_feature (590)..(590): n is a, c, t, g, unknown, or other
ncgaatgggtaccgggccccccctcgagccctgcagtggtaaaggtcagggcctctcgatcgctcatcagtcgccagaggagtagttgatcgaggtgagtgaggttgaaaagcaggcggcgaacaaaggcaccatcgtcatggacggcggatactacggcggccgcgatcagcgctacagcggcgggtactacggcggcggtggcatcgcgacgcccgggtacgctcccggcgtcccgtacgggatgtcgcaggtgaacatcgagggcaacgggtgcgggcgggcgctgccgccgcagccgacccgtgaggtgtactgccgcgccaaccccactacgccatgagcgtccgcgacggggaggtggtgctggcgccggcaaacccccangacgagtaccagcactggatcaaggacatgcggtggagcacgagcatccaggacgaggaaggttacccggcgttcccgctggtgaacaggcgacgggggagccatcaagcactcgctggggcagtcccaccccgtgcggctgttgccctacaacccgggactttttggacaattcggtgctgttgaacgaaaaccccccaacntccgaaaacggttccccgctgccgcccgcattggtcaaaaaacatcttactttcaactttccaccccccttccaaggggaaacaaattgggccccggcg

SEQ ID NO: 57777 - protein, 67 aa, Zea mays
  misc_feature: Ceres CLONE 1507458
MDGGYYGGRDQRYSGGYYGGGGIATPGYAPGVPYGMSQVNIEGNGCGRALPPQPTREVYCRANPTTP

SEQ ID NO: 57778 - DNA, 670 bp, Zea mays
  misc_feature: Ceres CLONE 1507460
  misc_feature (200)..(200): n is a, c, t, g, unknown, or other
  misc_feature (365)..(365): n is a, c, t, g, unknown, or other
  misc_feature (422)..(422): n is a, c, t, g, unknown, or other
cgattgggtaccgggccccccctcgagccctgcagtggtaaaggatgttgccgaattggaaaggcaggcgtggttgaccctggcacaggaggagggcaagtcgctgcctccctcttttgtgttgcggagagtcgaagggatgaagaacgagcaggcgatttctgaggttctctgctggtctcgggatccctccgagcttnagagttttatcacagtattgcgagtcatggagtagagatgatgctcaaaggcagtacattgtagaacttggtataccagaagaatggatgcatgaagctctggctctttatcacgaatactatggagataaacagggcgcactggagaatttgattcagtgtggncactggaagaaactcatactattttcgtgacttctgttgctcattctatgtttctgncatcaaccatcaggaggtctggaggatcacaagtgccttggagaacccacagtatgaaattgctgactgggacctttggtgccgaatatacatagacttctacgttctgaagaactcaatgcaagaaaaaaatgccgtggatgatttcggtttccctcgaggagatgagtgaatccggcaaaagtttcctttgcccattaaacaagtcctttgttagtctggggaaacaaattcccctgttgagtcag

SEQ ID NO: 57779 - DNA, 649 bp, Zea mays
  misc_feature: Ceres CLONE 1508837
  misc_feature: Encodes the peptide sequence at SEQ ID NO. 57780
cgattgggtccgggcccccctcgagccctgcagtggtaaagggcgtgccgtccttggcggcggcggtgctggcggcgctcctggcggcggcctcgatgccgtcgccgccccgcgtggcggccgcgctgtcgccggactactacagggacagctgcccgggcctggagtcgatcgtgcggtacgaggtggcgaggaagaagaacgagacggtggtcaccatcccggcgacgctccgcctcgtcttccacgactgcatggtcgggggctgcgacgccgccgtcctgatcgcgtccaagaacaacgacgccgagaaggacgcgccggacaacgagtcgctcgccggcgacggcttcgacaccatcaaccgggtcaaggcggccgtcgagaagaggtgccccggcgtggtgtcctgcgccgacatcatcgcgctcgccgccagagacgtcgtctacctggcggatggcccctactggcgcgtcgagctcggccgtctggacggactcgattccagggccagcgacgtcaaggggaagctgccggacccggacatgcacgtcaaggacctcacgccggtgttccagcggaacggcttcacggaggtggacatggtcgcgctctccggggcgcacaccgtcggcttcgcgcactg

SEQ ID NO: 57780 - protein, 215 aa, Zea mays
  misc_feature: Ceres CLONE 1508837
  misc_feature (58)..(215): Pfam Name: peroxidase Pfam Description: Peroxidase
  misc_feature: SWISSPROT Homolog: EC 1.11.1.7 Peroxidase
IGSGPPSSPAVVKGVPSLAAAVLAALLAAASMPSPPRVAAALSPDYYRDSCPGLESIVRYEVARKKNETVVTIPATLRLVFHDCMVGGCDAAVLIASKNNDAEKDAPDNESLAGDGFDTINRVKAAVEKRCPGVVSCADIIALAARDVVYLADGPYWRVELGRLDGLDSRASDVKGKLPDPDMHVKDLTPVFQRNGFTEVDMVALSGAHTVGFAH

SEQ ID NO: 57781 - DNA, 636 bp, Zea mays
  misc_feature: Ceres CLONE 1508844
  misc_feature: Encodes the peptide sequence at SEQ ID NO. 57782
cgattgggtccgggccccccctcgagccctgcagtggtaaaggcgtgacggtgttctagtggttcgggaacgggcagttctggatgacggccagctgctccgcgtacctggccgcggtgtgccaggtgctggtgaaggtggtgttcaggcgggacatctcgttcaagctgacgtctaatcagcccgcgggggacgagaagaaggacccctacgcagacctgtacgtggtgcgctggacctggctcatggtgacgcccatcatcatcatcctcgtcaacatcatcggctccgccgtggccttctccaaggtgctggacggcgagtggacgcactggctcaaggtggccggcggcgtcttcttcaacttctgggtgctcttccacctctaccctttcgccaagggcatcctggggaggcacggcaagacccccgtggtggtgctcgtctggtcgggccttcaccttcatcatcaccgccgtgctgtacatcaacatcccacacatccacaggcccggcggcaagcaccgcagcgccatcagaaggcacggcggcgactcacaccaccatggtaagaagttcgacggctactacctctggccgtgaagcgccgagcagccagcatcgtcatgcatgcac

SEQ ID NO: 57782 - protein, 162 aa, Zea mays
  misc_feature: Ceres CLONE 1508844
  misc_feature: SWISSPROT Homolog: EC 2.4.1.12 Cellulose synthase (UDP-forming)
  misc_feature: Functional homolog of the protein sequence given in SEQ ID NO 96882
  misc_feature: Useful for making plants with modulated plant growth and development
MTASCSAYLAAVCQVLVKVVFRRDISFKLTSNQPAGDEKKDPYADLYVVRWTWLMVTPIIIILVNIIGSAVAFSKVLDGEWTHWLKVAGGVFFNFWVLFHLYPFAKGILGRHGKTPVVVLVWSGLHLHHHRRAVHQHPTHPQARRQAPQRHQKARRRLTPPW

SEQ ID NO: 57783 - DNA, 820 bp, Zea mays
  misc_feature: Ceres CLONE 1508849
  misc_feature (9)..(9): n is a, c, t, g, unknown, or other
  misc_feature (44)..(44): n is a, c, t, g, unknown, or other
  misc_feature (53)..(53): n is a, c, t, g, unknown, or other
  misc_feature (55)..(55): n is a, c, t, g, unknown, or other
cccccaaanaaccccaacccccaaaccccgccaccaacagcacnccacagacnancacgattgggtacgggccccccctcgagccctgcagtggtaaaggagagagtcgaacaatcgtcggatcgacgcccctcttcctgacgccgcacgccttcactgtcctcggcagccgatcttccagagcggttcgacaccgtgctcgccacggtcgacatcactgccgccgccgccggaaagttggaatcggtgacgacctctctctccccgtttccttccacccaggaggcaacatgtcgtccctcgccgctgctagagcggataacttctactatccgccgcaatggagccccaggaagggtgggatgcaaaaagctcccatggccccacaacgcccccccaatggcaccccagcttccgtaaccctccaccaggggccctcctggccccccaaaggccccgaaaaagacctccctaaacacccccgttatggcgggaacccttcttcattagcggggccaccgcccggcgcgcgccaaattacccgtgtccccgacaccaaacccccgttcgccccccgataatcccccccatacaaacaaaaaatagggcccccccccccccccccctaaaaatccccactacatccgcaacccgcgaccgaaacacggggggcgggcaaagagcccgcgcggcgccccagataggagaacaaagccgctggaggcatgctaaaatcggcgggatggggcggccgccttctaacgcgggagggacagaacccgcgcgcgtatttgttgagttcgttctccgcagggccgcg

SEQ ID NO: 57784 - DNA, 679 bp, Zea mays
  misc_feature: Ceres CLONE 1508851
  misc_feature: Encodes the peptide sequence at SEQ ID NO. 57785
  misc_feature (475)..(475): n is a, c, t, g, unknown, or other
cgattgggtaccgggcttgctgtcgagccactgcagggtaaagggtgctcacacagtcactccgtttagctcaaatccttatcggcgactcggcgtcggaggctcggagcccacgaccacgaccgcttccacgccctcgaccccgaacccccaatcccggacgcgaccgctgaaccctagcatactccggccatctgccgccggccccggcgatcccccgccatggcctcccccgagggcacaacgtgggtcttcgactgtccccttatggacgacctcgcggtcgccgccgacttcgcggcagcccccgcgggaggatttttctgggcagcgccgccgtcgctgcagccgcatgcgccagcgcagtctgtccttgcctcgtcggctcccaacccatgtatggaaatgagtggggcccccgcctgtgttcggggaaaacgaccgccaacaaattaacgtccaaggtcggaaaagncttacagaatcgggcgcaaaatctttcagggagaagaatagaagggaacagcctgaaccaaacaacccagggaatttagacgccaaattggatacccctgcacaaccccctgcttttgataccacacagcttatccagaagccgaagctttttccccgccattaggggaaccccgcccaaggaaaaacaaaccaagcaccactc

SEQ ID NO: 57785 - protein, 77 aa, Zea mays
  misc_feature: Ceres CLONE 1508851
MASPEGTTWVFDCPLMDDLAVAADFAAAPAGGFFWAAPPSLQPHAPAQSVLASSAPNPCMEMSGAPACVRGKRPPTN

SEQ ID NO: 57786 - DNA, 651 bp, Zea mays
  misc_feature: Ceres CLONE 1508867
  misc_feature: Encodes the peptide sequence at SEQ ID NO. 57787
cgattgggtaccgggccccccctcgagccactgcagtggtaaaggtgtgggtcttctctgctcacatgccgggaggtgctccaagaacaagtgttctccaccggatccaggactcggcatggtcgtgatcagaggacaagggcggcgccatacaccgctaatgctggctgcgctcctgttcctgggcacctggccggccgtactcaccctgctggagcaccggggccggctgccacatgcacacgtacctagactactccatcaccaacctcctcgcggacgagctcatcgcgctcaccttccgtcagcatcggggacaggatgcgcgacatgcccaacttcttcatgcagctctgccaacacaactggccctccgtgctgttcgccatggcgagaggcgtcgagttcactgtccgcaaactctccactcaggacgcttgggcctatgtggagcctctccgacaatgacgtcatcatctccagcatggaggtggtcataagcaccacgctgaactacttcctggactaccacatcaacagggtacatattctgttccctggtgcggcttgcttcctattatccgacatccgtggctccactgtccattactccaatgcagctgacaatgagcagaaactcggtgcctccac

SEQ ID NO: 57787 - protein, 68 aa, Zea mays
  misc_feature: Ceres CLONE 1508867
MWSLSDNDVIISSMEVVISTTLNYFLDYHINRVHILFPGAACFLLSDIRGSTVHYSNAADNEQKLGAS

SEQ ID NO: 57788 - DNA, 642 bp, Zea mays
  misc_feature: Ceres CLONE 1508871
  misc_feature: Encodes the peptide sequence at SEQ ID NO. 57789
cgattgggtccgggccccccctcgagccactgcagtggtaaagggaaggtcccgtgcctaataacttggcgggagaaaggcgaaacccacgtgctccccggcggagtgggactgcggcttgtagcgagagcggacgggagtggcgcacgtaacaggaaggtggtgctgcgcgggtacatctaccgcgcgcccagggaggaagacatggtagctcgtcgacggcggcgccgtgcagctgcgcgtccccgagggcggcggctgacccaccgcgctggtgaagaacctctacctatcctgcgacccttacatgcgcgacaggatgcgggacttccgcaactcctacatcccgcccttcaaacatggatcacctattgaagggtttggcgtggggagggtggtcgagttcagtcatgtaggattcaccgctggtgacgttggttcctggatgactgtctgggacgactacggtatgatctccaagcctgaggaggtcatgaagatcccgctaagctacgtactgctctactatcatgtgggccttcatggtctgcctggttttgcggcttatgtcggattctatgacatctgtgcaccagagaaaggagagtttgatgctgttgctgctgcatcgagacccgttgg

SEQ ID NO: 57789 - protein, 111 aa, Zea mays
  misc_feature: Ceres CLONE 1508871
MRDRMRDFRNSYIPPFKHGSPIEGFGVGRVVEFSHVGFTAGDVGSWMTVWDDYGMISKPEEVMKIPLSYVLLYYHVGLHGLPGFAAYVGFYDICAPEKGEFDAVAAASRPV

SEQ ID NO: 57790 - DNA, 811 bp, Zea mays
  misc_feature: Ceres CLONE 1508872
  misc_feature: Translation starting site: 195
  misc_feature (12)..(12): n is a, c, t, g, unknown, or other
  misc_feature (13)..(13): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
gctctgtgtatnnccccaaacccatccatcccccctaatatattttnnnntnnnnccgaattgggtaccgggccccccctcgagccactgcagtggtaaaggcgtcagggcctcttgatcatcagtcgccagaggagctgttgatcgaggtgagtgaggttgaaaagcaggcggcgaacaaaggcaccatcgtcatggacggcggatactacggcggccgcgatcagcgctacagcggcgggtactacggcggcggtggcatcgcgacgccggggtacgctccggcggtcccgtacgggatgtcgcaggtgaacatcgagggcaacgggtgcgggcgggcgctgccgccgcagccgaccgtgaaggtgtactgccgcgccaaccccaactactccatgagcgtccgcgacgggaaagtggtgctggcctctggcgaaaccccaggaccacgtcccccactgtgcccaaggaaaatgaaaccccatcaccccccctcaaggacgtaggaaagttacccgggcccttcccgctgcgtgacccccggtttacccggggaagcgccatctaaacccctcgtcctgggcccagttccccccccggttggccccctggtagcccctacccacccccgcattttcctcgcaaaaaatctccagtgcctctcgaaacccggagagccctcataacccgccggccaaacgggcttcccccaatagggtcctaccaatgggttatacccaatctacccccacttcaaacacccccgacagactcccccccccttgttgtaatccagtgggtctactccgcc

SEQ ID NO: 57791 - DNA, 656 bp, Zea mays
  misc_feature: Ceres CLONE 1508875
  misc_feature: Encodes the peptide sequence at SEQ ID NO. 57792
  misc_feature (18)..(18): n is a, c, t, g, unknown, or other
  misc_feature (22)..(22): n is a, c, t, g, unknown, or other
  misc_feature (392)..(392): n is a, c, t, g, unknown, or other
  misc_feature (393)..(393): n is a, c, t, g, unknown, or other
  misc_feature (395)..(395): n is a, c, t, g, unknown, or other
  misc_feature (398)..(398): n is a, c, t, g, unknown, or other
  misc_feature (399)..(399): n is a, c, t, g, unknown, or other
  misc_feature (403)..(403): n is a, c, t, g, unknown, or other
  misc_feature (406)..(406): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (465)..(465): n is a, c, t, g, unknown, or other
  misc_feature (524)..(524): n is a, c, t, g, unknown, or other
tcgattgggtaccgggcntctntcgagccactgcagtggtaaagggtatttgctttgcttcctcttctccccctcctccgcgcccggctcctctcccctaaggattagggttagccaggcagcgacctccctcgggaatcctccgtagccgccatggtcacggcggttctcagatcccacgatgcgctcaacaaccgcctgcatctcgacgcgtacaccccggccccggcgaagccgcgccggcgccgtatccccaagccggcggacgcgtacttcacgcccacaagggccgcggcgcgcatagcctcgacgtcgtcgcctaatcctgctgccggcgcagaagaggcgacgcacgttatttttcctcccccctctggagacgaaaggggggnncntannccanctncttcnnnncccacccacttttccccattacgggagatcccaaggggggggcttgcctgnacgaagtccggacctttgaagtgggccgaggaaccgccggctccccgttccccacccancccctaatggcggggatagggccggccccgcccgggcccaagaacgtcggtgggtggacccacaacttccacttttatttattggggccggacgcgagtaacggatccacggcccgtggtgggcgattaagg

SEQ ID NO: 57792 - protein, 42 aa, Zea mays
  misc_feature: Ceres CLONE 1508875
MAGIGPAPPGPKNVGGWTHNFHFYLLGPDASNGSTARGGRLR

SEQ ID NO: 57793 - DNA, 617 bp, Zea mays
  misc_feature: Ceres CLONE 1508893
ctgtcctagtggatcccccgggctgcaggaattcgcacgagaccattacctagaacatcctaatcgaaaagaaagcaaaaaccaaccaaacaagctagctagagctagccaagccgcggcgtgcctccgctccggccggcccgcccctgtcagagcccccaccgccgctgccacctccgccagccgtcaccccaggcgttggatcggggccctctcgatccgcgcccggcgaatccagacggacccgcattggggttggggccccttcgatccggcgcttggtgggggtttggctgggagctccaggctgaggggacggggcggggggacctgatccttcattccgttcggatttcgcttttcccccgtggggtctcgactgccggagggggaggaggacatggattaggcgtcggtcagcgaggagctggccgagatcgacgggcagatcggcgatatcctccgcgtattgcaaaatgggttccagaagctggagaagatcaaggatgccaaccgccgcaacaggcagcttgaaaagcttactgataagatgcaagactgcaagagactcgtcaaagacttcgaactaatttagcaaagctgaggctggaggttac

SEQ ID NO: 57794 - DNA, 619 bp, Zea mays
  misc_feature: Ceres CLONE 1508899
  misc_feature: Translation starting site: 193
  misc_feature (212)..(212): n is a, c, t, g, unknown, or other
  misc_feature (215)..(215): n is a, c, t, g, unknown, or other
  misc_feature (226)..(226): n is a, c, t, g, unknown, or other
  misc_feature (227)..(227): n is a, c, t, g, unknown, or other
  misc_feature (232)..(232): n is a, c, t, g, unknown, or other
  misc_feature (233)..(233): n is a, c, t, g, unknown, or other
  misc_feature (247)..(247): n is a, c, t, g, unknown, or other
  misc_feature (253)..(253): n is a, c, t, g, unknown, or other
  misc_feature (374)..(374): n is a, c, t, g, unknown, or other
  misc_feature (392)..(392): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (435)..(435): n is a, c, t, g, unknown, or other
  misc_feature (436)..(436): n is a, c, t, g, unknown, or other
  misc_feature (449)..(449): n is a, c, t, g, unknown, or other
  misc_feature (452)..(452): n is a, c, t, g, unknown, or other
  misc_feature (453)..(453): n is a, c, t, g, unknown, or other
  misc_feature (462)..(462): n is a, c, t, g, unknown, or other
  misc_feature (463)..(463): n is a, c, t, g, unknown, or other
  misc_feature (464)..(464): n is a, c, t, g, unknown, or other
  misc_feature (465)..(465): n is a, c, t, g, unknown, or other
  misc_feature (466)..(466): n is a, c, t, g, unknown, or other
  misc_feature (468)..(468): n is a, c, t, g, unknown, or other
  misc_feature (469)..(469): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (479)..(479): n is a, c, t, g, unknown, or other
  misc_feature (482)..(482): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (511)..(511): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (517)..(517): n is a, c, t, g, unknown, or other
  misc_feature (518)..(518): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (535)..(535): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (563)..(563): n is a, c, t, g, unknown, or other
  misc_feature (564)..(564): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (572)..(572): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (608)..(608): n is a, c, t, g, unknown, or other
  misc_feature (616)..(616): n is a, c, t, g, unknown, or other
cataactggagctccccgcggtggcggccgctctagaactagtggatcccccgggctgcaggaattcgcacgagaccattacctagaacatcctaatcgaaaaattccccgccgcctcgcgcccccgctcgcttcacttctctaggtgcgcaccgatcagaaggtgcctgcctcctcctcgtcggcgaaaagatggcggtgccgctgctgancgnaagaaaagatnncgtgnnaagaatagcgggtncaaagncagttccaaaggagggcccccacctcgaccgctacaagtgccttaagccaagctggcgcaagccaaggtattgattcccctgcccgggagaaattcaagggatggccccttgggccccaanaaattttgggttatgggnnnnnnntttnnnnnnttgaaaaaggcccaccccgggctccctnntttccctcccccncannaaaaaaagnnnnntnnnnnggtaatnttnttacaaaaaaaaacnnnaaaaaataattntnnntnntcnnnnnannntttttnttttattttttttnnntgttggtgggtnntgcnnncncccccaccaccaaaaaaaccccnnnnnnnnnnnntntttgtttnttg

SEQ ID NO: 57795 - DNA, 642 bp, Zea mays
  misc_feature: Ceres CLONE 1508906
  misc_feature: Translation starting site: 202
  misc_feature (173)..(173): n is a, c, t, g, unknown, or other
atagctggagctccccgcggtggcggccgctctagaactagtggatcccccgggctgcaggaattcgcacgagaccattacctagaacatcctaatcgaaaaattcggtcattccacttccaccaatctgtctcccaatctttcttgctgctccaattcgctctctttactcnggccagcggaaggggagaggagggcgagatgacggtggagaaggtggacgcggggctttccgacttcgacgcccacttcgatcgcctcttcgcttccccggacgccgcctccgacggcaaggtgaagctgctgctcttcctggccgaccgcaagcctggctcctccctctcctggtgccccgactgcaacgtggcggagccggtgatctacgagcggctggaggcactggagggcaaggacgcggtgctcctgcgcgcctacgtcggggaacagcccacttggcgcgacccggcgcacccgtggagggtgggaccccaggtcgggctcaagggcgtgccaacgctgatcgcctgggaggattgcgccgccgcccgcccgcctcggggacgaccaagcgcaacctcagggacaaaggtgaacgcccttctttggggctggggggaacttgataccgacagaattggggtc

SEQ ID NO: 57796 - DNA, 630 bp, Zea mays
  misc_feature: Ceres CLONE 1508909
  misc_feature: Encodes the peptide sequence at SEQ ID NO. 57797
catagctggagctccccgcggtggcggccgctctagaactagtggatcccccgggctgcaggaattcgcacgagaccattacctagaacatcctaatcgaaaaagcttggtcggttcgtttaccaccaaagcgccccgcaaaatctcgccgccgaccgccatggcagccgccgacgagacgcgtccgctgctcgttgctatatctctcgccgtagccgcctgctgcctcgcgcagctggcggtgggggacacgaacggcgtctacgagccgtgcagtgacgcacggatccagcgcggggacggcttcaccttcggggtggtcttcgccggatacaacgccttcttctccggcaacacacagctctccccctgcgaccgccgcctcaacctcgctgcctccgggcagctcgccgtcttccgccccaggtcgacgagatctccctcctcaccatcacaccactaccggattcaaccagcttcagctggtggattatggtagcatttgccggcaggaagtatgcagctagatctattccgatttttgtatccacacttcaatcccagggtcagcttcacccgggaactggaggtcacaaaggcgaacccaaaactggactggaaaaaggccgg

SEQ ID NO: 57797 - protein, 112 aa, Zea mays
  misc_feature: Ceres CLONE 1508909
MAAADETRPLLVAISLAVAACCLAQLAVGDTNGVYEPCSDARIQRGDGFTFGVVFAGYNAFFSGNTQLSPCDRRLNLAASGQLAVFRPRSTRSPSSPSHHYRIQPASAGGLW

SEQ ID NO: 57798 - DNA, 459 bp, Zea mays
  misc_feature: Ceres CLONE 1508918
  misc_feature (44)..(44): n is a, c, t, g, unknown, or other
  misc_feature (46)..(46): n is a, c, t, g, unknown, or other
  misc_feature (55)..(55): n is a, c, t, g, unknown, or other
  misc_feature (69)..(69): n is a, c, t, g, unknown, or other
  misc_feature (79)..(79): n is a, c, t, g, unknown, or other
  misc_feature (85)..(85): n is a, c, t, g, unknown, or other
  misc_feature (86)..(86): n is a, c, t, g, unknown, or other
  misc_feature (330)..(330): n is a, c, t, g, unknown, or other
agtgagctccggtggggcgtctgaatggaccccggtgaggttcnanagacttccnaactccaacgaacntccggcggcngggggnngttccaaagctggactccccgcgggtggcggccgctctagaactagtgggatcccccgggctgcaggaattcgcacgagaccattacctagaacatcctaatcgaaaactttatcagtagtagtcatcactgagtagactgcagagcaggaggagatgttcacttacgtgctcgcggccgccgccgtgcttatcgtgttcctctacgccgtcgaagcagcaacagcaaggctcccttccgtcgncccccgtcgctgccgctgatcggccacctcccacgccgtgggtcacttcgcggcggccacagggggccgccggggcaacaaccaggatgtgcctgccgaacccggccccttaaggggggggcttccaac

SEQ ID NO: 57799 - DNA, 626 bp, Zea mays
  misc_feature: Ceres CLONE 1508919
  misc_feature: Encodes the peptide sequence at SEQ ID NO. 57800
atagctggagctccccgcggtggcggccgctctagaactagtggatcccccgggctgcaggaattcgcacgagaccattacctagaacatcctaatcgaaaacgacgtactacgaggacatgcagcgggccatcttctgcctgtgcccgctggggtgggcgccgtggagcccgcggctggtggaggcggtggtgttcgggtgcatcccggtgatcatcgccgacgacatcgtgctgcccttcgcggacgccataccctgggagcagatcagcgtgttcgtggccgaggcggacgtgccgcggctcgactccatcctggcgtcggtggcgcccgaggacgtgctccggaagcagcgcctgctggccagcccggccatgaagcaggccgtgctcttccaccagccggccaggcccggcgacgccttcgaccaggtgctcaacgggctcgcccgcaagctgccgcaccgagagggcgcgtttctgaagcccggccagaaggtgctcgactggaacgccggcctcgacagcgacctcaagccgtggtagcgtgtgtagaagatcgtcggagcgctttgcatagtctcgtcgtgtacatttttgttcttcagagttcagaagacctcacgt

SEQ ID NO: 57800 - protein, 141 aa, Zea mays
  misc_feature: Ceres CLONE 1508919
  misc_feature: SWISSPROT Homolog: EC 2.4.1.223 Glucuronyl-galactosyl-proteoglycan 4-alpha-N-acetylglucosaminyltransferase
MQRAIFCLCPLGWAPWSPRLVEAVVFGCIPVIIADDIVLPFADAIPWEQISVFVAEADVPRLDSILASVAPEDVLRKQRLLASPAMKQAVLFHQPARPGDAFDQVLNGLARKLPHREGAFLKPGQKVLDWNAGLDSDLKPW

SEQ ID NO: 57801 - DNA, 692 bp, Zea mays
  misc_feature: Ceres CLONE 1508944
  misc_feature (692)..(692): n is a, c, t, g, unknown, or other
acagctggagctccccgcggtggcggccgctctagaactagtggatcccccgggctgcaggaattcgcacgagaccattacctagaacatcctaatcgataactagctcatttctgttctcctccccagccgccagaatagtatccagccgccaggaagcatggccgacggcgcccttctcatcctttctctgtttctgttcttgcactgccaggccgtgccctttcccactggtgatggcgagtagctcaactggcccttaccgccaacgagtgcgtccccatgtgagggtgcgcggtcgtcggtcggtggccggtgagagctcggctagcccaaaaaaaaacaaaaatatgtcggccatcgccttttgaaccttgcccgacgaccaaaaccggccgcctctcctctctgttcatgctctttctaatctctgtttctaagttccagaccgctcacccaagaaccggtcgccacgagcttgggccgaccgaactatccttttctccctgctccttttggccgttcgcccccttctccttctttgtttctggtttttttatttcttttcaagcatccaagccgctagggtactcccctcaaatttccggtttttttttatttccctggtccctggaacccgggggattatttcccctcggcctttggcccggggcagggttcttttttccttn

SEQ ID NO: 57802 - DNA, 607 bp, Zea mays
  misc_feature: Ceres CLONE 1508956
  misc_feature: Encodes the peptide sequence at SEQ ID NO. 57803
  misc_feature (571)..(571): n is a, c, t, g, unknown, or other
  misc_feature (592)..(592): n is a, c, t, g, unknown, or other
aaagctggagctccccgcggtggcggccgctctagaactagtggatcccccgggctgcaggattcgcacgagaccattacctagaacatcctaatcgaaaatagcttcctagtccgtgtagtggaggtagtggaggtagccatcatcagaatccagaaaggagcaccgtgtgtgcgtgatgtggccggagaagatgtacgcgtgggcgtccatggcagaagacccgcttaaggcgcgcgggggggtgggatttggggctttccttttgaaggcccttttggggggtttaaaccccaaaaacattggggggggggggggcccctcccctttggtggggcgccccccccttatttttttttgggggaaaaaaaaaaaaaaggggggcccaaaaaggggggggcccgttttttaaaaaaaaaaaaccgggggggagccaccaataattttttttccccccgggggggtgccacaaaaaaaaaaaaatttctttttctttctcttggggggggggggtttttttttttttctccaagagaaaaaaaaacacacccccccccccgcgtttcccggntttaatatctgttttctctanaacgtgaaaaaatag

SEQ ID NO: 57803 - protein, 30 aa, Zea mays
  misc_feature: Ceres CLONE 1508956
KLELPAVAAALELVDPPGCRIRTRPLPRTS

SEQ ID NO: 57804 - DNA, 669 bp, Zea mays
  misc_feature: Ceres CLONE 1508959
  misc_feature: Encodes the peptide sequence at SEQ ID NO. 57805
  misc_feature (663)..(663): n is a, c, t, g, unknown, or other
ctggagctccccgcggtggcggccgctctagaactagtggatcccccgggctgcaggaattcgcacgagaccattacctagaacatcctaatcgaaaaaacaggagcccagtcaatgagcttagcacttctcgagggctactcctccgccgaggaggaggacggccccgccgccggcgccggcgccgagctaagcgagtccgctgattcgtcagccgaggaagccggatcggacggcgacgaggggtccgctcctccgaagtcggccttcaagccccgccgccgaccaaaccgtaagaagggagatgccggcggcggcgacggggactcctgtctgccctccgctctggaggccttctccgatatctcgggaccaccggagttcttgaggcacagggttgcggagcctgaggaagggacggaggccctcggtgtactcgatcgccgtgggaaagaggggagcaagctgccgcctccaggagctgttgtggtggcaaaaccgcagttggttaccacaattggagccaaccctccaggttcagtgacatctggttctgttgatggaaaaagaataataggtgccgcaaatcctggtccagaagatgcagctgatcttctgaggatgtgtctccaatgtggtgtaccaaagacctactcacatggncagggt

SEQ ID NO: 57805 - protein, 185 aa, Zea mays
  misc_feature: Ceres CLONE 1508959
MSLALLEGYSSAEEEDGPAAGAGAELSESADSSAEEAGSDGDEGSAPPKSAFKPRRRPNRKKGDAGGGDGDSCLPSALEAFSDISGPPEFLRHRVAEPEEGTEALGVLDRRGKEGSKLPPPGAVVVAKPQLVTTIGANPPGSVTSGSVDGKRIIGAANPGPEDAADLLRMCLQCGVPKTYSHGQG

SEQ ID NO: 57806 - DNA, 883 bp, Zea mays
  misc_feature: Ceres CLONE 1508962
  misc_feature (34)..(34): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
actgccatattatccaatggaagaaggcccatanttcataannnnnnacgcaagcgggtaccccccgcgggggcgctctaacctagtggatcccccgggctgcaggaattcgcacgagaccattacctagaacatcctaatcgagaagttccttccgtccatccatccgccatggcgaccgctacgctactgagctcctctttctccatgcccgccgccgccccgtaggcctaatacccctcccccgcctgcttgagcttcgccacgttatagtacggcccgcttctttttatgcgtggtggatggaacctccccccgctattcccccttccctcataaaaacccccccctataataaaatgttctcgggggcagggagtgatatagccccccccccccccctaaccccctcaaacccactataatatatttcttaccgccctgggggggggggggggaaaaaccccccccattattttttatatacaaatgtgaaaacgacccccatggtggtgcccccgcgccgccccaatattcccccccggtgaaacgactaccctcatccctatatacgggattccgctcgcccgaattattgcctctggccgccgaacgggcgcggtcccgatgaaaaaccgccccccattacccctcaccaaccctacgctcctatatgaccccatcggggccgaatcctccaacccccactgtccccctcccgaccagtttttttatatagcccccccgccccgccccatgatcccgcccaagacgccgcgtattagcttgtccggcatcagtcgtgcgagagattaaccgcccccccccgcacccgccccgataacaacgcatcgaacgtcgccccgtgcgtaagttctagagg

SEQ ID NO: 57807 - DNA, 626 bp, Zea mays
  misc_feature: Ceres CLONE 1508969
  misc_feature: Encodes the peptide sequence at SEQ ID NO. 57808
aaagctggagctccccgcggtggcggccgctctagaactagtggatcccccgggctgcaggaattcgcacgagaccattacctagaacatcctaatcgaaaattgtgctttcttgccagtaacccatccacccatccatcggggatcaccaggggtcaggggagcaagatgtcgactgccaccgccccaagattgcccgctcccagatccggggcaagctatcactatcagacgaccgcggctccggcggccaacaccctctccttcgccggccacgcgaggcaggcggcccgcgcgtccgggccacggctgtccagcaggttcgtggcgtccgcggcggccgtgctgcacaaggtgaagctggtcggcccggacgggacggagcacgagttcgaggcccccgacgacacctacatcctcgaggcggccgagaccgccggggtggagctgcccttctcctgccgcgccgggtcctgctccacctgcgccgggaggatgtcggccggcgaggtcgaccagtcggaggggtccttcctcgacgacggccagatggccgaggggtacctcctcacctgcatctcctaccccaaggcagactgcgtcatccacacccacaaggaggagga

SEQ ID NO: 57808 - protein, 152 aa, Zea mays
  misc_feature: Ceres CLONE 1508969
  misc_feature (66)..(142): Pfam Name: Fer2 Pfam Description: 2Fe-2S iron-sulfur cluster binding domain
  misc_feature: SWISSPROT Homolog: EC 1.18.1.3 Ferredoxin--NAD(+) reductase
MSTATAPRLPAPRSGASYHYQTTAAPAANTLSFAGHARQAARASGPRLSSRFVASAAAVLHKVKLVGPDGTEHEFEAPDDTYILEAAETAGVELPFSCRAGSCSTCAGRMSAGEVDQSEGSFLDDGQMAEGYLLTCISYPKADCVIHTHKEE

SEQ ID NO: 57809 - DNA, 617 bp, Zea mays
  misc_feature: Ceres CLONE 1508970
  misc_feature: Encodes the peptide sequence at SEQ ID NO. 57810
aaagctggagctccccgcggtggcggccgctctagaactagtggatcccccgggctgcaggaattcgcacgagaccattacctagaacatcctaatcgaaaactctccgcctcaccttgccctgcccgcacacaccacctgtccccgcacggccgcaccgctccgctcccgaggcttagggctccggccgcgctcccttcccttcccggcattcccgatctctcgccgccgcccgcctggccttgatctcgatcgccctcccctctccgctctcgctccggcaggccggcccgggtttgtctcgccgctattgggcctcggcacgctgcgatggtgtcgggcgtgtgcgtggggacggaggggcaggtggaccctgaggcggtggcgccggctgtcgcggaggaggcggtggtgccggcgcccgcgagggaggtcgtggtggggtacgcgctcacgagtaagaaggccaagagcttcctccacccaagcctcgggggctcgccaggtactgcaggggatcacgtgctccgcctcggttgggttaaggtagagacgggtccatggcgaaaagttgcgcccccgccgggaaatttctgtgcccttgggaaggatggcca

SEQ ID NO: 57810 - protein, 95 aa, Zea mays
  misc_feature: Ceres CLONE 1508970
MVSGVCVGTEGQVDPEAVAPAVAEEAVVPAPAREVVVGYALTSKKAKSFLHPSLGGSPGTAGDHVLRLGWVKVETGPWRKVAPPPGNFCALGKDG

SEQ ID NO: 57811 - DNA, 671 bp, Zea mays
  misc_feature: Ceres CLONE 1508974
  misc_feature: Encodes the peptide sequence at SEQ ID NO. 57812
  misc_feature (671)..(671): n is a, c, t, g, unknown, or other
aagctggagctccccgcggtggcggccgctctagaactagtggatcccccgggctgcaggaattcgcacgagaccattacctagaacatcctaatcgaaaacccaaacccctaccaccatttcccgggagtctcctttcccggagagtggatccgccactccaatctgcaccattctataaggaaaacctagatccggactcctagccgtcggccatggccacgcgccgggccttctcgtccatcctccgctctgcctctcgcattcgctccgcctcaccgtccccatgcccgcgtgcgccgctccaccaccgcccgtcccccgcgggcttcatactcaaccgtgtagccgcctacgcctcctccgccacggcccaggccgcgcccgctccgccacctccttcaaccggcaagaaaaccggtggcggcaagatcaccgatgagttcaccggcgctggcgccatcggccaggtgtgccaggtcatcggcgccgtcgtggatgtgcgcttcgacgaggggctgcccccgatcctgacggcgcttgaggtgctcgacaacaacattcgcctcgtgctcgaggtggcgcagcacctcggggagaacatggtccgcaccatcgccatggacgggacagaggggcttgttcgcggccagcgtgttctcaacaccggn

SEQ ID NO: 57812 - protein, 152 aa, Zea mays
  misc_feature: Ceres CLONE 1508974
  misc_feature (86)..(152): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
MATRRAFSSILRSASRIRSASPSPCPRAPLHHRPSPAGFILNRVAAYASSATAQAAPAPPPPSTGKKTGGGKITDEFTGAGAIGQVCQVIGAVVDVRFDEGLPPILTALEVLDNNIRLVLEVAQHLGENMVRTIAMDGTEGLVRGQRVLNTG

SEQ ID NO: 57813 - DNA, 626 bp, Zea mays
  misc_feature: Ceres CLONE 1508977
  misc_feature: Encodes the peptide sequence at SEQ ID NO. 57814
  misc_feature (575)..(575): n is a, c, t, g, unknown, or other
aaactggagctccccgcggtggcggccgctctagaactagtggatcccccgggctgcaggaattcgcacgagaccattacctagaacatcctaatcgaaaaagtccgtccgtccagcgttctctggctcacggtttatgctccatccccggaccccacttttccgttcgagagacgaaaaccgaccattcattaattcttccatggggaggatggcgaccgcgatggtgctcgcggcggcgctctgcggcctcctgctggcgtcggcggcggcgaagactgcgcccgtgggcagcggcggccgggatgacccctgggctgcggggggggccgccgtcacttcgtgtcgtgacctgatgaaggctggaccggcgggtgcgagcgatgggaaggcgaaggatatagatgtcaggccccccacgacaaggacgagtgcatgataagggcgtacgccggccagcgcacacccgaatactgtttacacccaagcagtagcccctgcctgaaccgagtacaaaacccgacctgacgaaaaatggcgggggctgaccatccaccgaagtttgaaagttcgtncagaggctcattgcccgaggagctacagctcctgctctggcgagacaaaag

SEQ ID NO: 57814 - protein, 78 aa, Zea mays
  misc_feature: Ceres CLONE 1508977
MGRMATAMVLAAALCGLLLASAAAKTAPVGSGGRDDPWAAGGAAVTSCRDLMKAGPAGASDGKAKDIDVRPPTTRTSA

SEQ ID NO: 57815 - DNA, 704 bp, Zea mays
  misc_feature: Ceres CLONE 1508979
  misc_feature: Encodes the peptide sequence at SEQ ID NO. 57816
aaagctggagctccccgcggtggcggccgctctagaactagtggatcccccgggctgcaggaattcgcacgagaccattacctagaacatcctaatcgaaaaaccatggtgccgctccactgctcagctagcgtccacctccacttcctatcgccatctctccccctttcgtcatccttctctctcctctgccatcgcgtccgccgccccaccgccatccgcgccgaagctgaagtgcggcctccgctacctgtctccgcggcggagtcagagccccctgacgccggcgctgtggaagccgaaggtcagggacccgtggagctccgcgctccgacgctcttctcgactgatgacaatctcaccccgctccagactgccaccagtctcctcctcaccggcgccatctcggttcttcctctttcgggccctccgccgccgtgcccgccggtgccaaggagctcaaagtgccgtcaagcgggttgaaaaaacctaaccatcttccccgaggagcccttggaaaaggctgaaatggatgaccgccctccccaattcgaaccgaaaaaggcaatttcccccatcccgggttcttcttcggcggaaattgcgggggggggcatttgccctctttcccttaaaaagtttcacaccccacttagaaggtggtggtttaacccttaaaaaacttttccgaaaggttttttttt

SEQ ID NO: 57816 - protein, 125 aa, Zea mays
  misc_feature: Ceres CLONE 1508979
MVPLHCSASVHLHFLSPSLPLSSSFSLLCHRVRRPTAIRAEAEVRPPLPVSAAESEPPDAGAVEAEGQGPVELRAPTLFSTDDNLTPLQTATSLLLTGAISVLPLSGPPPPCPPVPRSSKCRQAG

SEQ ID NO: 57817 - DNA, 667 bp, Zea mays
  misc_feature: Ceres CLONE 1508986
  misc_feature: Encodes the peptide sequence at SEQ ID NO. 57818
  misc_feature (587)..(587): n is a, c, t, g, unknown, or other
atagctggagctccccgcggtggcggccgctctagaactagtggatcccccgggctgcaggaattcgcacgagaccattacctagaacatcctaatcgaaaaaccacctcccccattttcgccgccccctccgatctcgccgttctcgtctccttccgttggattagggctcttcatctgttcgccgcacttcgtcagtcgcccatggcggatgaggaggtcactgatccaaaggcgctcctagaggatcgttcaaaggctaagtgtgtgtcgcagtggtatgattatcagaaatgtgttaaaaggattgaggacgatgagactgggcacaagcactgtcccgggcagtacttttgattactggcaaacgtgttgacaaggagggggggagacaaactcttttgaaatggtaaaatgaccaatttttccccccccttttatcccccttgaaggtggggaaaaattggtatcactttgtgagggcccattaacctttttaaggcgcttaatttttgtgccagaaaaacttttggcctcttggggtaaaagcaaatttttccccctgacaattttgcaatttcgtttcnggcccccttgttttgcacccccaaaggtttccccccccttgccggaaaaaaaaacgcgggcgcccttccccctcgctggg

SEQ ID NO: 57818 - protein, 50 aa, Zea mays
  misc_feature: Ceres CLONE 1508986
MADEEVTDPKALLEDRSKAKCVSQWYDYQKCVKRIEDDETGHKHCPGQYF

SEQ ID NO: 57819 - DNA, 522 bp, Zea mays
  misc_feature: Ceres CLONE 1508987
  misc_feature (236)..(236): n is a, c, t, g, unknown, or other
caaagctggagctccccgcggtggcggccgctctagaactagtggatcccccgggctgcaggaattcgcacgagaccattacctagaacatcctaatcgaaaagagggcggaagctgtccagatcgcgtgattccgcatcccgttcgcgagcgcgacacacgctgacagctcacggctgaccttcccgacggcctccagctccatcttgattcttgaggcgaagccccggtgcgtnaagagtcctgccatggccagcgagaataaggtctttggggtttcgaggaaagtcgccaaagcacaaaacggcacccaaaggacctggctgggatcatcatcccccgaaagggatgactccccccgttatgataacccctgggggaacaaagttttctacttaaccgggaaaaaccccccctgatttccaaaaattgggcccccttattccccccgggggcattgttgggaaaataccccccccccggggcgaaaaaaaaggttttttaaaaaaatccccccggaaa

SEQ ID NO: 57820 - DNA, 1200 bp, Zea mays
  misc_feature: Ceres CLONE 1508988
  misc_feature: Encodes the peptide sequence at SEQ ID NO. 57821
gaacggaggaggagagccatgtccagccccacgcacgccaggctcgcgcagcaaggcaaggccggcgtggcgctgcgcctgctcctcgccgccgcgctcgccggcttcctcctcgtcttcgccgcgcgcaccctggtcacgtcgcctgtccctgcatctccctcgtactcgtcgcatccgcatccgcatccgctgccgctgcccgttgcggaggcgctggtgcactacgccacgtccaacgcgacgccgcagcagacggcggaggagatcggggtggcgctgcgcgtgctgcagcggcgcgcgccctgcaacttcctggtgttcggtctgggcctggacagccccctgtgggcggcgctgaaccacggggggcggaccgtgttcctggaggaggacgcggcgtggatcaccagcgtgcggggcaggcacccagcgctggagtcccaccacgtggcctacgacacggcgctggccgacgccgacgcgctgctggggctccgcgcccacccggcctgcgtcgcgcagcccgacctcgcggcggccgccgccgcgtcctgccgcctcgcgctccggggcctcccgcccgtcttcgccggcctcgactgggacctcgtcatggtggacgcgcccacggggtggacgccccgtgcgcccggccgcatgggcgccatctacacggccggcatggcggcgcgcgcgcgcaggccaggggccggacccacccacgtcttcgtccacgacgtcgaccgctccatcgaggacgccttctccagggcgttcctgtgcgagggctacctcgccgaacaggtcggacggatcaggcacttcgtcatcccgtcacaccgcgacaaggacggcacgccattctgcccttgacaagagtttgttctgctttggtttggatcccacggtgcccattgccaaactactagctatgtgaatgtgggcgtggccaaactacgtactacagtactattattgctgcatagatgttgctttgcagtttttcattctacactgatgagtgcctgagagttgggtagacgacgattacaatgtaaaattcagagcttgcattgtctgttaggccttgttcgtttacatcggattgcacccggaatcattccggctaatcaaagtttatataaattagagaagcaatccggcttggattcgttccgaccaaaaaaaaaaaaaaaa

SEQ ID NO: 57821 - protein, 285 aa, Zea mays
  misc_feature: Ceres CLONE 1508988
  misc_feature (41)..(284): Pfam Name: DUF579 Pfam Description: Protein of unknown function (DUF579)
MSSPTHARLAQQGKAGVALRLLLAAALAGFLLVFAARTLVTSPVPASPSYSSHPHPHPLPLPVAEALVHYATSNATPQQTAEEIGVALRVLQRRAPCNFLVFGLGLDSPLWAALNHGGRTVFLEEDAAWITSVRGRHPALESHHVAYDTALADADALLGLRAHPACVAQPDLAAAAAASCRLALRGLPPVFAGLDWDLVMVDAPTGWTPRAPGRMGAIYTAGMAARARRPGAGPTHVFVHDVDRSIEDAFSRAFLCEGYLAEQVGRIRHFVIPSHRDKDGTPFCP

SEQ ID NO: 57822 - DNA, 647 bp, Zea mays
  misc_feature: Ceres CLONE 1508989
  misc_feature: Translation starting site: 158
  misc_feature (214)..(214): n is a, c, t, g, unknown, or other
  misc_feature (221)..(221): n is a, c, t, g, unknown, or other
  misc_feature (342)..(342): n is a, c, t, g, unknown, or other
  misc_feature (346)..(346): n is a, c, t, g, unknown, or other
  misc_feature (347)..(347): n is a, c, t, g, unknown, or other
  misc_feature (348)..(348): n is a, c, t, g, unknown, or other
  misc_feature (390)..(390): n is a, c, t, g, unknown, or other
  misc_feature (391)..(391): n is a, c, t, g, unknown, or other
  misc_feature (392)..(392): n is a, c, t, g, unknown, or other
  misc_feature (395)..(395): n is a, c, t, g, unknown, or other
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (400)..(400): n is a, c, t, g, unknown, or other
  misc_feature (403)..(403): n is a, c, t, g, unknown, or other
  misc_feature (404)..(404): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (412)..(412): n is a, c, t, g, unknown, or other
  misc_feature (416)..(416): n is a, c, t, g, unknown, or other
  misc_feature (417)..(417): n is a, c, t, g, unknown, or other
  misc_feature (439)..(439): n is a, c, t, g, unknown, or other
  misc_feature (613)..(613): n is a, c, t, g, unknown, or other
aaatctggagctccacgcggtggcggccgctctagactagtggatcccccgggctgcaggaattcgcacgagaccattacctagaacatcctaatcgaaaaaggtagaagacgactgactgcctcgagcagcagagatcagggaggccgagggctggatgaccatccggttcgtgctgttcgtcaacaagcagggccagacgcggctggcgcantactacnagcacctctccctcgacgagcgacgggccctcgagggcgagatcgtccccaagtgcctctcctgcaccgaccaggagggttcgttttgggacttctttaactaccaggtcgtttacagggnttannntttttttttcttcccccccccaaaggggaaaagaaaaggggnnnttnnnnnntcnnttnnnttntttnnttttttttaataaaaaacatcncttcccccccctggggggggggggcgcggccccgtcttctcgtgccccctgcggcattcccccctccccccccgcacagcaccgcaaattctatggcccccctgcgcgcacccacgtcacccggattcccctggccccccctccgctcccttccgccccccccttgctcgcccnccccgcaccccacccccggcccgccgctcttccc

SEQ ID NO: 57823 - DNA, 781 bp, Zea mays
  misc_feature: Ceres CLONE 1508992
  misc_feature (9)..(9): n is a, c, t, g, unknown, or other
  misc_feature (36)..(36): n is a, c, t, g, unknown, or other
  misc_feature (37)..(37): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
atacatatnccccccacccgtaatataacttattgnncccctnnnnnnnncaagctggaactccctgcggtggcggccgctctagaactagtggatcccccgggctgcaggaattcgcacgagaccattacctagaacatcctaatcgaaaaaaaggactcgggtgcttcatcagggtttactggactgacagacaacaaaaagctgagcaatgaccagcagcaagcagcaaaggctactgttcaagtatcaaagaggcctacagcttttgaagctctgtttggaaaggcagctgctggaagaaggccagatcttttcctaggattttcaaatgttcagggtaagactaaggtggacaagaataacgtcttccgtggtacttccttttcatcatttcctcaggtggggcaaaacttttcatcacccgctcttccagtaaaagaatcgttgcattctgaaccagacagcatccaaccacagtgacccagcttgtcagttggaagaagtgatacagttggacatgggcaacagaacgagcaacaacccacccaaaaaaatggcaaccgaagaatgatgggaacccttgtgaaaactgaaaaaaaacggaaaatgtttaaaacccccccttccgggggcacccgttatcgattacccgcccaacctacgaggggggggcccccggcacccccaatttttgccccgaaaagcggaggccggatttacccccccgttaaccccgggtccatctatttttaacaaaccacccttcaacggggaaaaa

SEQ ID NO: 57824 - DNA, 651 bp, Zea mays
  misc_feature: Ceres CLONE 1508993
  misc_feature: Encodes the peptide sequence at SEQ ID NO. 57825
aagctggagctccccgcggtggcggccgctctagaactagtggatcccccgggctgcaggaattcgcacgagaccattacctagaacatcctaatcgaaaagttcagttcagcttcggttggctcgccgtactcgggtttgttcctcgcctcgcttcgcttccttcctccgcagtcctcgtctcgaattcgctcgcggtgggagaaatcggggcgcgaggatgaccgtgatcgacatcctcacccgggtggacgcgatctgccagaagtacgacaggtacgacgtcgacaagctcaacggcgcgaacgtcgccggcgacgacccgttcgcccgcctctacgcgtccgtcgacgcggacatcaaccaatgcgtcgatgtgagatcccgtcctctcgctctgcgtcagcggcccggagccctggatctgaatctgacgacggtctgtttggcgtttggaacagaaagcggaaacggcgaagcaagagaagaaccgggccgcggtggtggcgcttaacgccgagatccggcgcacaagggcaagctcctcgaggaggacctcccaagctgcagcgcctcgcgttaagaggttgccgccctagtacccgcattgcctccgctgagttatgggtgagtgtgctcgtttcgcgagct

SEQ ID NO: 57825 - protein, 97 aa, Zea mays
  misc_feature: Ceres CLONE 1508993
MTVIDILTRVDAICQKYDRYDVDKLNGANVAGDDPFARLYASVDADINQCVDVRSRPLALRQRPGALDLNLTTVCLAFGTESGNGEAREEPGRGGGA

SEQ ID NO: 57826 - DNA, 620 bp, Zea mays
  misc_feature: Ceres CLONE 1509007
  misc_feature: Encodes the peptide sequence at SEQ ID NO. 57827
aagctggagctccccgcggtggcggccgctctagaactagtggatcccccgggctgcaggaattcgcacgagaccattacctagaacatcctaatcgaaaaatctgttatgcaaaatttcccgacccctctagaacgaccgcccctgccgaggagccgacagacgggcgaagcgggagggaggcgatggcggcggctcgggggcagaaggccctgggggctctgccgcagctggtgaagtcgctgcggagtgatgtctccggcagcgcacgactcaggcgccttccgtatctcaggaggaccttctcgttgtacgatcagatcaacctcatcgacagcgtcccggaagacgagctccgattccagtcgtatgatgacactggattcaaaattaacaatgtaaaatatgaaggcagtgtattgattgtagagaacaagataatgacatgggcacccaaaacgttctcagagataactcctgaaagtttatcaatcttcaaagttgtgcaccctatcccagagatctttattcttggttgcggaagacacgtccagctggtcagtcctgagctacggaagttcattcggtcaactggaatgaaactagaagcagttgattcg

SEQ ID NO: 57827 - protein, 145 aa, Zea mays
  misc_feature: Ceres CLONE 1509007
  misc_feature (59)..(145): Pfam Name: DUF498 Pfam Description: Protein of unknown function (DUF498/DUF598)
MAAARGQKALGALPQLVKSLRSDVSGSARLRRLPYLRRTFSLYDQINLIDSVPEDELRFQSYDDTGFKINNVKYEGSVLIVENKIMTWAPKTFSEITPESLSIFKVVHPIPEIFILGCGRHVQLVSPELRKFIRSTGMKLEAVDS

SEQ ID NO: 57828 - DNA, 734 bp, Zea mays
  misc_feature: Ceres CLONE 1509008
  misc_feature: Encodes the peptide sequence at SEQ ID NO. 57829
aagctggagctccccgcggtggcggccgctctagaactagtggatcccccgggctgcaggaattcgcacgagaccattacctagaacatcctaatcgaaaaaacctactagaccttgcccccggtggccaccttgggcgctttgtgatctggacccagagcgcgttcaataagctcgaggaggtgtatgggagctatgacgccccgtcgcagaagaagaagggcttcgtgctgccgaggcctaagatgtccaacgctgacctgggcaggatcatcaactctgacgaggtgcagtctgtggtgaagccactcaacaaggaggtgaagcgcagggagaagaggaagaacccactcaagaacatggctgctgtgctcaaactcaacccctacctgggcactgcccggaagatggttacccccccccacgctgctcgtgtgaaggcccagaaggtgaagctcgactccaagaggaccaagcttacccccgaaactgccaaggttaaggcctgctggcaaggcatgggtacaagaccatggtcttcggaaagcgaactacacccgagttttgaggaacttcttcaacagtgggctccggccgtgaacttcacttgaagcccggcaaagaggtaagtttaaagcttttcttgaagtctacccccacccctcttatatgttcccggaaggacaaaagtaggaagacccccattaccaattcccggattgtttaaacccccg

SEQ ID NO: 57829 - protein, 202 aa, Zea mays
  misc_feature: Ceres CLONE 1509008
AGAPRGGGRSRTSGSPGLQEFARDHYLEHPNRKNLLDLAPGGHLGRFVIWTQSAFNKLEEVYGSYDAPSQKKKGFVLPRPKMSNADLGRIINSDEVQSVVKPLNKEVKRREKRKNPLKNMAAVLKLNPYLGTARKMVTPPHAARVKAQKVKLDSKRTKLTPETAKVKACWQGMGTRPWSSESELHPSFEELLQQWAPAVNFT

SEQ ID NO: 57830 - DNA, 632 bp, Zea mays
  misc_feature: Ceres CLONE 1509019
  misc_feature: Encodes the peptide sequence at SEQ ID NO. 57831
gaaagctggagctccccgcggtggcggccgctctagaactagtggatcccccgggctgcaggaattcgcacgagaccattacctagaacatcctaatcgaaaaagacgtacgacacgaggatcaagatcgcggaggcactggaggcgtcggccagggccatcggggacaagcacgtggagccgtccgacgccgcggcgatacgcgtcgcggaggcgagcgccgcggggcgtggggcgatcccaggcggcgtctccgagcgcgcgcaggccgcggtggcggccaacgcccgcgccgcgcgcgacgaggacaaggtcaccatggccgacgtgctgacgtgggaggcgacggtgaagctgccgacgggcaaggccgtgactggcgaggtcgctgcggccgcggcagaggccgaggccgaggccgcgaatgatccccgagcgaagacgaacccccgcggggtgagcgcggcgctgggcatggccgcgaagcacaactgtggacacgagagcgcgcgcacgggcacggcctttccggatgaagctaagcaggattaagcttgatcgtatgtagtccagactctgtccatggactcccttgacggccggttgagtcgagttattagtgaatgaattat

SEQ ID NO: 57831 - protein, 77 aa, Zea mays
  misc_feature: Ceres CLONE 1509019
MADVLTWEATVKLPTGKAVTGEVAAAAAEAEAEAANDPRAKTNPRGVSAALGMAAKHNCGHESARTGTAFPDEAKQD

SEQ ID NO: 57832 - DNA, 602 bp, Zea mays
  misc_feature: Ceres CLONE 1509027
  misc_feature: Encodes the peptide sequence at SEQ ID NO. 57833
ctccccgcggtggcggccgctctagaactagtggatcccccgggctgcaggaattcgcacgagaccattacctagaacatcctaatcgaaaactatccagccgtctcggggcgtcgtgtgcgcgtggatctctccgtagaagggatgaagatcacggcgctccttgtgctgaagccgtcgacctccggagccggtagctcctcgtccggcggccagtcgggcccggaggcggtcgtgctcgcgaacgcgacggacgtcagccacttcggctacttccagcgcagcgccgcccgcgagttcatcgtcttcgttgcccgcaccgtcgctcaacgcacccagccaggccagcggcagtccgtccagcacgaagaatataaggttcactcccacaacagaaatgggctttccccggtggtatttatggatgatcactatcctgtacgaagtgcactttctcttctgaatcacgctcttgatgagcaccagaaggcttttggggactcctggaaatctgctactgcagatggaactcaacagtgggcttttcctgacagacgccttggcaagatttcatgaccctgcggaagctgacaaactaatgg

SEQ ID NO: 57833 - protein, 143 aa, Zea mays
  misc_feature: Ceres CLONE 1509027
MKITALLVLKPSTSGAGSSSSGGQSGPEAVVLANATDVSHFGYFQRSAAREFIVFVARTVAQRTQPGQRQSVQHEEYKVHSHNRNGLSPVVFMDDHYPVRSALSLLNHALDEHQKAFGDSWKSATADGTQQWAFPDRRLGKIS

SEQ ID NO: 57834 - DNA, 669 bp, Zea mays
  misc_feature: Ceres CLONE 1509031
  misc_feature: Encodes the peptide sequence at SEQ ID NO. 57835
  misc_feature (429)..(429): n is a, c, t, g, unknown, or other
atagctggagctccccgcggtggcggccgctctagaactagtggatcccccgggctgcaggaattcgcacgagaccattacctagaacatcctaatcgaaaaatcctgctgtcgatccactggattccacatcaagaatgctttctccccacgtgctgggtgaggatcattacaatactgctcgtggtgttcagaaggttcttcagaactacaaaaatcttcaggatattattgctatcttgggtatggatgagctcagtgaggatgacaagttgacggtcgctcgtgcaagaaagattcagcgtttcctgagccagcctttccatgtcgctaaaattttcacaggtgctccagggaagtatgtggagctgaaggaaagtgtgaagagtttccagggtgttttggatggcaagtatgaccacccccccnaacagtcattctacatgggatggaggcattgaggaagtcatttgctaaggccgagaaaatcgccaagagatctgcttcataaagcggcttcttgccttgttgaaacctggaaaatcaaggctcccattttaaaatataaacagattgggtaaaccttttcgcagataaaaccggccccaatctgggagggccaatcctccgggctaaaaaggccttcactttttcgcgttaggctggtgc

SEQ ID NO: 57835 - protein, 107 aa, Zea mays
  misc_feature: Ceres CLONE 1509031
  misc_feature (12)..(107): Pfam Name: ATP-synt_ab_C Pfam Description: ATP synthase alpha/beta chain, C terminal domain
  misc_feature: SWISSPROT Homolog: EC 3.6.3.14 H(+)-transporting two-sector ATPase
  misc_feature (98)..(98): Xaa is any aa, unknown, or other
MLSPHVLGEDHYNTARGVQKVLQNYKNLQDIIAILGMDELSEDDKLTVARARKIQRFLSQPFHVAKIFTGAPGKYVELKESVKSFQGVLDGKYDHPPXQSFYMGWRH

SEQ ID NO: 57836 - DNA, 622 bp, Zea mays
  misc_feature: Ceres CLONE 1509032
atagctggagctccccgcggtggcggccgctctagaactagtggatcccccgggctgcaggaattcgcacgagaccattacctagaacatcctaatcgaaaaagtacgtcacacgccgtgtttccattcccaccggccaccaccgggtttcgtcgctgccgccgcccgcacctgcagccgccatagtggaggggcggctctacagccgcctccgccgcgagggctctccgctcgcgcctcctcctcgaccccatccaccacccggccacgtcgctcgctccaatcgcttcggcgcgtacctcctcctcttccaccccgtctaccgccgcggcgaacaccatcgtggaagaagcagcggcagcggtatccgtttctcagcataccggatccatctccgactcgctgcggcactacgggaagtgctactgggagctctcgaaagcccgcctcagtgctcttgttgtggcaacttcgggggctggctatgtgcttggtagtggcaacatcgtggacattgccggcctttgttgcacatgtgccggtacaatgatggttgcagcatctgcaaataccctcaaccaggtgtttgagataaaaaatgatgctaaaatgaaaaggacaa

SEQ ID NO: 57837 - DNA, 582 bp, Zea mays
  misc_feature: Ceres CLONE 1509033
  misc_feature: Encodes the peptide sequence at SEQ ID NO. 57838
aagctggagctccccgcggtggcggccgctctagaactagtggatcccccgggctgcaggaattcgcacgagaccattacctagaacatcctaatcgaaaaaaacacgtccgcatactcccaaccaaatctccctccagcgccgcagctagcccgagaagccgacgaggaggaaaccgaccgccgacgccgagcaccctcggttccttgcttgcccggcgcccaatctagacagctctttctcgttcgtctgtatccatggccgcctcgagcaagaccatcgctgtcctcctcgccgcgctgctcctcgcgctggtcgcgtccgcggtggccagcaggaagctggaggaggaggacgctttatcgataccgtcgacctcgagggggggcccggtacccaattcgccctatagtgagtcgtattacgcgcgctcactgggccgtcgtttttacaaacgtccgtgaactggggaaaaaaaccctgggggttacccaaccttaatcggccttggagccacatcccccctttttcgcccagctgggcggtaattagccgaaagaggggcccggccacccgatttgg

SEQ ID NO: 57838 - protein, 68 aa, Zea mays
  misc_feature: Ceres CLONE 1509033
MAASSKTIAVLLAALLLALVASAVASRKLEEEDALSIPSTSRGGPVPNSPYSESYYARSLGRRFYKRP

SEQ ID NO: 57839 - DNA, 621 bp, Zea mays
  misc_feature: Ceres CLONE 1509036
  misc_feature: Encodes the peptide sequence at SEQ ID NO. 57840
ctggagctcaccgcggtggcggccgctctagaactagtggatcccccgggctgcaggaattcgcacgagaccattacctagaacatcctaatcgaaaaaacccaacttctctccctctccctcgcctgccttccgttccgcgtttgaccaactcccccgcaccgtaaccctagcagcagatcggccatggagagctgggcgacctgggtggggacaagcgtcacctccgccttcttcgcctccctcgagcgctgctcctgcatcaacctctccaccgacgacgacgacgacgactaggaccacgactaggccaaggaccgggccctcatcctctcagccgccccacgccacgactccgccgccaagcccgatccagactccgccgccgaggaccaggacgaccagaacggagaacatccggcgctgccgcccggatgaatcgaacccgatgccgtgcttgtactagcggctactgacgggagggcgccaaagaagagcaagagtggcgggtacagtcattaactacagcgctgctgcgacgaaccgaatacggggggatggagagatggagcgagaccgcgggggaaaggggaatcaaactcttaaaccagaaccccatct

SEQ ID NO: 57840 - protein, 36 aa, Zea mays
  misc_feature: Ceres CLONE 1509036
MESWATWVGTSVTSAFFASLERCSCINLSTDDDDDD

SEQ ID NO: 57841 - DNA, 670 bp, Zea mays
  misc_feature: Ceres CLONE 1509041
  misc_feature: Encodes the peptide sequence at SEQ ID NO. 57842
  misc_feature (334)..(334): n is a, c, t, g, unknown, or other
  misc_feature (354)..(354): n is a, c, t, g, unknown, or other
atagctggagctccccgcggtggcggccgctctagaactagtggatcccccgggctgcaggaattcgcacgagaccattacctagaacatcctaatcgaaaaagattcggagcttcgggggaaaaaggcaggcacagtatcgtcgaacatgctgccaggtcgccacccggcgcgccgggccgacaccaccgggacggggccgctcctgccggacgccactcgcgcggtggtgtcggagttcgtcgccacagccatgttcgtgttcgccgccgatagctccgtctacggcctctggaagctgtacaaggacacggcaacgccgggcggcctgctncgcgtgggcatcgcgcacancctggccctggtggcccccgtggcggtagccaacaacccctcgggtggggccggtcaaccctggggtcactttcggcctggttcgtgggccgtccatttcttttggccctgccccggttttatgggctccccaaaatccctggcccgggggcccccctttttcttataaacccttccccgggggaaccccccccgggggtttgggtttcccccggggcccaaaaaaggacccccccccccttaaaaacactatttttttggggctttattccccggtaccccccccggggtttttaaaaaaaggggggggggggtc

SEQ ID NO: 57842 - protein, 124 aa, Zea mays
  misc_feature: Ceres CLONE 1509041
  misc_feature (69)..(69): Xaa is any aa, unknown, or other
MLPGRHPARRADTTGTGPLLPDATRAVVSEFVATAMFVFAADSSVYGLWKLYKDTATPGGLLRVGIAHXLALVAPVAVANNPSGGAGQPWGHFRPGSWAVHFFWPCPGFMGSPKSLARGPPFFL

SEQ ID NO: 57843 - DNA, 674 bp, Zea mays
  misc_feature: Ceres CLONE 1509046
  misc_feature: Encodes the peptide sequence at SEQ ID NO. 57844
  misc_feature (673)..(673): n is a, c, t, g, unknown, or other
aaagctggagctccccgcggtggcggccgctctagaactagtggatcccccgggctgcaggaattcgcacgagaccattacctagaacatcctaatcgaaaaattcgcaccaccgccgcgccgcccaaatcacagccaccgccgccatggccgcctccagccgccctctcgtctccgtgaaggccctggagggcgacatggtcacggacgcccccggcatcgccttgccgcccgtcttcggtgcgccgatccgcccggacgtggtccgcttcacccacaagctgctgtcctgcaacaagcgccagccttacgcagtctcccgccgcgctggccaccagacgtcggccgagtcctggggtacgggccgcgctgtgtcccgtatcccccgcgtccccggcggcggcacccaccgcgccggccagggagcattcggcaacatgtgccgcggcggacgcatgttcgcgcccaccaagatctggcgcaagtggcaccgccgcgtcaacgtcaacctccgccgcgtcgccgtcgcctcggcgctcgccgccaccgccgtcccggccctcgtccaggcgcgcggccaccgcatcgagaccgtcccagagatgcccctggtcatctctgactcggcggagtccatcgagaagacctcccaggcgctcagatcctcaagcang

SEQ ID NO: 57844 - protein, 175 aa, Zea mays
  misc_feature: Ceres CLONE 1509046
  misc_feature (23)..(174): Pfam Name: Ribosomal_L4 Pfam Description: Ribosomal protein L4/L1 family
MAASSRPLVSVKALEGDMVTDAPGIALPPVFGAPIRPDVVRFTHKLLSCNKRQPYAVSRRAGHQTSAESWGTGRAVSRIPRVPGGGTHRAGQGAFGNMCRGGRMFAPTKIWRKWHRRVNVNLRRVAVASALAATAVPALVQARGHRIETVPEMPLVISDSAESIEKTSQALRSSS

SEQ ID NO: 57845 - DNA, 658 bp, Zea mays
  misc_feature: Ceres CLONE 1509048
  misc_feature: Encodes the peptide sequence at SEQ ID NO. 57846
  misc_feature (542)..(542): n is a, c, t, g, unknown, or other
  misc_feature (559)..(559): n is a, c, t, g, unknown, or other
aagctggagctccccgcggtggcggccgctctagaactagtggatcccccgggctgcaggaattcgcacgagaccattacctagaacatcctaatcgaaaagggaatttggatagcgcggcgcaggaaaaatggcggcttccgctctccacctccgcctccacccctcgccgccggcgggtgtgaagcttcagcagcggaaactgcgctcgaaaatacagaggcagggtggcctatctcgaagattttcaaaagttgtgtcctattacggtctcacaaccccaccatataaactggatgctctggaaccttatatgagcaagaggacagttgaacttcactggggtaagcaccatcaagattacgtggatggcttgaataagcagttggctaccagccctctgtatggatacactctggaggatctgataaaagaagcttataacaatggcaatccattaccagagtataacaacgcagcacaggtctgggaccatcacttcttctgggaatcaatgcaaccagaaggtggtggcttacctngaggaggtgtgctgcancagattgaaaggattttggctcgtttactaattttaggggaagagttatcggctcagccttacagctgttaaggtctggttggggtttggcttgtactg

SEQ ID NO: 57846 - protein, 166 aa, Zea mays
  misc_feature: Ceres CLONE 1509048
  misc_feature (45)..(130): Pfam Name: Sod_Fe_N Pfam Description: Iron/manganese superoxide dismutases, alpha-hairpin domain
  misc_feature: SWISSPROT Homolog: EC 1.15.1.1 Superoxide dismutase
  misc_feature (138)..(138): Xaa is any aa, unknown, or other
  misc_feature (143)..(143): Xaa is any aa, unknown, or other
MAASALHLRLHPSPPAGVKLQQRKLRSKIQRQGGLSRRFSKVVSYYGLTTPPYKLDALEPYMSKRTVELHWGKHHQDYVDGLNKQLATSPLYGYTLEDLIKEAYNNGNPLPEYNNAAQVWDHHFFWESMQPEGGGLPXGGVLXQIERILARLLILGEELSAQPYSC

SEQ ID NO: 57847 - DNA, 670 bp, Zea mays
  misc_feature: Ceres CLONE 1509049
  misc_feature: Encodes the peptide sequence at SEQ ID NO. 57848
agctccccgcggtggcggccgctctagaactagtggatcccccgggctgcaggaattcgcacgagaccattacctagaacatcctaatcgaaaaatcctcggcgccgcgctcacgattccggaatcactccccacgcgattcgatcctctcgccggcccaggcatcgtagaatccccccaccgaaaaaatcaagcgggcatacaaagagcgcgtgcgcactgcgcagtgcttggaataggtgggtcgaacttcgaaggggttcgaggacttcagctatggcatctgtgggacgtgcaggacgaggagggaaacgagatggagggaagggagaagggtcgctggctcgcagggcgtggaggcagtacctgctccagctccagcaacatcctctccgcacaaagatgattattggcccatgcctcgccggcgtcagtgactccgtggcgcagaagctctctgggttccagaagattgagaaacgcagactcctgctcaagatgctctttggttttgcatatggtggcccatttggacatttcttgcccaaaaattttggattgcatccttccaggggaaagaaggagaccaaaaaccataccaaaagaaggtggttattggagcaaagtgaacatcttcttcccttggaaataacatatttggttcctggcc

SEQ ID NO: 57848 - protein, 131 aa, Zea mays
  misc_feature: Ceres CLONE 1509049
MASVGRAGRGGKRDGGKGEGSLARRAWRQYLLQLQQHPLRTKMIIGPCLAGVSDSVAQKLSGFQKIEKRRLLLKMLFGFAYGGPFGHFLPKNFGLHPSRGKKETKNHTKRRWLLEQSEHLLPLEITYLVPG

SEQ ID NO: 57849 - DNA, 676 bp, Zea mays
  misc_feature: Ceres CLONE 1509052
  misc_feature: Encodes the peptide sequence at SEQ ID NO. 57850
  misc_feature (676)..(676): n is a, c, t, g, unknown, or other
aaagctggagctccccgcggtggcggccgctctagaactagtggatcccccgggctgcaggaattcgcacgagaccattacctagaacatcctaatcgaaaaaaaaaaaatatttgtttggtgagccacgctcccgtccggatccgcgggggaggacggcgatttcgtccccagcctcacgaggtcgggaaggggttcccgcacccacatttgtgaacctcgccgccgcccgtcccctgccttcacgaacccgtcgccgcccgtcccctactcttcctcgtgcacccaccgtcgctcgtcccctcgtcttccttgcgctctcgccgtcgccgcctcctcaccctcacgcacttgaggccagctgcggaacgaggtcggacggcggagacgaggtcgaggtctgtgacctcctcaacttgcgcaagactgccgagactgcagggacaagctctttgctgcctcgtcagctgcttctcggatactaacaaatgggttctataattgagttgataaggaaacatttgaagcagggtgatacacaagggattttcatcaacaagtggccgccagaagaactgaaacatcaagatggcgtttgcttttaggtcatgccattcaggagtacactgagactgttttattatgagactatgttttattatgatgcactgagacn

SEQ ID NO: 57850 - protein, 38 aa, Zea mays; identical to SEQ ID NO: 56690
  misc_feature: Ceres CLONE 1509052

SEQ ID NO: 57851 - DNA, 638 bp, Zea mays
  misc_feature: Ceres CLONE 1509058
  misc_feature: Encodes the peptide sequence at SEQ ID NO. 57852
  misc_feature (542)..(542): n is a, c, t, g, unknown, or other
  misc_feature (544)..(544): n is a, c, t, g, unknown, or other
ctggagctccccgcggtggcggccgctctagaactagtggatcccccgggctgcaggaattcgcacgagaccattacctagaacatcctaatcgaaaaattctcgaagtcgctgcggcacgcgtcccgcttctggtttgcttgcctgttgcctcccagatcttgccaactaattggaggcagccgagctgatctcccattctcccatcccgcaacgcgccgtctcgacggcggatcggtttcttctgcttctactgcgtgatctttgggcaagaagataagacacgtccaagcgtcgccacagtcaagggcggcttggttgcaggcaagatggggaaggacggagaatctgccaagctgaaggaggagaaggagtccaaggaagagatccatgtgaaggtcaagagcaagggcgagcggcccggcgaaaaagacggcaaggaggaggtcgaggtagagattgaggccaagtttgttgagaaggaagaggtcaaagactcgggtgacggtgcgggaggaaagggtacccagaagagggatccnangaagaaagacaagaaaaagaaggaaggtggtgacgattctgggaagggagaggaagacaagaaggataaagcgaaggattcagagggcaaggac

SEQ ID NO: 57852 - protein, 103 aa, Zea mays
  misc_feature: Ceres CLONE 1509058
  misc_feature (72)..(72): Xaa is any aa, unknown, or other
MGKDGESAKLKEEKESKEEIHVKVKSKGERPGEKDGKEEVEVEIEAKFVEKEEVKDSGDGAGGKGTQKRDPXKKDKKKKEGGDDSGKGEEDKKDKAKDSEGKD

SEQ ID NO: 57853 - DNA, 639 bp, Zea mays
  misc_feature: Ceres CLONE 1509064
  misc_feature: Encodes the peptide sequence at SEQ ID NO. 57854
aaagctggagctccccgcggtggcggccgctctagaactagtggatcccccgggctgcaggaattcgcacgagaccattacctagaacatcctaatcgaaaaactgagaaccgcagagacaggcgtcttcgtactcgcctatctccgcgacccaaagcgttcccccttctcccattcttctctcatttctcaccaccgccgccgctaccccctttcgacaacaccatgagggagtgcatctcgatccacatcggccaggccggtatccaggtcggaaacgcgtgctgggagctgtactgcctcgagcatggcattcaggctgatggtcagatgcccggtgacaagaccattgggggaggtgatgatgctttcaacaccttcttcagtgagactggcgctgggaagcacgtcccccgtgctgtttttgttgaccttgagcccactatcatcgatgaggtgaggactggcacctatcgccagctcttccatcctgagcagctcatcagtggcaaggaggatgcagccaacaacttcgctcgtggtcactacaccattggcaaggagattgttgacctgtgccttgaccgcatcatgaagcttgcaaataattgcactggtctccagggcttcctcgtcttc

SEQ ID NO: 57854 - protein, 138 aa, Zea mays
  misc_feature: Ceres CLONE 1509064
  misc_feature (49)..(138): Pfam Name: Tubulin Pfam Description: Tubulin/FtsZ family, GTPase domain
MRECISIHIGQAGIQVGNACWELYCLEHGIQADGQMPGDKTIGGGDDAFNTFFSETGAGKHVPRAVFVDLEPTIIDEVRTGTYRQLFHPEQLISGKEDAANNFARGHYTIGKEIVDLCLDRIMKLANNCTGLQGFLVF

SEQ ID NO: 57855 - DNA, 637 bp, Zea mays
  misc_feature: Ceres CLONE 1509065
  misc_feature: Encodes the peptide sequence at SEQ ID NO. 57856
  misc_feature (515)..(515): n is a, c, t, g, unknown, or other
  misc_feature (580)..(580): n is a, c, t, g, unknown, or other
  misc_feature (596)..(596): n is a, c, t, g, unknown, or other
ctggagctccccgcggtggcggccgctctagaactagtggatcccccgggctgcaggaattcgcacgagaccattacctagaacatcctaatcgaaaaatcgacgcgcacaacacagcgcccacacaaacacacagacagtctcacgcgacgacacacacgcaaggcggacggacatggatatgagaggagggcacaacatgggcggcatggcaccgccgccgtcccctcacggcggcatgcggaagcgctacgtccacatgaccttcttctggggcaagaactcggagatcctcttcacggggtggcccggcgcgcgcggcggcatgtacgcgctggcgctcgtcgccgtcttcgcgttcgcgctcctgctcgagttcctgggctcccgccgcctggacgcgctcctctccgccgcggccggccggcgcacggcagcggcgggggcggcgcgcacggcggtgtatgccctgcgcgtgggtggggcgtacctgctcatgctggcgctcatgtcgntcaacggcggcgtgctcctcgttgcaatcgcgggccaccgccgcggcttctggcgttcagggccngcctgtttcgcgaccngcgggcgcaggtggagaccactgcaaagatgaagtcccccc

SEQ ID NO: 57856 - protein, 150 aa, Zea mays
  misc_feature: Ceres CLONE 1509065
  misc_feature (27)..(135): Pfam Name: Ctr Pfam Description: Ctr copper transporter family
  misc_feature (114)..(114): Xaa is any aa, unknown, or other
  misc_feature (141)..(141): Xaa is any aa, unknown, or other
MDMRGGHNMGGMAPPPSPHGGMRKRYVHMTFFWGKNSEILFTGWPGARGGMYALALVAVFAFALLLEFLGSRRLDALLSAAAGRRTAAAGAARTAVYALRVGGAYLLMLALMSXNGGVLLVAIAGHRRGFWRSGPACFATXGRRWRPLQR

SEQ ID NO: 57857 - DNA, 679 bp, Zea mays
  misc_feature: Ceres CLONE 1509070
  misc_feature: Encodes the peptide sequence at SEQ ID NO. 57858
  misc_feature (494)..(494): n is a, c, t, g, unknown, or other
aagctggagctccccgcggtggcggccgctctagaactagtggatcccccgggctgcaggaattcgcacgagaccattacctagaacatcctaatcgaaaaaaaaaggccaaaaccacccaaaaaccccagcgcacccaacccaagagcgaaaatggatccgcaccagttcgccccctcccagcagtcggcgctgaccatggaatcggcggagagcacggccgccgccgccgcgcgggcgtccaacggcgctgcccgagctgtcgtcgaggacgacgacgaggacgacgacgtccccgaggtggccgcctgcatatcgacgatgctcgaccgcgggggtagcgtggagagccacccgctcttcctgggcgcgcgcaccgcgctggagatgctcgcgaccgcgggtacgccgttccggaggagagctcgcccgcacctcccggagtccgcgcctggggggaaaacaggccggagttgaacgcctcgctttttcantaacctaactccaaccgttcagaaggggaaagttgggttctgccccctgggactgggaaaaatccagctttcgggtaaattttccgaatcaaaaaaaaaacttttccaaaaggtttttaaattggcggaaaaaaattgcttttcaccccaaaaaccctcggggggttttttcatttaaagagaac

SEQ ID NO: 57858 - protein, 107 aa, Zea mays
  misc_feature: Ceres CLONE 1509070
MDPHQFAPSQQSALTMESAESTAAAAARASNGAARAVVEDDDEDDDVPEVAACISTMLDRGGSVESHPLFLGARTALEMLATAGTPFRRRARPHLPESAPGGKTGRS

SEQ ID NO: 57859 - DNA, 685 bp, Zea mays
  misc_feature: Ceres CLONE 1509077
  misc_feature: Encodes the peptide sequence at SEQ ID NO. 57860
aagctggagctccccgcggtggcggccgctctagaactagtggatcccccgggctgcaggaattcgcacgagaccattacctagaacatcctaatcgaaaaatcgagccgccgccgccgccgccgcagttgtcttcggtcttccgtgctcaccttcgagagatcaagttgctgctgcggtagtccccaaccatcatcatgcagaacgaggagggtaagacggtggacctctacgtccccaggaagtgctcggccacgaataggatcatcactgccaaggatcatgcctctgtccagatcaacattggccacttggatgcgaatggcctgtacgatggtcacttcaccacgtttgctctctctgggtttgtccgtgctcagggtgatgctgacagttcgttggacaggctgtggcagaagaagaaggctgagatcaagcagtaggtctttgcacgtagttccaccggtaatggactcttgagggatactgctctagctaatgctttagctggggggggggggagtgattctgatgtttggctgttcgtttgttggatgaccacggttttagttttgtcttggccatgctttgggttccaaccaatcctgtgggcaccaatgaatattcatttttggtcaaccttatttcttcctcaccaaaaaaaaaaaaaaaaacaaaccctttt

SEQ ID NO: 57860 - protein, 81 aa, Zea mays; identical to SEQ ID NO: 43974
  misc_feature: Ceres CLONE 1509077
  misc_feature (1)..(81): Pfam Name: Ribosomal_S21e Pfam Description: Ribosomal protein S21e

SEQ ID NO: 57861 - DNA, 668 bp, Zea mays
  misc_feature: Ceres CLONE 1509079
  misc_feature: Encodes the peptide sequence at SEQ ID NO. 57862
aagctggagctccccgcggtggcggccgctctagaactagtggatcccccgggctgcaggaattcgcacgagaccattacctagaacatcctaatcgaaaaccttctccgccgccacgctagagaggaagagcgcgcggagagcgagagcccgggagaaacagcggccggcggcaaaatggtgcagcggctcacctaccggaagcgccacagctacgccacaaaatccaatcagacccgcgtggtcaagacccctggtgggaggcttgtgtaccagtacaccaagaagcgcgcgagcggaccgaaatgcccggtcaccgggaaaaagatccaaggaattccacacctgagacctgctgagtacaagaggtctaggttgccaaggaaccgcaggactgtgaaccgtccatatggtggtgttctgtctggtaccgcagtcagagagaggatcatccgtgcctttttggtcgaggagcagaagatcgtgaagaaggttttgaagatccaaaagaccaaggataaggcctccaagaactaggcgatataggcatcttccacaatgttcaagtcccttagatgatatggtttaaattttgagcgaaagttgcggatccttttatttttttaaaatctcgggtggaatgtttttcactcgtctatgtggatgtc

SEQ ID NO: 57862 - protein, 119 aa, Zea mays; identical to SEQ ID NO: 13398
  misc_feature: Ceres CLONE 1509079
  misc_feature (5)..(103): Pfam Name: Ribosomal_L34e Pfam Description: Ribosomal protein L34e

SEQ ID NO: 57863 - DNA, 670 bp, Zea mays
  misc_feature: Ceres CLONE 1509084
  misc_feature: Encodes the peptide sequence at SEQ ID NO. 57864
  misc_feature (614)..(614): n is a, c, t, g, unknown, or other
aaagctggagctccccgcggtggcggccgctctagaactagtggatcccccgggctgcaggaattcgcacgagaccattacctagaacatcctaatcgaaaaaaggaaaacccaaagccagcagctgtctgcgtcgccgtcggcttcctatcctactgcgtgcgtggacctcgctatgctcacgcggcgaccggtggctcctcctattgctacaactacttgtactcgcgcccgtcccttgcgcacgcaacgcaagcgcagacacgagcgatccgatccgatccggaactgtgccggccagccatggcgactagggttttgctcaccgccctcctcctcgccttcctcctcgtcgccacccctttcaccgcccgagttgctagagctgattcggaggaagatgctgctgcagctgaggttgttgaaggggctgatctaggtattgtgggtgatgatacacaggtttccagtgatggacctttaagccctgctcctggtgtagagacagtagttgtattccccaaaaatgctggcaaaattgtactagcaggtgaagaaactgaattactagttggtctgcaaaatgagggtgaatcgactttgaatggtggttngctgtcattcactctccatcttccttttgacccatatatgtatggccagaatctta

SEQ ID NO: 57864 - protein, 122 aa, Zea mays
  misc_feature: Ceres CLONE 1509084
  misc_feature (104)..(104): Xaa is any aa, unknown, or other
MATRVLLTALLLAFLLVATPFTARVARADSEEDAAAAEVVEGADLGIVGDDTQVSSDGPLSPAPGVETVVVFPKNAGKIVLAGEETELLVGLQNEGESTLNGGXLSFTLHLPFDPYMYGQNL

SEQ ID NO: 57865 - DNA, 678 bp, Zea mays
  misc_feature: Ceres CLONE 1509088
aagctggagctccccgcggtggcggccgctctagaactagtggatcccccgggctgcaggaattcgcacgagaccattacctagaacatcctaatcgaaaacaggccaagggaaccaagattcatcgcaggagttccagcctagaagaataagcttgcttgccccattttcttccctcggatggcgagacaagaacaagaacggctctgatgagtcaacaaacggtaagctcaataatagcaccgatcaaggggttgaaacacccaaaaaggacgactcgccaaaagagggtgaacagattgtccgaacaccggaaagagacaatgaactgagactagggacacccaggatggatagtgaggtaccaagtgtggaaatggcggcgaacagtacgaatgggctggaggaccagttggaggagataaaattggattgatatcctttggctggtcgctaagccgcaacataaggtgccattaaattatgtattggtgtatccattttccacctctattcttttaggtttatagattcttgtataacttgagtcgagagaatgaataaactatgtttgccctcttatagttctgttgatcgcctgtaagctatcatgagtacacatgaaaaggacgtaccaaatagaagattatcacgaaagcaatttttggaaaaaaaaaa

SEQ ID NO: 57866 - DNA, 733 bp, Zea mays
  misc_feature: Ceres CLONE 1509090
  misc_feature (313)..(313): n is a, c, t, g, unknown, or other
  misc_feature (398)..(398): n is a, c, t, g, unknown, or other
  misc_feature (399)..(399): n is a, c, t, g, unknown, or other
  misc_feature (400)..(400): n is a, c, t, g, unknown, or other
  misc_feature (691)..(691): n is a, c, t, g, unknown, or other
  misc_feature (733)..(733): n is a, c, t, g, unknown, or other
aaagctggagctccccgcggtggcggccgctctagaactagtggatcccccgggctgcaggaattcgcacgagaccattacctagaacatcctaatcgaaaaaaccgtgggggtgccttacggcctacgggccggagcagcgctcgggagccgcggcacggaggcatcgacgccgttgagctcgaggcgaccggcggctcgcggcctcgccacagcggtgctgtggcagtgtggcttcttctggtttctgcgggctcagcgcggaggcctattgcaggattaaatgtcaaataggccaggatgggatgatganatatgccctatgcacggaagtaccaaagccagacctttccctttgcttgttttcccccccccgctaggggggagaggggggtccnnnaaaggcccccaaaattccccttcccccaaacctaaaaaaatgtggggggaaaccttgggtggggggggcacacatttcctccccccccccccccatttttgtggaaaaacccctggggacaatttcccccccccgtttttgagaggggggggaaaaaatctccccccccccccaacaacacccccttgggggcgccccccggggatacaaccccccccccccccgcccaaaaatatgggagaaaaagagggggggaaaaccctccccccccgccggcccccacccgcgccnagaaaaagaatgtataaacccccccccaacatttttttttcn

SEQ ID NO: 57867 - DNA, 662 bp, Zea mays
  misc_feature: Ceres CLONE 1509092
  misc_feature: Encodes the peptide sequence at SEQ ID NO. 57868
  misc_feature (568)..(568): n is a, c, t, g, unknown, or other
aaagctggagctccccgcggtggcggccgctctagaactagtggatcccccgggctgcaggaattcgcacgagaccattacctagaacatcctaatcgaaaactctcccctcctcttccacggccgcgcctgcgacacccatccgccgccacgccatggccaagtacaacgtggtgcagaagaacaagcgccagtgcaatcaggaccgcaagcgcgccgcgcatggggagcccgggaccggcaagctcaagcagcggaccgcgcccgtctccatgtccggcaagcggaagaagaagctcgagcgccgcctcaaccggaagcagaaagaggctgcgatgattaaggcgctggagaacaacatgggggatgtcgacatggtctcagttgaagagtcttcagaagctgcaaagggcaagtcccaagtgaagttcagtgtgaagaaaaactcaagaatacagataaagagattaaagggcaaaggcaggaagaaagccaaaaatgcaaaaccacctgccaaggagaaagttgatgccatggtagcatgacggacaagactgcatacatcccntttgtatgttttctcagagtttgcagcatggaccgacctcaccgaacactggcgcgtgaactgtctcttgcatcttctgcctgaatgctaaata

SEQ ID NO: 57868 - protein, 129 aa, Zea mays; identical to SEQ ID NO: 40983
  misc_feature: Ceres CLONE 1509092

SEQ ID NO: 57869 - DNA, 679 bp, Zea mays
  misc_feature: Ceres CLONE 1509098
  misc_feature: Encodes the peptide sequence at SEQ ID NO. 57870
aaagctggagctccccgcggtggcggccgctctagaactagtggatcccccgggctgcaggaattcgcacgagaccattacctagaacatcctaatcgaaaactagcgccgcacacactcccccgcccgccgccgccgccgcacagccgcaggtagagaaggcaaggaggaagggaagatgccggcggagcacgggctgcggtcgcggacgcgcgacctgttcgcgcggcccttccgcaagaaggggtacatcccgctcaccacctacctgcgcacctacaaggtcggcgagcatgtcgacgtcaaggtgaacggcgccgtccacaagggtatgccgcacaagttctaccacggccgcaccggtcgcgtctggaacgtcaccaagcgcgccatcggcgtcgagatcaacaagcaggttggcaacaggatcatcaagaagaggatccatgtgcgtgtggagcacgtgcagccatccaggtgcaacgaggagttcctccagaggaagctcaacaacgacaagctgaaggcggaggccaaggcgcgtggtgaggtcatcagcaccaagaggcagccagcaggccccaagcctgagttcatggtggagggcaccaccatcgagacggtcacccccatcccgtacgacgtcgtcaacgatctcaaggggtggtactagagcgct

SEQ ID NO: 57870 - protein, 164 aa, Zea mays
  misc_feature: Ceres CLONE 1509098
  misc_feature (2)..(100): Pfam Name: Ribosomal_L21e Pfam Description: Ribosomal protein L21e
MPAEHGLRSRTRDLFARPFRKKGYIPLTTYLRTYKVGEHVDVKVNGAVHKGMPHKFYHGRTGRVWNVTKRAIGVEINKQVGNRIIKKRIHVRVEHVQPSRCNEEFLQRKLNNDKLKAEAKARGEVISTKRQPAGPKPEFMVEGTTIETVTPIPYDVVNDLKGWY

SEQ ID NO: 57871 - DNA, 609 bp, Zea mays
  misc_feature: Ceres CLONE 1509148
  misc_feature: Encodes the peptide sequence at SEQ ID NO. 57872
aagctggagctccccgcggtggcggccgctctagaactagtggatcccccgggctgcaggaattcgcacgagaccattacctagaacatcctaatcgaaaagatggtgcgggtccccctctgctccgttttccaattagtgaaccagataggagtcttcttcctccccgaccacaccgctcctctccttccaagccctcgtcaccaccagcctgctctcattcctgtgccacctggatctcaactgcttgcgctcaacatgctccccacacactctcgctgcggcgtgtgcccgcccaacccgtgcatcgctctctgtcgcttccgcctcatcataggtgatgggcgtcgtcgtcccccgaagaaaaaaccgaaggggccagccaattttgatagaacaaccttggtgggaaagaaaacctaaccccacaaacgagttggggaatttccccggggccggggttttttttaccaccttttgaaaaagaaaggccaaaggggtcttttttttgggccccaaaaaaacacaaaggggccccaaaaaattttgaactttttaaaaaaggggtctctcattttttttaaaggggggtgtggcccccccccagag

SEQ ID NO: 57872 - protein, 106 aa, Zea mays
  misc_feature: Ceres CLONE 1509148
MVRVPLCSVFQLVNQIGVFFLPDHTAPLLPSPRHHQPALIPVPPGSQLLALNMLPTHSRCGVCPPNPCIALCRFRLIIGDGRRRPPKKKPKGPANFDRTTLVGKKT

SEQ ID NO: 57873 - DNA, 660 bp, Zea mays
  misc_feature: Ceres CLONE 1509163
  misc_feature: Encodes the peptide sequence at SEQ ID NO. 57874
  misc_feature (627)..(627): n is a, c, t, g, unknown, or other
aaactggagctccccgcggtggcggccgctctagaactagtggatcccccgggctgcaggaattcgcacgagaccattacctagaacatcctaatcgaaaaaaaaacaggcaatgggcaacgcataggcatagcttggctcgcacggtgtcgctggctcccctccccttccctccccactgttacatccagcgagctgttcacggccgtgccgagctcagtgaggcagcgtttgcgagtccgggacgaggggagcggcgggcgacatggggaggggccgcaacgagataaagcggatcgagaaccccacgcagcggcagtccaccttctacaagcgcagggacggcctcttcaagaaggctagggagctctccgttctgtgcgacgtggacctgctgctgctcctcttctccacctccggcaagctctaccactacctctcgcccaccgtcccctccgtcaaggacctggtcgagaggtacgaggccacgacgcacaccaaggtctggaccgacatccgccaggagcggcgcgcggagctggagaatgcggagcagatgtgcgagctgatggagacgagctggcggtcatgacggtggacgacggagagcactacacagtgctttcnctggagctgctgaacacagcctagaagcggccg

SEQ ID NO: 57874 - protein, 108 aa, Zea mays
  misc_feature: Ceres CLONE 1509163
  misc_feature (9)..(59): Pfam Name: SRF-TF Pfam Description: SRF-type transcription factor (DNA-binding and dimerisation domain)
MGRGRNEIKRIENPTQRQSTFYKRRDGLFKKARELSVLCDVDLLLLLFSTSGKLYHYLSPTVPSVKDLVERYEATTHTKVWTDIRQERRAELENAEQMCELMETSWRS

SEQ ID NO: 57875 - DNA, 806 bp, Zea mays
  misc_feature: Ceres CLONE 1509181
  misc_feature: Encodes the peptide sequence at SEQ ID NO. 57876
  misc_feature (1)..(1): n is a, c, t, g, unknown, or other
  misc_feature (2)..(2): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
nnttcatttatactcnnnactatcaacaacatcacccataccttttttcctaaaactggagctccccgcggtggcggccgctctagaactagtggatcccccgggctgcaggaattcgcacgagaccattacctagaacatcctaatcgaaaaagttaggattcactcgatcggccatcatcggactgtgcaagcacgagagggggatacagcggattcataaaccgtcagagtgttaggacaagatggtggccaatggtgatgtacctgctagagggagcgcggcggcagccgcaagcctgcgtaggcgtaagaccacaagtggtgctgctgctggtggaggctgtaccagctcaatgctccaattctacactgatgaggctgccggccgcaaaatgtcaccaaacactgttctgatcatgagcattggggatcgaagccgtcgtttgctgggctcccatgtattccgggaaagccgcacccccacctccaaaacaaggttggcattgcccatattcctaaaaaaggctgagccccccccaagagaaagattccccggtgaaaacaaatttaaaattgggaccggccagggtgacttttccaaaacttctggttgggagaaaagtgtttttttatacccaaattttgcctatgcgctcggccaggggtccattccatttaaaagaccccccccacgagcctaacgtgttttataaagaccatcggccgccccttccctattttctttggaaaaattgtactaggtgggagctcataagagggcgccaatatctctgtcctcgctg

SEQ ID NO: 57876 - protein, 152 aa, Zea mays
  misc_feature: Ceres CLONE 1509181
  misc_feature (32)..(78): Pfam Name: Sec61_beta Pfam Description: Sec61beta family
MVANGDVPARGSAAAAASLRRRKTTSGAAAGGGCTSSMLQFYTDEAAGRKMSPNTVLIMSIGDRSRRLLGSHVFRESRTPTSKTRLALPIFLKKAEPPPRERFPGENKFKIGTGQGDFSKTSGWEKSVFLYPNFAYALGQGSIPFKRPPPRA

SEQ ID NO: 57877 - DNA, 623 bp, Zea mays
  misc_feature: Ceres CLONE 1509188
  misc_feature: Encodes the peptide sequence at SEQ ID NO. 57878
  misc_feature (429)..(429): n is a, c, t, g, unknown, or other
  misc_feature (430)..(430): n is a, c, t, g, unknown, or other
ctccccgcggtggcggccgctctagaactagtggatcccccgggctgcaggaattcgcacgagaccattacctagaacatcctaatcgaaaaatccacccggaggcacctcacacacacacactctctctctctccactggctgacgccgcgaccgccccaacccaactgcccttttcggagatctcgccgcctccgccgtcgacttccgtcgcccccctatcccgcgtccgggcttacccgatggcacggctgcactggcttgaggccgtcctgccgctggggatcatcggcggcatgctctgcatcatgggcaacgcccagtatttcatccacaaggccgcgcacggcaggccgaagcacatcgggaacgatatgtgggacgtcgccatggagcgccgcgacaagaagctcgtggaacatccctcgnngcactaggtattgatcaacttcaaactttttctgatgttgacgaacttcgttcaaaacacaggagtactgctcttttgtttccctgaacaattgggacccaaaactggtttggttttgcttttgaaaaatccaaccgtttcggaaaaaataatctggaacctgaaatcctggtttaaatggaaccaaaagccc

SEQ ID NO: 57878 - protein, 64 aa, Zea mays
  misc_feature: Ceres CLONE 1509188
  misc_feature (63)..(63): Xaa is any aa, unknown, or other
MARLHWLEAVLPLGIIGGMLCIMGNAQYFIHKAAHGRPKHIGNDMWDVAMERRDKKLVEHPSXH

SEQ ID NO: 57879 - DNA, 654 bp, Zea mays
  misc_feature: Ceres CLONE 1509190
  misc_feature: Encodes the peptide sequence at SEQ ID NO. 57880
aaagctggagctccccgcggtggcggccgctctagaactagtggatcccccgggctgcaggaattcgcacgagaccattacctagaacatcctaatcgaaaagcatttgtagtacagtagtagcagcagtagcagcaggcaagaagaatccaaagccgaagggtctctcccccccatctctgttccaccaggtgcgtgcggcggggagcgatgggggcgcggaggcggctgcaggaagacgcgccgccggggcgtcgccacaggcagggcgcgccggcgccggactggagcgccgggtacctcaacgggtggctgtcgcagccgacgcccgtcttcggcctccgcctctgggtgctcatcggcatcgccgtcggcgccgccatcgtgctcgtgctcctcctcatcttcgtctgcctctcccgcctccgccgccgccgcctcgccgccaacccctactaccccgccgacaccaagctgctcaagcagcacctgcagcagcaggccacgcccaccaaggacatccaggagatcgtccgccgccagcaggagcccgcggtgcagctcgccaaggccgtgccgcagccgcagccgcagactccgccgccgccgccgcctccgcagcacaggccaccggcgcgcaagacgcccggcagc

SEQ ID NO: 57880 - protein, 148 aa, Zea mays
  misc_feature: Ceres CLONE 1509190
MGARRRLQEDAPPGRRHRQGAPAPDWSAGYLNGWLSQPTPVFGLRLWVLIGIAVGAAIVLVLLLIFVCLSRLRRRRLAANPYYPADTKLLKQHLQQQATPTKDIQEIVRRQQEPAVQLAKAVPQPQPQTPPPPPPPQHRPPARKTPGS

SEQ ID NO: 57881 - DNA, 694 bp, Zea mays
  misc_feature: Ceres CLONE 1509203
  misc_feature: Encodes the peptide sequence at SEQ ID NO. 57882
  misc_feature (318)..(318): n is a, c, t, g, unknown, or other
  misc_feature (331)..(331): n is a, c, t, g, unknown, or other
  misc_feature (343)..(343): n is a, c, t, g, unknown, or other
  misc_feature (370)..(370): n is a, c, t, g, unknown, or other
  misc_feature (373)..(373): n is a, c, t, g, unknown, or other
aaaactggagctccccgcggtggcggccgctctagaactagtggatcccccgggctgcaggaattcgcacgagaccattacctagaacatcctaatcgaaaagatggagaagatgctccactcagccccggcccacggcaggctcccggagtgcttcatcttcccggccgacaagctcccgcaggccaaggccacctcagcgacggtctccctgcccatcgtggacctctccctcggccgcgacgaggtgcggcgcgccatcctcgaggccggcaaggagatcggcttcttccaggtggtgaaccacggcgtctcccntggagcgatgcangacatggagacngtgtgcccagagttcttcccgctgccngcngaggaacaaggcgggctgtacttcgaggaaccggggagggcgaacgggatttactccagcccatgtttcaacgggggcccaaaaaaatggggggaatggccccccctggcttgttctttccccccctgggaaaaaaccccgggttttgcccaaaacccccagatcccgggggggggggaaaaatttttcggggaacacgggggcgggggagaaaaaaacccccccctggggggggagccccccccccccccccacaatgggaagggaaaaaatggggggaaaattttctctcttaaaaaaacaaccccccccccccccccc

SEQ ID NO: 57882 - protein, 197 aa, Zea mays
  misc_feature: Ceres CLONE 1509203
  misc_feature: SWISSPROT Homolog: EC 1.14.11.9 Flavanone 3-dioxygenase
  misc_feature (72)..(72): Xaa is any aa, unknown, or other
  misc_feature (76)..(76): Xaa is any aa, unknown, or other
MEKMLHSAPAHGRLPECFIFPADKLPQAKATSATVSLPIVDLSLGRDEVRRAILEAGKEIGFFQVVNHGVSXGAMXDMETVCPEFFPLPAEEQGGLYFEEPGRANGIYSSPCFNGGPKKWGEWPPLACSFPPWEKTPGFAQNPQIPGGGEKFFGEHGGGGEKNPPLGGEPPPPPHNGKGKNGGKIFSLKKTTPPPPP

SEQ ID NO: 57883 - DNA, 663 bp, Zea mays
  misc_feature: Ceres CLONE 1509204
  misc_feature: Encodes the peptide sequence at SEQ ID NO. 57884
tggagctccccgcggtggcggccgctctagaactagtggatcccccgggctgcaggaattcgcacgagaccattacctagaacatcctaatcgaaaaaccgcacccccgcaaagagaccaaaaccctagccgtcaccccgtaacctcactggcggccatggcgttctccggcaggatcaagcagctcgtgaagaagtacggcaaggtggccgcgggcgtccatctatccgtctcctttgcctccatcttcggcctctacgctgccatcaacaacaacgtcgacgtcaaagccgtcttccggagatttggcatctcccccggcgttgccgtcgacggggaggcctcaccctcacccgcccctgtctcccgcgatgagcacctgcaacacgcctccctaccgccctgtcctagtgaggtactgcaagaagagtcggagcagcagcagccccgcaacaggacgatggagctcgtggcgttgagtggaggccagctcgggctcacgctactctgcaacaaggcactgttgcccgtgaggatccccatcactatcgtgctcacgccggcccgtcgccagggcccttagccagctgggagctcgggctagaggctgatttggggaagtccggtttcccgctttcggaaaggccctctgttcgggttaag

SEQ ID NO: 57884 - protein, 141 aa, Zea mays
  misc_feature: Ceres CLONE 1509204
MAFSGRIKQLVKKYGKVAAGVHLSVSFASIFGLYAAINNNVDVKAVFRRFGISPGVAVDGEASPSPAPVSRDEHLQHASLPPCPSEVLQEESEQQQPRNRTMELVALSGGQLGLTLLCNKALLPVRIPITIVLTPARRQGP

SEQ ID NO: 57885 - DNA, 677 bp, Zea mays
  misc_feature: Ceres CLONE 1509252
  misc_feature: Encodes the peptide sequence at SEQ ID NO. 57886
  misc_feature (326)..(326): n is a, c, t, g, unknown, or other
tcccccgggctgcaggaattcgcacgagaccattacctagaacatcctaatcgaaaaaatataatggagaggaagaccaaaatggtgcggagcaatgcaactactggaggtgctcggaaaaaaaagggtgggcatgtaagacaatcaagtgctactcatgatgccattgataaaaattatagtggcagttcacctgaaggtttaaggaacaagagacagaagtctgctgctcaaagcacttcggtaggcagaagggaagggttgaggcaactatctgatgccaagcaacatccagatgcagcccaggggcagtacaaaaccactcnctaatctacccaaaaaccaacaaccaactcaaggttcaatggacctgtggagccccccctcctccaaccgaaataaaaccaatgggtcaggaaaaatactgttcaaggacatccattgaacaaggaccacgatggctgagatggctttatggcgaaaaaagtgatcaaatggggactcttgttaagccttcctgacaccatgattcgcgtcccacccccgggtgatgctttccgggaaaaagggggacaatggtttccaagcagattcctgaagctggattgggattggtggaatctctgccaaccggcccggggaaagggcgtaaaagatacaaaccacaccgataattg

SEQ ID NO: 57886 - protein, 108 aa, Zea mays
  misc_feature: Ceres CLONE 1509252
SPGLQEFARDHYLEHPNRKNIMERKTKMVRSNATTGGARKKKGGHVRQSSATHDAIDKNYSGSSPEGLRNKRQKSAAQSTSVGRREGLRQLSDAKQHPDAAQGQYKTT

SEQ ID NO: 57887 - DNA, 677 bp, Zea mays
  misc_feature: Ceres CLONE 1509264
  misc_feature: Encodes the peptide sequence at SEQ ID NO. 57888
aagctggagctccccgcggtggcggccgctctagaactagtggatcccccgggctgcaggaattcgcacgagaccattacctagaacatcctaatcgaaaaaaaccaagtagcgtctagggttttagcctctccaaccgcacgatggacaccgacgcgagaaggcagggggagagaaaatggcgtatttgtcccgcacagccgccgccgtcgccgtcgccgtgaggtcggcggtccgctccgcacctctcactggccgcgtcctcggagcgccactgccttcccttgcctcgccttccgctgcccggtccgcccgaatcctccgcaggacggcggccgcggcgtcggcggggctggagactctaatgccgctgcacagcgcggtggcggccgcgcggcttaggtcctgcatcgccgtcgactcctcgtgctggagctcgctctcgcaaggtttaaacaagcgcatctgatcatggctaggagctgagcacagaagagaagatatgctttgcctttatgagaggagaggcgcacctgaagaaaccaatgaacattaggaattacaaacaagggctgtaataatgtgattgctgtaaactaattttacctttgatgttcattgaatcatccacagatgtacaactggcatttgttgacgttgggattttatttacgtgg

SEQ ID NO: 57888 - protein, 96 aa, Zea mays
  misc_feature: Ceres CLONE 1509264
MAYLSRTAAAVAVAVRSAVRSAPLTGRVLGAPLPSLASPSAARSARILRRTAAAASAGLETLMPLHSAVAAARLRSCIAVDSSCWSSLSQGLNKRI

SEQ ID NO: 57889 - DNA, 566 bp, Zea mays
  misc_feature: Ceres CLONE 1509288
  misc_feature (472)..(472): n is a, c, t, g, unknown, or other
aagctggagctccccgcggtggcggccgctctagaactagtggatcccccgggctgcaggaattcgcacgagaccattacctagaacatcctaatcgaaaaactcgccctcgtccgcagcgcccacgaaacgcgccgccgccgccgtgacatcgcagcggacgtcgtgcgtcgtctcggccgctccccgccgtagggccattttcgctcgagctgccggagaccatgtcgagcggtctagacatgtccctggtacgacctcatcaagcaggtcgtacgtcccgaccctagggaccaaaccccgcgtcctcgtcggggcctgtccgccgcgcggaccccgatcgcgccgcgtcctaccaaccggttgctcccaggttaccccgcgagagcccctggacccttccttgccccgggggttacgtccgccacaaaaacccttaaaacccccccggccggccggggcctttttaccncccccccctttccccttcccaggggcccgggtgccacccggcggaattccccccttttggggggggttttattttcccgaaacaaaaattttcc

SEQ ID NO: 57890 - DNA, 626 bp, Zea mays
  misc_feature: Ceres CLONE 1509290
  misc_feature: Translation starting site: 139
  misc_feature: SWISSPROT Homolog: EC 2.5.1.18 Glutathione transferase
aagaacgtcaataaaggatcccccgggctgcaggattcctcacgagaccattacctagaacatcctaatcgaaaaatcacccctcgttgtcatctcatatcctgagccagagatcaaagaaaccagagggagcgaggcatggcagcaggcttgcaagtgtttggccagccagcgtctactgatgtctccagggttctgacatgcctgtttgagaagaaactggagttcgatcttgtccgcatcgatacattcgagacgcatcacaagcttcccgagttcatcaggcttcaggatcctaatgggcaagtgaccttgaagcacggcgacaaaactctcgttgattcgagggacatctgccgggacgtctgcacccagtttccaaacgatggaaacaagaccctttacagatccggcgctctagaacgggcgtcgatagaacagtggcttcaagcggaggctcaaaacttcaggccccccagctccgcgctcgtcttccagctggcgttcgtccctcacctcactcacctggagggttcgtcaggaccctgccgtgatcgccgagaacgaggataagctgaagcaagtccttgatgtctacgacgagatacctctcgaagaacgagtac

SEQ ID NO: 57891 - DNA, 794 bp, Zea mays
  misc_feature: Ceres CLONE 1509292
  misc_feature: Encodes the peptide sequence at SEQ ID NO. 57892
  misc_feature (11)..(11): n is a, c, t, g, unknown, or other
  misc_feature (794)..(794): n is a, c, t, g, unknown, or other
ttttattatangccgccgcacggagcaaacacataaaaaaaggcgggggggtctcaaactggagctccccgcggtggcggccgctctagtctagtggatcccccgggctgcaggaattcgcacgagaccattacctagaacatcctaatcgaaaatcccaccaccaccttcctcctctgcccccgcccagctcgttccattttgaagaagcaagaaacagcagcgcgcacatctcgctgctcgacgtcgtcggaggaagaggcgagggtgatggagcggcggagggctgcatgggccgcggtgctggtggcggtggccgcgttcgcggcgctgccggcgaatacgacggcgaacaagatcaatgtcaactggttgcccaacaccaactactccggctgggagcaagagcacaggcccttctacaagggcgactggataaagctccactacaccgcagggcaggtggacttggtggaggtgaacggttccgggtgcgtaccggagcgacgccggaaacgccgacgtatagtgacggtggggccgcctcctttcccgctcgaggttaacgagaccaatacgcttcctccttaatattcaatatatcagggctacagacctcgggcgggtatgcacccctggcacattatagtatccgattaaacgtgcccgacaccccgtcgacctaaccggactctatcttcactcactttccttgtgggcttaccttcgattcgcgggggctcggggacaccggccgcgatcacggtatgttctcaaccacacttgttcacgcn

SEQ ID NO: 57892 - protein, 106 aa, Zea mays
  misc_feature: Ceres CLONE 1509292
MERRRAAWAAVLVAVAAFAALPANTTANKINVNWLPNTNYSGWEQEHRPFYKGDWIKLHYTAGQVDLVEVNGSGCVPERRRKRRRIVTVGPPPFPLEVNETNTLPP

SEQ ID NO: 57893 - DNA, 683 bp, Zea mays
  misc_feature: Ceres CLONE 1509308
  misc_feature: Encodes the peptide sequence at SEQ ID NO. 57894
gatagctggagctccccgcggtggcggccgctctagaactagtggatcccccgggctgcaggaattcgcacgagaccattacctagaacatcctaatcgaaaaagcgagaaggcagcagccgccagcaaccagttcgtcactgcctaaacctaacctaatccattagcagttcggcactgcgggtctacggcggccggcggcagcagtactacggagcccccagccagccccaggttgcggcagcggcagcaggtggccaggttgcggcagcggcgccctgggacctggtcggccgaccctgctcgagtgctcggcgtcacagcttctcctttctacgtgcagcggttcacaggttcaggcattcagcgccacgccgccgtcgcccccaagccagtgttcagcgctcagggtgccttggaagtacgctagcttgttgtcatgaagaagtcattcaagttccttccactgaagttggtgcataaggctgcaacaccatctagtggagggtgttctggacaaagaaagcttgtaccttaaaataggaggatacaagaagctggagtggttgtctgaaggcttttgaactgcttgaagcattagtgtagctttggtgcttttgtgactgatcaactctggagcagctagagtgatatagttgtgggcttttgacaatagttggagt

SEQ ID NO: 57894 - protein, 32 aa, Zea mays; identical to SEQ ID NO: 44793
  misc_feature: Ceres CLONE 1509308

SEQ ID NO: 57895 - DNA, 703 bp, Zea mays
  misc_feature: Ceres CLONE 1509310
  misc_feature: Translation starting site: 192
  misc_feature (223)..(223): n is a, c, t, g, unknown, or other
  misc_feature (228)..(228): n is a, c, t, g, unknown, or other
  misc_feature (325)..(325): n is a, c, t, g, unknown, or other
  misc_feature (326)..(326): n is a, c, t, g, unknown, or other
  misc_feature (327)..(327): n is a, c, t, g, unknown, or other
  misc_feature (328)..(328): n is a, c, t, g, unknown, or other
  misc_feature (329)..(329): n is a, c, t, g, unknown, or other
  misc_feature (360)..(360): n is a, c, t, g, unknown, or other
  misc_feature (361)..(361): n is a, c, t, g, unknown, or other
  misc_feature (402)..(402): n is a, c, t, g, unknown, or other
  misc_feature (406)..(406): n is a, c, t, g, unknown, or other
  misc_feature (420)..(420): n is a, c, t, g, unknown, or other
  misc_feature (453)..(453): n is a, c, t, g, unknown, or other
  misc_feature (468)..(468): n is a, c, t, g, unknown, or other
  misc_feature (469)..(469): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (504)..(504): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (562)..(562): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (583)..(583): n is a, c, t, g, unknown, or other
  misc_feature (593)..(593): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (675)..(675): n is a, c, t, g, unknown, or other
  misc_feature (680)..(680): n is a, c, t, g, unknown, or other
  misc_feature (701)..(701): n is a, c, t, g, unknown, or other
  misc_feature (702)..(702): n is a, c, t, g, unknown, or other
atagctggagctccccgcggtggcggccgctctagatctagtggatcccccgggctgcaggaattcgcacgagaccattacctagaacatcctaatcgaaaaaccacgcaatcactcccgggccgccgccgcaggcgcctccgcgaaaaaccctagcagggttcgccgctatcactccaaggggcgcgaccatggcggccacaaagaagacgaagaaactccnatcgngtaacgatacccttcaaaataaaccaaaggctgacagcccttgcttattgaaaggaaatggcccaagttcccctctttggggggggcccaaaaaaannnnnccgcccgccgggactcttcttcaaaaaattnnttttttttgggcccacccacaccgaatggggggtgaaaaanattncccccccccccaanaaaaaaaaaaaaaaacgggccccccgcccgccncccccccggggtcgnnnnntgggggggtgtggtgcggccgcccccccgggntaaacactnnnaaaaaaagaaaaacaaacaccacccaccgcnnnnccccccacaaccncaccnnnngaaggagaggagnggttgggggngccnnncccacccccccccnnnnnnnnnnnnaagcgtctagagaaaaaannnnaagggaggggggggtgtgggggcgcctgngcgtngggaggcccccccgccccccnna

SEQ ID NO: 57896 - DNA, 677 bp, Zea mays
  misc_feature: Ceres CLONE 1509312
  misc_feature: Encodes the peptide sequence at SEQ ID NO. 57897
  misc_feature (48)..(48): n is a, c, t, g, unknown, or other
catagctggagctcaccgcggtggcggccgctctagaactagtggatnccccgggctgcaggaattcgcacgagaccattacctagaacatcctaatcgaaaagtctttcggtattcgccttgacacgcagactaggcgccagccttctgcgaactgtctctacccttgacgaaggaagaggcagccttctcaccgtcgcacccggcgatgcagcggcacgtcgcctccggccggccgtcgggcacggacggctccgacttttcttaccgcatggtcgtcgaatcccggtaccagagggtcgccgagggcagatcccgcctcgcgcgcctcatcctcgtgcaggcgctgcacctagtggccggaggcttgcttctattgctggcggtgtccaagggggcggcggtgaacaagttcccccccctgtccatggccgcgggattcctggctatagtggtgggggaattagggcgaatgcggaccatgtcaatgctgctccggctctacacaagcttggtatcaattgcagatgccttctctgtgacgtgcattatccggtcagagttgtcctctaaggttatgaagcagaaccctgaggccatcacgagctacgaaatgcttgatgcgggccgtgttgccctggtatcccgctgcaaaggggggttaagctacaactccg

SEQ ID NO: 57897 - protein, 156 aa, Zea mays
  misc_feature: Ceres CLONE 1509312
MQRHVASGRPSGTDGSDFSYRMVVESRYQRVAEGRSRLARLILVQALHLVAGGLLLLLAVSKGAAVNKFPPLSMAAGFLAIVVGELGRMRTMSMLLRLYTSLVSIADAFSVTCIIRSELSSKVMKQNPEAITSYEMLDAGRVALVSRCKGGLSYNS

SEQ ID NO: 57898 - DNA, 825 bp, Zea mays
  misc_feature: Ceres CLONE 1509315
  misc_feature: Encodes the peptide sequence at SEQ ID NO. 57899
  misc_feature (41)..(41): n is a, c, t, g, unknown, or other
agagctggtggggggatggggggtggggggcggatgcgggnggggggggagattatgcaaactgggactccaccgcggtggcggccgctctagaactagtggatcccccgggctgcaggaattcgcacgagaccattacctagaacatcctaatcgaaaaacctgataatcatttctgggatcatttctcaggtcgcgcagcaaagtagcaaactcctgcgaccctacccaccgcacctaccattctggagaggagaggaacagagccaagaaacatgcccggaagatggcaggcggtggggtggtgaaagcacatcctgctggctagcttccaggatgaggggacccaggagcgcctggtcgagctcgtcctcggataagagagcgctcggcggggggggcccctccaagaacgaccttccaactggggaaatggatgggaggctagaaaacatggtacctaagggttactcgcactgctttcttagtcccaccttttggagaagccccgtaggggaactgaaaggagatacgagttggattaccctctgtcgcaacggggcgcattgtgcggacgtgttgtgtctttggcctgggagcttgtgagatagtgtctctccccaagtgcaggttagaagaattggaaagtttggtaataatttagcgatgaaagaaacattaacatcatatcgcctcgaaccactcgcgagagagaaccaggtggtgaggtaactgactattctttgtttggcgcgactggatggctgcttttcattctttatggtaccacctgtcggccacatgtgggcgcgtagctgcgtggcc

SEQ ID NO: 57899 - protein, 46 aa, Zea mays
  misc_feature: Ceres CLONE 1509315
SWWGDGGWGADAGGGGDYANWDSTAVAAALELVDPPGCRNSHETIT

SEQ ID NO: 57900 - DNA, 662 bp, Zea mays
  misc_feature: Ceres CLONE 1509318
  misc_feature: Encodes the peptide sequence at SEQ ID NO. 57901
atagctggagctccccgcggtggcggccgctctagaactagtggatcccccgggctgcaggaattcgcacgagaccattacctagaacatcctaatcgaaaaacagcagccgtttccactgacagtttctcagaaccacagcctcgatccatcgggggagaggatgggagagcctacgcggcaggagctggcggaggcggcgctcgccggggagtcggcggagcagcgcaaccgcttcctggtgctgcggctgtacgaggcgctcggctcctgcgacgcgcgccgggcgcggaagctgctggcgcccgacctcgagtggtggttccacggcccccccacgcgccagcacatgatgcgcctcctcaccggcgcggaccaccagcgccacatgagcggcggcggcggcggcgggttcgccttctccccgcgctccgtcgacgccttcgggtccaccgtcgtcgcggagggcggcgctgacgacgcgcgccagctctactgggtgcacgcctggaccgtggggcccgacggggtcattacccagctcagggagtacttcaacaccgacctcaccgtcaccctcctcgccggcactgcctccgccaagaaagctgctccgcctaagaagcagcaggacgctgcctcttcttctacctcctcctcct

SEQ ID NO: 57901 - protein, 166 aa, Zea mays
  misc_feature: Ceres CLONE 1509318
  misc_feature (64)..(165): Pfam Name: WI12 Pfam Description: Wound-induced protein WI12
MGEPTRQELAEAALAGESAEQRNRFLVLRLYEALGSCDARRARKLLAPDLEWWFHGPPTRQHMMRLLTGADHQRHMSGGGGGGFAFSPRSVDAFGSTVVAEGGADDARQLYWVHAWTVGPDGVITQLREYFNTDLTVTLLAGTASAKKAAPPKKQQDAASSSTSSS

SEQ ID NO: 57902 - DNA, 570 bp, Zea mays
  misc_feature: Ceres CLONE 1509319
  misc_feature: Encodes the peptide sequence at SEQ ID NO. 57903
caaagctggagctccccgcggtggcggccgctctagaactagtggatcccccgggctgcaggaattcgcacgagaccattacctagaacatcctaatcgaaaaccttcagacgagcgagcgagccaccgagagagagggcgagagtgagtgagtgagagggagagtgagagtgggggattcaagtttcaaactcactatcgagggggataggaaggtggtcatcggtccatagctagctcgtcgtcgaccatggctgactggggccccgtggtgatcgcgacggtgctgttcgtgctgctcacgccgggcctgctgttccagctgccggcgcacggccgcatcgtcggcttcggcaccatgcacaccagcggcatcgccatcctcgtccacgccgtcgctctacttcgcgctcatcaccatctcctcatcgccatcggcgtccacatctacgcccgctagctagggtgtcgtctagtccacaccccttcggctcctcctccatcatcggcctctggtcctcggcagtacaattaggcacaactactcccagggactactactactaggct

SEQ ID NO: 57903 - protein, 69 aa, Zea mays
  misc_feature: Ceres CLONE 1509319
MADWGPVVIATVLFVLLTPGLLFQLPAHGRIVGFGTMHTSGIAILVHAVALLRAHHHLLIAIGVHIYAR

SEQ ID NO: 57904 - DNA, 691 bp, Zea mays
  misc_feature: Ceres CLONE 1509325
  misc_feature: Encodes the peptide sequence at SEQ ID NO. 57905
  misc_feature (691)..(691): n is a, c, t, g, unknown, or other
caaagctggagctccccgcggtggcggccgctctagaactagtggatcccccgggctgcaggaattcgcacgagaccattacctagaacatcctaatcgaaaaacacaaacagaaaactgagtcagagaggtgcagatcaatgcggcggtggtggtgcgccgccggcggcctcgcccgctgcgtcctctcgtcctccacctccgccatagcatcccatgcccgcccgctgccggcacccctgatgcccaaatctccctcctttaccgtccctttctccttgtcctgtcgcaggcaccactctctccagggattcttccacctggtcatcgcttcttccttccgccctccgtcggcgcatcatcagcaagtgcggcactacgccaagaaggagaggtcgcgcgctccgctcacgccccctaaatccaaagtcaagaaatacaagatgaaggccccctcgtccatgaagttcaaattcagaacccatgaaagacggaccgggccgccaggtggaggggccggcaagcgccccaatgcccccctcaagtcctaaggaggccaaacgggaaacttcggaaaggctggctttgggggcttttggccctaccccaaaggttttataaaaaaccttcaccttctcgggggggggcaaaatcaattaaaacaccttaccgggaatttgtgccttgggan

SEQ ID NO: 57905 - protein, 29 aa, Zea mays
  misc_feature: Ceres CLONE 1509325
MKFKFRTHERRTGPPGGGAGKRPNAPLKS

SEQ ID NO: 57906 - DNA, 664 bp, Zea mays
  misc_feature: Ceres CLONE 1509327
  misc_feature: Encodes the peptide sequence at SEQ ID NO. 57907
ctccccgcggtggcggccgctctagaactagtggatcccccgggctgcaggaattcgcacgagaccattacctagaacatcctaatcaaaaaaatagaacatcaagtttagattcttgttcacgcgttcaaagatgcgtggggaaaacaacatagtcctccttctcctcctcctgtttgctgtaatttctccgaaccaagtaattggtagtgcttgtactccggaacagaaggctgccatcctaaatcaatgcgaagagtacatcaagcctggatacccccttatactgccatcgtacgccagtgtgtgttgcgacaaggtgagagatgtgccaaatagggacatgaactgcatcgtcgatctgctcacgcctccagagaaggcgaaacacggtgtcgacaagataaaacgtctgaaagatctctgcgacaactcgcctcatcatcaggtgggggggtagacagacagcagctgtcattgctaatggaattcggaggcaagatatattgggctagtaaattatattcttcgatcaaagcatgacaacttgtccaaatgtaccttttggattaggtaaagggttctcacgaaaattaaagaaaaaagctttttttgatttccccgtcttatcctccaaagggggggggtcccgggtatcccaatt

SEQ ID NO: 57907 - protein, 108 aa, Zea mays
  misc_feature: Ceres CLONE 1509327
MRGENNIVLLLLLLFAVISPNQVIGSACTPEQKAAILNQCEEYIKPGYPLILPSYASVCCDKVRDVPNRDMNCIVDLLTPPEKAKHGVDKIKRLKDLCDNSPHHQVGG

SEQ ID NO: 57908 - DNA, 638 bp, Zea mays
  misc_feature: Ceres CLONE 1509328
  misc_feature: Encodes the peptide sequence at SEQ ID NO. 57909
  misc_feature (322)..(322): n is a, c, t, g, unknown, or other
  misc_feature (420)..(420): n is a, c, t, g, unknown, or other
  misc_feature (421)..(421): n is a, c, t, g, unknown, or other
atagctggagctccccgcggtggcggccgctctagaactagtggatcccccgggctgcaggaattcgcacgagaccattacctagaacatcctaatcgaaaaatctgttcccatctcttctgcctccgtctcaatctcgaccggtcaccccatctccaccgccacatccgtcgtcttccgccgccgccgatggcccgcctcctcacgcaaaccctcaccctagcccgccccgcctcctccccctccactaccgccgcatccgacttccctccgtggcctcgccaccaaggtcgagatcatcgagatcgatctcgccgagggngacgctggctcctcgtccacgggtccccctcctcgtccccgtcggtcaaggcggtcgggatccggcgcctgggaggaaggcatcaacggggtcaatgnncccccaacgcgcgcccggaatggtttcccttcctgcccgggaagggcccttttggggggccccccgtgggcccccccccaagggggccccccaaactttttttggcgggaatcccggcctgcgggggggcccccaaaaggggggcccccggggccctttgggggggccccccccaaaaaatctttgaaatcctctacccccccccaaaaaagaggag

SEQ ID NO: 57909 - protein, 149 aa, Zea mays
  misc_feature: Ceres CLONE 1509328
  misc_feature (45)..(45): Xaa is any aa, unknown, or other
  misc_feature (77)..(77): Xaa is any aa, unknown, or other
  misc_feature (78)..(78): Xaa is any aa, unknown, or other
MARLLTQTLTLARPASSPSTTAASDFPPWPRHQGRDHRDRSRRGXRWLLVHGSPSSSPSVKAVGIRRLGGRHQRGQXXPNARPEWFPFLPGKGPFGGPPVGPPPRGPPKLFLAGIPACGGAPKRGAPGALWGGPPQKIFEILYPPPKKR

SEQ ID NO: 57910 - DNA, 636 bp, Zea mays
  misc_feature: Ceres CLONE 1509330
  misc_feature: Encodes the peptide sequence at SEQ ID NO. 57911
aaagctggagctccccgcggtggcggccgctctagaactagtggatcccccgggctgcaggaattcgcacgagaccattacctagaacatcctaatcgaaaaaacataccactgcactacagcaggttgcccagttctgcacccccttcttccttctctcacttgcattgcacaccgaaaacctcttcttcgtcaggcaggcatgaagcttggaggacaagggaggcagatggggaggctcaacagggccttcagggagaaaagggcaaggttctacattttccgccgctgcgtcgtcatgctgcttcgctggagcgattagatattggtctccatgggagatgacttcccctccattctagatgttttttatttctttagtttggagctagtatccattttggtagagttctagaatctacgcgtagttgctcacttgctctgtacaggatggccggacgtgtgctggttcgagtggcaatcttttttagattctttgcttgcatgttgtttcaggcaagggtgactgatccagctctgtggtctgagatcgccataatttgtactgctgaaagagattcgtatgaaaatatgcttgtgttaacggtgatgattgtgccatgaaatcatactttg

SEQ ID NO: 57911 - protein, 39 aa, Zea mays; identical to SEQ ID NO: 45736
  misc_feature: Ceres CLONE 1509330
  misc_feature (18)..(36): Pfam Name: DVL Pfam Description: DVL family

SEQ ID NO: 57912 - DNA, 703 bp, Zea mays
  misc_feature: Ceres CLONE 1509334
  misc_feature (369)..(369): n is a, c, t, g, unknown, or other
  misc_feature (370)..(370): n is a, c, t, g, unknown, or other
  misc_feature (372)..(372): n is a, c, t, g, unknown, or other
  misc_feature (375)..(375): n is a, c, t, g, unknown, or other
  misc_feature (377)..(377): n is a, c, t, g, unknown, or other
  misc_feature (703)..(703): n is a, c, t, g, unknown, or other
ctctagaactagtggatcccccgggctgcaggaattcgcacgagaccattacctagaacatcctaatcgaaaacaaggtactgcggctgcgcgcgaggggtcgtcggacgaccgacgaggacgagcggcataggcgcgtgcatggcgctcacgaacttcatcctcacggtggtgggggtgggcgcgacgattatgctgctgcggaaagacgtcagccgtcggcccccgtcttctgcccaacttgcgccacatccgctactgcctcgaggaagagtccgcccccgccaccaaatcttttttactgtcgttcgggaaagagggggaatccttttttttttccccccccccagaggggaaagaaagggggtnntnccncnttcttccccccccccccccccaaaattaaaataataaagtacttctctcccgacctccgaactgcccccccccacaccattttttttcgtctgtctggtctccttatggtttccgcttcctgtcctcgtacagcaagcgacacactcctcgtgccgcccacttaccttgtgtaatactcctacctcgtcactctctccatcccttcttggtccttgggccccttttccgcctcccccactcctcccactcactggtctgcgcccctcctctgcgtccttctgctccgtcttgtcgtgcaccacctcgggctggtcgcgtcttcgtn

SEQ ID NO: 57913 - DNA, 642 bp, Zea mays
  misc_feature: Ceres CLONE 1509335
cccccgggctgcaggatccccacgagaccattacctagaacatcctaatcgaaaaaaaacaaacctcaccgagtcgcaactcgcaaggacagtgaaaacgcccaaacgagcgcgggcacgccaaccaaagcggcgaagcgcgaaggaaggaaggaaggaagcaagcaaagcagcagccatggggcttgactactacaagatcctgggcgtcgacaagggcgccaccgacgacgacctctagaaggcgtaccgcaagctcgccatgaagtggcaccccgacaaggaaccccaataacaagaatgatgccaagaacaagttcaagcagatctccgaggcatacgatgtcctcagcgacccgcagaagcgcgcggtgtacgaccagtttcgctgaggaggggctcaaggggcaggtgcccgccgtcagatctccggcagggcggggctcatactgctgttttaccgggcgggtattgggtctaactgtgttaccggggtttcacccgtgtgagcgttagatggagatcctcggccggagtgtattgggggatcttctagacctctttctgcgggggtaatattcgggagttcggttataccccgggacctaatttcccggggtgcggtataaaaatttctcgcgt

SEQ ID NO: 57914 - DNA, 699 bp, Zea mays
  misc_feature: Ceres CLONE 1509336
  misc_feature: Encodes the peptide sequence at SEQ ID NO. 57915
ataagctggagctcaccgcggtggcggccgctctagaactagtggatcccccgggctgcaggaattcgcacgagaccattacctagaacatcctaatcgaaaaaacaccacagtacaactacaatccgaagatatgcatctcagccacgcaaagtcctgcagctacagtgctgcttggagcgagcctcttgcctgccgctacaagccaactactctaacacatacgctcatatgggagcaactgagatggcctccatgagacccctcgcctccgccaccccaagcacgcgtgtcgctttccctgtacagctgctgctccgaacttctgctgactcaactcgtcatagagccttccctattgaccttgaggtccagagcgaccactccgtcgccgatgcaaaggaggaggtagtgccagccaccgccgcggagacaaaaacctagaagcgcttaccaactaccccatgctgagaaaagctcatcgcctaaaatgcccggggtccccaagcctttatacggcccccctcgcctatgtgggggttaaccgggaacccctcccccccaagggaaaccacaaagaagggggctttcgatctccaccggccggggcaacggtaaccggggacagaacaagggtgttcgggggctctccggcagcctggagatgctgaaaatcgccgcccgcatgagctcccccct

SEQ ID NO: 57915 - protein, 70 aa, Zea mays
  misc_feature: Ceres CLONE 1509336
MGATEMASMRPLASATPSTRVAFPVQLLLRTSADSTRHRAFPIDLEVQSDHSVADAKEEVVPATAAETKT

SEQ ID NO: 57916 - DNA, 781 bp, Zea mays
  misc_feature: Ceres CLONE 1509341
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (781)..(781): n is a, c, t, g, unknown, or other
gcggggacgaggggcgacggnnnngggtggggggggtgggggagggggcgggaaaaacaaagcgggactccccgcgggggaggttgatcgttcatagtggatcccccgggctgcaggagtgctacgagaccattacctagaacatcctaatcgaaaaacaaccgcagtacacggcgtatcattcccagcgaccacgagagactagctagccaagtgcatgcaaccagccatgcaggccgggaagacggcagtggaggcggacgaacgaggccgcggccaacgtcggggcctcggcgaacggcggcatgcagaagacccgtgccgccgtgcaaggccgggaggagaagggcgccgcgagcgacgggcgcggacagggggggggttggaggagggcccgcggagagcgcttgtcccctcgaggaactggaaaaaaagggaggcggggggggccaacggccgcccaccaggggggggggggggataggcggcgcgcttatctgttcccccggggagccggcgggcagaaggggcgcgcccgggggaacggggggggcggcaagggggttgggcgaaaagagggggggatgccacggggcaccgtggatgggcggggccccagggggggggggaaacatggtgtcgcatgttgggggggagaaatgtgggtgggcaccggtgtggcttttgccccattgggaaaaatgggtgttggggcaaatgggtgaatggtgaaacagactaggtgggggccaaaacggagggggagtgggggcgaacaaan

SEQ ID NO: 57917 - DNA, 651 bp, Zea mays
  misc_feature: Ceres CLONE 1509343
  misc_feature: Encodes the peptide sequence at SEQ ID NO. 57918
ctccccgcggtggcggccgctctataactagtggatcccccgggctgcaggaattcgcacgagaccattacctagaacatcctaatcgaaaagccaaaccctagccgccgagtgccgcccaccgcccgcccgccctccgccgcgcgtcggacggtgccgagggaagaggcaccatgaggttggagaagtgctggttctgctcctctaccatctaccccggccatggaatccagttcgtccgcaacgacgccaaggtcttccgcttttgccggtcaaagtgccataaaaacttcaagatgaagaggaaccctcgtaaggttaagtggacaaaagcatacaggcatttgcatggcaaggacatgacccaggatacaacctttgagtttgagaggaagaggaacaggcccgagcgctacgaccgcaatttgacggagcagactctgaaggctatcccgcttattgcaaagattaggcatgaccgtatgggaaaacacatctcaaacagacataaaccttggtaaacgcaaggagatggaaaaggactccaagggatttggagcaggtaatcggcatgctccccgaagaagcttattattcaaccatctcgcgttttgagaaaacgaaggtcaagggttgaagtttgtcatcagc

SEQ ID NO: 57918 - protein, 115 aa, Zea mays
  misc_feature: Ceres CLONE 1509343
  misc_feature (1)..(71): Pfam Name: Ribosomal_L24e Pfam Description: Ribosomal protein L24e
MRLEKCWFCSSTIYPGHGIQFVRNDAKVFRFCRSKCHKNFKMKRNPRKVKWTKAYRHLHGKDMTQDTTFEFERKRNRPERYDRNLTEQTLKAIPLIAKIRHDRMGKHISNRHKPW

SEQ ID NO: 57919 - DNA, 622 bp, Zea mays
  misc_feature: Ceres CLONE 1509346
  misc_feature: Encodes the peptide sequence at SEQ ID NO. 57920
gctccccgcggtggcggccgctctagaactagtggatcccccgggctgcaggaattcgcacgagaccattacctagaacatcctaatcgaaatgaagagactcttccgtgacttatttctccgcaaggggtaccaactagattatgtatttgactggaccattatgaagtatcctcagtttagagataaaaacaaatttcagtctagcggcaagactagtgggttggcaggcccttctgcagaaaggaccaatagaactgcagctgaagctttgtttagaagaactagatccggttccggtcacaatcgagaacacaccaagcacagaagtcttctagagtcactgatgccatccaagactgttgattcggataaaataaggccatcgtcatcatcgcgcaatggaagcacgtcaagaagagctgtgctttcatcaggcaaaccaagctcttcctgagattcaagcgacccaaaccgcgtggggcgccttgggccccaagtaacagcatacccccattggaggccccaaagggccattcttccgggggaaacaaaaacaaaacctttttttgggcaaaaaagggaaaggccttcccctggatgaaccctttccggaaacttg

SEQ ID NO: 57920 - protein, 121 aa, Zea mays
  misc_feature: Ceres CLONE 1509346
  misc_feature: SWISSPROT Homolog: EC 2.7.11.1 Non-specific serine/threonine protein kinase
MKRLFRDLFLRKGYQLDYVFDWTIMKYPQFRDKNKFQSSGKTSGLAGPSAERTNRTAAEALFRRTRSGSGHNREHTKHRSLLESLMPSKTVDSDKIRPSSSSRNGSTSRRAVLSSGKPSSS

SEQ ID NO: 57921 - DNA, 663 bp, Zea mays
  misc_feature: Ceres CLONE 1509353
  misc_feature: Encodes the peptide sequence at SEQ ID NO. 57922
  misc_feature (661)..(661): n is a, c, t, g, unknown, or other
  misc_feature (663)..(663): n is a, c, t, g, unknown, or other
atagctggagctccccgcggtggcggccgctctagaactagtggatcccccgggctgcaggaattcgcacgagaccattacctagaacatcctaatcaaaaacactcgtctcctcttcccctccctcgcctcaaaacaaggaagggagcagatggagccgcatcattaaaaaaggacacggaaacttaatccgatccaccaaacaaaaatccctgtctctcgcgcagggcaccgccacgcgcgcctcatccggtaccgccatgacgagcgcctccgagctcttcatcgcgcgccgcgccgcccgtggggcccgcctctccgaccccgacccggacccggacccggacccgcaccccgtcgcgctccgggaccagcatggactcggcggccggcgccagcaccgcgggtgccgtccgcgacgccagctcgacgccaccggggacgtgagccagcacctgcacaccggggccccgccaccgcgtcgccgcggatcgtacaccgtgagaatccgtcgccccagtctccctcccgcttgattattgtcggatcagatgtgttgtgactggatcggagcatcaccggcgctggcttatacaattcgcggacactatgaggattatgctcgcgcggaatgtcatgatgaatggaaatgccgatttgngn

SEQ ID NO: 57922 - protein, 91 aa, Zea mays
  misc_feature: Ceres CLONE 1509353
MTSASELFIARRAARGARLSDPDPDPDPDPHPVALRDQHGLGGRRQHRGCRPRRQLDATGDVSQHLHTGAPPPRRRGSYTVRIRRPSLPPA

SEQ ID NO: 57923 - DNA, 657 bp, Zea mays
  misc_feature: Ceres CLONE 1509354
catagctggagctccccgcggtggcggccgctctagaactagtggatcccccgggctgcaggaattcgcacgagaccattacctagaacatcctaatcgaaaaatagatgagatcttccgtgggtagttgactacttaagtatgtgttggccctgctgctgatcctgctgccctctcctcttcggcttcgggagaatctatgtggaaaccgtgctggaaggagctacaacttcgacaccatatttctcgcactgggtgtgagctgcaacttacctgtaagcacgcctcaacgataattaacggaagacgatgacgcactgcgccctctgcaaaggaaacgtacgggctgcagggtgaaataacagaacatagctgctgcaaatgactacggtaattgctgctaggagaagatcaccccaccctaataccctgccatctagaaatacctgatccgatacggtgtctaaacccgagtctccagctacgactcccaagagccttcggccaaaaaaccctcccaggtcaaaatggagccgcaaaaagccgacccccccgatgaaaaccttgcataccgaatcggagaaccgtatgcggagccccatacaagttccgcgtcccccgccgaccgcggtcagaagtctaagtgaaccccggaac

SEQ ID NO: 57924 - DNA, 750 bp, Zea mays
  misc_feature: Ceres CLONE 1509363
  misc_feature: Encodes the peptide sequence at SEQ ID NO. 57925
  misc_feature (706)..(706): n is a, c, t, g, unknown, or other
aaagctggagctccccgcggtggcggccgctctagaactagtggatcccccgggctgcaggaattcgcacgagaccattacctagaacatcctaatcgaaaaatcaccaagttttggattccagcagcggcgcccccaggccaggccccacccgctcagcctcctcagctgcccaaccttctccccatctgctcagcctcagctgtcattcccgcgaagcgccgtctcccggctctatcgatggaccgagtcgccgccctcgtcgtcgcgctcctcgccctcttcttcgccgccggggccacggcgcaggccccggcctcgtcgcccaagcgcactccagggccagcgccacccaagaaggccttcctcccccccgccacccggcaggggggcctaatggacttctccgcacttcacctcccccaaaaagaacgggggaccggggtccctccacccggcaatgccggccaccaaaaccccgtccagaaaacagaaaactgcgggaaccaccgcgaatggcccccccctcccggaaccccccagagggacactagatatccgagacgtgccccgcacccggactacaaaaaaaaaaaggtcccctaaccacaaggggccacaacccaccgggccaacaagggctcacaaggaacaagcaagggccagggcggggaaaaaaaagcaggcgcgcgaatcaaaaaaaagngaggcccaacaacccacgagaccaactggggagactcacatggg

SEQ ID NO: 57925 - protein, 121 aa, Zea mays
  misc_feature: Ceres CLONE 1509363
MDRVAALVVALLALFFAAGATAQAPASSPKRTPGPAPPKKAFLPPATRQGGLMDFSALHLPQKERGTGVPPPGNAGHQNPVQKTENCGNHREWPPPPGTPQRDTRYPRRAPHPDYKKKKVP

SEQ ID NO: 57926 - DNA, 686 bp, Zea mays
  misc_feature: Ceres CLONE 1509373
  misc_feature: Encodes the peptide sequence at SEQ ID NO. 57927
aaagctggagctccccgcggtggcggccgctctagaactagtggatcccccgggctgcaggaattcgcacgagaccattacctagaacatcctaatcgaaaaaattcggatccgcctccatggctgccgcttcgcagctcctctctctgttcttcctcctcctcctccctgcttgtgatgccatctactgcgacgaagacgactgctacgacctcctaggggttaagcaggacgcgaacgcgtcagacatcaagaaagcgtactacaagctctctctcaaacaccacccggacaagaatcccgatccggagtcgcggaagctcttcgtcaagatcgccaatgcttacgagattctgaaggatgaatccactagggcgcagtatgactttgccattgaacatccggaggaggttttctataacacagctcagtactatagggcatactatggacataaaacggatcctcgtgcagtgttgattggtcttcttctaattgtttcagcatttcaatacattaatcagctaacgaggtataaccaggcgcttacttggaagatttgttggttttggagataccgggtaaagaaattaccatatacatgggaggatgcttgctacttgacctggatttcactccaaatacctgcgaatgcatggaaaaatatggatgagtccaggaaggag

SEQ ID NO: 57927 - protein, 189 aa, Zea mays
  misc_feature: Ceres CLONE 1509373
  misc_feature (28)..(89): Pfam Name: DnaJ Pfam Description: DnaJ domain
MAAASQLLSLFFLLLLPACDAIYCDEDDCYDLLGVKQDANASDIKKAYYKLSLKHHPDKNPDPESRKLFVKIANAYEILKDESTRAQYDFAIEHPEEVFYNTAQYYRAYYGHKTDPRAVLIGLLLIVSAFQYINQLTRYNQALTWKICWFWRYRVKKLPYTWEDACYLTWISLQIPANAWKNMDESRKE

SEQ ID NO: 57928 - DNA, 687 bp, Zea mays
  misc_feature: Ceres CLONE 1509375
  misc_feature: Encodes the peptide sequence at SEQ ID NO. 57929
aaagctggagctccccgcggtggcggccgctctagaactagtggatcccccgggctgcaggaattcgcacgagaccattacctagaacatcctaatcgaaaaaatgttcgttttttccccttgaagttctgctttgttctgtgacataagtgaggtactacatcgaaaaacgatctgattttatttttcaggtcacaaacctgaaaataccaatctacgatacagatctagaaaccacgaatacatattttgtcggggctaatagggaaaaaagaagaagatattctgtggcatcggaactctgtaacactgttggtttctgtgaatgcttcaggtaaggcaaggtaagtgacgagacaaagatggtgcaggaggagatgccgcaggcatggtggttcgacagccacaacctcgcgaggccgtcgccatggctgaacagcacgctctcagagctggatgacaagaccaagcaaatgctgaagctgatcgaccaagacgcggactcgttcgcccagcgcgccgaaatgtactacaagaagcggccggtgctggtggacatgctcggcgacctgtaccgcacgcaccgctcgctggcggagcagtacgacctgctgaagcacggcagcggcgcgcggcacacggtgttcggcctgtcctcctgcacacagagccggtcgtcgacgaacg

SEQ ID NO: 57929 - protein, 108 aa, Zea mays
  misc_feature: Ceres CLONE 1509375
  misc_feature (9)..(82): Pfam Name: KIP1 Pfam Description: KIP1-like protein
MVQEEMPQAWWFDSHNLARPSPWLNSTLSELDDKTKQMLKLIDQDADSFAQRAEMYYKKRPVLVDMLGDLYRTHRSLAEQYDLLKHGSGARHTVFGLSSCTQSRSSTN

SEQ ID NO: 57930 - DNA, 694 bp, Zea mays
  misc_feature: Ceres CLONE 1509393
  misc_feature: Encodes the peptide sequence at SEQ ID NO. 57931
  misc_feature (554)..(554): n is a, c, t, g, unknown, or other
  misc_feature (595)..(595): n is a, c, t, g, unknown, or other
aaagctggagctccccgcggtggcggccgctctagaactagtggatcccccgggctgcaggaattcgcacgagaccattacatagaacatcctaatcgaaaaattcctcggagagggagaagccgccgccgcagcaatcacagcagcccggagaaagcccaggtccgacaagatgcagatcttcgtgaagacgctgacagggaagaccatcaccctcgaggtcgagagcagcgacaccatcgacaatgtcaaggccaagatccaggacaaggaagggatcccgccggaccagcagcggctgatctttgccgggaagcagctggaggatggccgcacccttgcggactataacatccaaaaggagtctacgcttcacctcgtgcttaggctccgcggtggcatcattgagccctcgctgcaggcgctcgctcgcaagtacaaccaggacaagatgatctgccgcaaatgctatgcacgactgcaccctagggctgtcaactgccgcaagaagaagtgtggtcacagcaaccagctgagggcccagaagagatcangaactgaggtgctgctcctagtcagtttcatggacaatgtngggctgtatttgctgtgtggttgttgaaccgtgtttgtttacccacctttggggccttccgttatggtttaccctgggtgcgatgaccccataactaaa

SEQ ID NO: 57931 - protein, 149 aa, Zea mays
  misc_feature: Ceres CLONE 1509393
  misc_feature (6)..(74): Pfam Name: ubiquitin Pfam Description: Ubiquitin family
  misc_feature (77)..(128): Pfam Name: Ribosomal_L40e Pfam Description: Ribosomal L40e family
  misc_feature (128)..(128): Xaa is any aa, unknown, or other
MQIFVKTLTGKTITLEVESSDTIDNVKAKIQDKEGIPPDQQRLIFAGKQLEDGRTLADYNIQKESTLHLVLRLRGGIIEPSLQALARKYNQDKMICRKCYARLHPRAVNCRKKKCGHSNQLRAQKRSXTEVLLLVSFMDNVGLYLLCGC

SEQ ID NO: 57932 - DNA, 693 bp, Zea mays
  misc_feature: Ceres CLONE 1509398
  misc_feature: Encodes the peptide sequence at SEQ ID NO. 57933
caaagctggagctccccgcggtggcggccgctctagaactagtggatcccccgggctgcaggaattcgcacgagaccattacctagaacatcctaatcgaaaaagcccaaaccccgacgcgtccccacctccgtcgccgatgacaccgcgtgccccgcagcttcggcatcacccgccgcacctcctcctcgccgaggctgtcgcctcctggcaccccttccacaagaagccctgtctcacggaccgctccacggctcccccctcctcggcccgcctccctgatgcggagactccgacgcctgccctctcggggggcggtagcggcggatccttccggtggttcgggctccgcaagcggcgccgccgcggtccgggctcgcggtccgtgtccggccgcagcagcgaccgccagagatccggcacgtgctccgacttccatttcacgtgcggcgcccgtggtggtggcagctgcggcgccactgactccagcggggagatgtgggcgtcggatgtctcgggaggtgcggatgaaggacgtgccaatggcgacagaattcggcccgtcgcctgttggaggagttggtgtctggatctggtgcgttccgccctgcagcggaggcagcagtcaccgattctgaatatgtgagcgaacctgagtaccctggcgacgtgtagctgggatatggagatgaa

SEQ ID NO: 57933 - protein, 168 aa, Zea mays
  misc_feature: Ceres CLONE 1509398
MTPRAPQLRHHPPHLLLAEAVASWHPFHKKPCLTDRSTAPPSSARLPDAETPTPALSGGGSGGSFRWFGLRKRRRRGPGSRSVSGRSSDRQRSGTCSDFHFTCGARGGGSCGATDSSGEMWASDVSGGADEGRANGDRIRPVACWRSWCLDLVRSALQRRQQSPILNM

SEQ ID NO: 57934 - DNA, 707 bp, Zea mays
  misc_feature: Ceres CLONE 1509463
  misc_feature: Encodes the peptide sequence at SEQ ID NO. 57935
  misc_feature (707)..(707): n is a, c, t, g, unknown, or other
aaagctggagctccccgcggtggcggccgctctagaactagtggatcccccgggctgcaggaattcgcacgagaccattacctagaacatcctaatcgaaaaaaaacccttcctcacttcacgcccccgctgagctgcttggcgcccccgatgctggtgatttcgagtatgagccagaggggttcggaatggcctagtctaagaactctcacggcgcataaccagtcggtccgggcgcacaagaccggcatcgagaagcccaagcgccagcgccagaccttcgccaaggggatggacccccagtttctgaggaacttgaggtactcactgaacggcgatgagagacagttgtccagatcgactcacacgagtgacatgatgactgaagttgtggcgacaaatgcatctcttgtatcactccgcccttacttgtgaacttcattttcacctctgtgtgattaaaacagattcatccattggtactgaaatgttgccttttacacttggtgcctatctggagtttctttgcctaaaatcatcaactagtgtcctttacatatcgggacttcttgccgaaccggaagaaaaaaagagattatcaatttccggccaccctctacgtggggggccacggcaccctatgtcgcgcgcatcgaacccgcgtatttacccgccctcctctgggccgtagcattgaccaccctccn

SEQ ID NO: 57935 - protein, 94 aa, Zea mays
  misc_feature: Ceres CLONE 1509463
  misc_feature (16)..(55): Pfam Name: Ribosomal_L29e Pfam Description: Ribosomal L29e protein family
MLVISSMSQRGSEWPSLRTLTAHNQSVRAHKTGIEKPKRQRQTFAKGMDPQFLRNLRYSLNGDERQLSRSTHTSDMMTEVVATNASLVSLRPYL

SEQ ID NO: 57936 - DNA, 595 bp, Zea mays
  misc_feature: Ceres CLONE 1509471
  misc_feature: Encodes the peptide sequence at SEQ ID NO. 57937
  misc_feature (493)..(493): n is a, c, t, g, unknown, or other
  misc_feature (495)..(495): n is a, c, t, g, unknown, or other
  misc_feature (496)..(496): n is a, c, t, g, unknown, or other
aaagctggagctccccgcggtggcggccgctctagactagtggatcccccgggctgcaggaattcgcacgagaccattacctagaacatcctaatcgaaaaaaaagaagctccataattaattattgccctttcagttcgccatcggcagccgagcaccatgagctccacaggcggcggcgacgatggcgccaagaagtcttggccggaagtggtcgggctcagcctggaagaagccaagagggtgatcctgtgcgacaagcccgacgccgacatcgtcgtgctgcccgtcggcacgccggtgaccatggatttccgccccaaccgcgtccgcatcttcgtcgacaccgtcgcggaggcaccccacatcgggctgaggttttaaatctacaaaaatgaaatgacctccgaaaatggcccctgggggtcacccgggcccccccccccccaaaaaaaaagggggagggggggggggggggggccctcccaacaancnncccccccccacaaaaagggggggcgagaaaaaaaaaaaagagagggcccccccccccgccccttttttctcccccgaaaaaaaaaaaaaaaaaaaaaag

SEQ ID NO: 57937 - protein, 74 aa, Zea mays
  misc_feature: Ceres CLONE 1509471
  misc_feature (12)..(71): Pfam Name: potato_inhibit Pfam Description: Potato inhibitor I family
MSSTGGGDDGAKKSWPEVVGLSLEEAKRVILCDKPDADIVVLPVGTPVTMDFRPNRVRIFVDTVAEAPHIGLRF

SEQ ID NO: 57938 - DNA, 668 bp, Zea mays
  misc_feature: Ceres CLONE 1509472
  misc_feature: Encodes the peptide sequence at SEQ ID NO. 57939
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
aagctggagctccccgcggtggcggccgctctagaactagtggatcccccgggctgcaggaattcgcacgagaccattacctagaacatcctaatcgaaaaatcgccattaccgccgcctctttatgcacctccggcctccgccgtccctcctcccaccttcgcactaccaccgccgctccgctcatcgaccaccgctgaacaccagtggaaagacccgtgggagactgcatggcttcaagagcgagttccccccctcctccctagctaccgccgagccatgggaggctcccgcgtccgcttcagagcccgccatccaggctatcttccgataggtggatcctgacactaatgccttggtggcacacattgacgagccctcgaccgatcaccgcatcgtgtcgaggcagtgcattagcagcacacgtcacgcactccagactgcgtggagtgagcgtcctggaacgtaaacgcttcctcgagtgagttccgaccctcaagcagctggtgacaccacgacttcggttgaaggaatccaccaaaaggagggagcgcaggcccnnncggggaaaggggggggggccccgaaaaaactcccccccgaattcttttagggcccaaaaatttttttcccccggaaaacagggtttttttaaacccccccccccc

SEQ ID NO: 57939 - protein, 69 aa, Zea mays
  misc_feature: Ceres CLONE 1509472
MHLRPPPSLLPPSHYHRRSAHRPPLNTSGKTRGRLHGFKSEFPPSSLATAEPWEAPASASEPAIQAIFR

SEQ ID NO: 57940 - DNA, 711 bp, Zea mays
  misc_feature: Ceres CLONE 1509473
  misc_feature: Encodes the peptide sequence at SEQ ID NO. 57941
  misc_feature (379)..(379): n is a, c, t, g, unknown, or other
  misc_feature (450)..(450): n is a, c, t, g, unknown, or other
aaagctggagctccccgcggtggcggccgctctagaactagtggatcccccgggctgcaggaattcgcacgagaccattacctagaacatcctaatcgaaaaaaaattcccagtccgcgatacaagaccaatccaatcccagcggaagtggaagcagtttcatttccttccttgcagctagcagcgatgattcttgtggcgatagtggcggagctgctcgaggagtacaccgcgctggtggcgcgggtgctggaacagctgctcaacgacgcgccgttcccgcgccggatgcgcttcctcatgctgcggagcctcccccttcgtgccgccgcctctgcccccgccgccgccgccgaaagccctcttttttccccccccnagggggggaagaaggggcgtttttctcaggggtttcaccctattggcccccatggacacccacccactagnctgggggtggggggggggaggaataaaaaccggtagggtgaccccccgattcccccgcgggtttccccccctccccttttgcccggggaattccaatggggtgagcaccccccgggctggtaaagaaaacaaataatgcccccccttgaagcccctccatttgggggcaaaaacctttgaaaacccccgcccccggagaaaaattttcttttttctaaaaaaaaaaaagaaaagccttgttgcttccccccccctccgggg

SEQ ID NO: 57941 - protein, 99 aa, Zea mays
  misc_feature: Ceres CLONE 1509473
  misc_feature (65)..(65): Xaa is any aa, unknown, or other
  misc_feature (88)..(88): Xaa is any aa, unknown, or other
MILVAIVAELLEEYTALVARVLEQLLNDAPFPRRMRFLMLRSLPLRAAASAPAAAAESPLFSPPXGGKKGRFSQGFHPIGPHGHPPTXLGVGGGRNKNR

SEQ ID NO: 57942 - DNA, 697 bp, Zea mays
  misc_feature: Ceres CLONE 1509490
  misc_feature: Encodes the peptide sequence at SEQ ID NO. 57943
aaagctggagctccccgcggtggcggccgctctagaactagtggatcccccgggctgcaggaattcgcacgagaccattacctagaacatcctaatcgaaaagcgtgtttattctgcgccgagactgaaaacggcatcagtagcagacgcaggcgaccacgaggagtgacggcatcagctgcggcagcgacgcccaacaacggcacctcatgggcgccgacgacgacgacgctgccgctgtggcggcgcgagagagggaggcggagatcgagcaggccatgcgcgcccgcgtctcagacttcaagaagcaggccgactccttgacccttgaaggcgttagaagagcactgaaaaaggacctgggtttggagacatattcacttgatgcacataaaaacttcataaatcaatgtgtagacaaggtttttgctgaatcccatgatgaaaatgcaaatgataatgcttcagaggatcctgaagccaaagattatttatccaaagaagagaaagatgttggtaaacaaatgcctgtttgaaacaaaacgtccttcaatgctgatgtcgaaacatgtggcaagatagaaaaggatcctgaaggaggaagggatcaaacttccagcagtgatattagtgaagacgtgataaaagaagccattgaaaaaaggtcgtcttattttagaaagaactctgagtatgt

SEQ ID NO: 57943 - protein, 108 aa, Zea mays
  misc_feature: Ceres CLONE 1509490
MGADDDDAAAVAAREREAEIEQAMRARVSDFKKQADSLTLEGVRRALKKDLGLETYSLDAHKNFINQCVDKVFAESHDENANDNASEDPEAKDYLSKEEKDVGKQMPV

SEQ ID NO: 57944 - DNA, 598 bp, Zea mays
  misc_feature: Ceres CLONE 1509502
  misc_feature: Encodes the peptide sequence at SEQ ID NO. 57945
  misc_feature (348)..(348): n is a, c, t, g, unknown, or other
  misc_feature (361)..(361): n is a, c, t, g, unknown, or other
  misc_feature (363)..(363): n is a, c, t, g, unknown, or other
  misc_feature (364)..(364): n is a, c, t, g, unknown, or other
  misc_feature (421)..(421): n is a, c, t, g, unknown, or other
  misc_feature (429)..(429): n is a, c, t, g, unknown, or other
  misc_feature (435)..(435): n is a, c, t, g, unknown, or other
  misc_feature (439)..(439): n is a, c, t, g, unknown, or other
  misc_feature (442)..(442): n is a, c, t, g, unknown, or other
  misc_feature (443)..(443): n is a, c, t, g, unknown, or other
  misc_feature (450)..(450): n is a, c, t, g, unknown, or other
aaagctggagctccccgcggtggcggccgctctagaactagtggatcccccgggctgcaggaattcgcacgagaccattacctagaacatcctaatcgaaaaatcgaaaagatgcgtcccaacaacgcgcaatggcgcagcagaggcttctcgctctcctcctggtggcggccctcctcgcgctctccttctcgcaagggcaggtggaagcgcggaaggtgcaggtgcggcgcgcgcccctcggcggcggcggccgcctgcttccggaggcgatgatggcgtacacgacgacggactacgggccccccacggccaacaccaaacaccacggcggcatggtcccgtcgncggaagaaccctncnntcgcgcgacgcactgaccggccagtcgatctcaccgcaaacactgtgtttgtctttngggattgnagcttngaangannagaatgnaggaaaggatcggaagaagctggggcttgtcttccccccttatgggcccccctgttttggttgggccctgccttggcctggtaaacctggcctaacctgcggcttggcttaactcaaatgaaattggaaactgtaagggggcccccaa

SEQ ID NO: 57945 - protein, 82 aa, Zea mays
  misc_feature: Ceres CLONE 1509502
  misc_feature (73)..(73): Xaa is any aa, unknown, or other
  misc_feature (77)..(77): Xaa is any aa, unknown, or other
  misc_feature (78)..(78): Xaa is any aa, unknown, or other
MAQQRLLALLLVAALLALSFSQGQVEARKVQVRRAPLGGGGRLLPEAMMAYTTTDYGPPTANTKHHGGMVPSXEEPXXRATH

SEQ ID NO: 57946 - DNA, 486 bp, Zea mays
  misc_feature: Ceres CLONE 1509512
  misc_feature (161)..(161): n is a, c, t, g, unknown, or other
  misc_feature (193)..(193): n is a, c, t, g, unknown, or other
  misc_feature (423)..(423): n is a, c, t, g, unknown, or other
  misc_feature (424)..(424): n is a, c, t, g, unknown, or other
aaagctggagctccccgcggtggcggccgctctagaactagtggatcccccgggctgcaggaattcgcaagagaccattacctagaacatcctaatcgaaaagcaccaccaccgtcactcaacacagcacaggcagctcgagagagagagagaaagaaagnatgtcgtggttcgggcacccacacacaacagncggctccccccggcgtctgcccccaccaagtgtcaagatctcttgccggcgcaaacaagaacttattgccttggcccttccccgaaagggccccctttgggggtggccccggtaaccctaggggaaacccccccccttgggaaaaaggaaatgggctttaaccccccggttaaaaaaaaaaaaaaaaaaagaattccggggtttttccccccccccaaaaaaagggcccnnggggggggggcccccccccaaaaaaaaaaaactctcccctccggcgggggagaggcacccca

SEQ ID NO: 57947 - DNA, 697 bp, Zea mays
  misc_feature: Ceres CLONE 1509527
  misc_feature: Encodes the peptide sequence at SEQ ID NO. 57948
aaagctggagctccaccgcggtggcggccgctctagaactagtggatcccccgggctgcaggaattcgcacgagaccattacctagaacatcctaatcgaaaaaaccgacgcctccagtcctactcctccacccagctcgctgcttccggaatccggagagctcgcgtcgcgcgtgcgtgggcgtgggtgcgtgcggcggcgaagcaccagcaccaccctctcgcgtcgcgcgcgcgtctcgatggccgacggcgagccttccctcacgcgctggaccttcgaggatttcgtggtccactacgaggcgcacttcggcctccggcgcgaggccgacggcgacggcgatggcgacgatgcacccccgccccgcggatccgatcatggggccagccgccccgccactgcccgcgccaacggcggcgcggacgttgccgtcttcgagcagttcgagcggatggagaggaaggtgaagataagcaatggagctatagaggatggtccactgcagaaatctctacttccttcatttgaatctgcagaaatgcgcaacttagctgagacattgttaagggatataattcgtggaagtccagatatcgataccgtcgacctcgagggggggcccggtacccaattcgccctatagtgagtcgtattacgcgcgctcactggccgtcgttttacaacgtcgtgact

SEQ ID NO: 57948 - protein, 134 aa, Zea mays
  misc_feature: Ceres CLONE 1509527
MADGEPSLTRWTFEDFVVHYEAHFGLRREADGDGDGDDAPPPRGSDHGASRPATARANGGADVAVFEQFERMERKVKISNGAIEDGPLQKSLLPSFESAEMRNLAETLLRDIIRGSPDIDTVDLEGGPGTQFAL

SEQ ID NO: 57949 - DNA, 717 bp, Zea mays
  misc_feature: Ceres CLONE 1509529
  misc_feature: Encodes the peptide sequence at SEQ ID NO. 57950
  misc_feature (213)..(213): n is a, c, t, g, unknown, or other
  misc_feature (214)..(214): n is a, c, t, g, unknown, or other
  misc_feature (215)..(215): n is a, c, t, g, unknown, or other
  misc_feature (223)..(223): n is a, c, t, g, unknown, or other
  misc_feature (224)..(224): n is a, c, t, g, unknown, or other
  misc_feature (229)..(229): n is a, c, t, g, unknown, or other
  misc_feature (336)..(336): n is a, c, t, g, unknown, or other
  misc_feature (354)..(354): n is a, c, t, g, unknown, or other
  misc_feature (355)..(355): n is a, c, t, g, unknown, or other
  misc_feature (512)..(512): n is a, c, t, g, unknown, or other
  misc_feature (513)..(513): n is a, c, t, g, unknown, or other
ggagctccccgcggtggcggccgctctagaactagtggatcccccgggctgcaggaattcgcacgagaccattacctagaacatcctaatcgaaaacttcccattccccccgtctcctcttcccttccgccatggcccagcccgctttcctctcctctctccgctcccgcctcggctccgcgccgccgcccccgccgaaccatcgcctccagnnncccaggcnngcggnctaccacgtcgagcttggggctcgcgaaaaagcgcttttggaggaggatgttgctttgaagaggttcaaatcatacaaaaacagtgtgaaacaggtctccaagatcngggaaatgctctcacttnntagctggtttgtactttggccttgccaagcttaccgaagcttttgccttggtggtttggggccgaacttagcaccaaaatgaaaggaaaaacctcaggtccagtgttgccgggccccgggttttatttcccgggggaaaggtggatccccattccannccattgaaaaagtgggccctccccccctcttccgggttttttttagcccccgttgtgggggaaacccccccggacccggggggaaaaaaaaaaaaaaaacaggggtgtaaccccttggatgtggaaaaaaaaggggcccctggttttttttggcggccttttgtgccacaaaacaggggggaaaaaagcctttcccggggggga

SEQ ID NO: 57950 - protein, 101 aa, Zea mays
  misc_feature: Ceres CLONE 1509529
  misc_feature (28)..(28): Xaa is any aa, unknown, or other
  misc_feature (31)..(31): Xaa is any aa, unknown, or other
  misc_feature (33)..(33): Xaa is any aa, unknown, or other
  misc_feature (69)..(69): Xaa is any aa, unknown, or other
  misc_feature (75)..(75): Xaa is any aa, unknown, or other
MAQPAFLSSLRSRLGSAPPPPPNHRLQXPRXAXYHVELGAREKALLEEDVALKRFKSYKNSVKQVSKIXEMLSLXSWFVLWPCQAYRSFCLGGLGPNLAPK

SEQ ID NO: 57951 - DNA, 674 bp, Zea mays
  misc_feature: Ceres CLONE 1509530
  misc_feature: Encodes the peptide sequence at SEQ ID NO. 57952
aaagctggagctccccgcggtggcggccgctctagaactagtggatcccccgggctgcaggaattcgcacgagaccattacctagaacatcctaatcgaaaatttatctcacgccgcaacctccctcgagcccgagcaaacaagggtggacgcggagccggcggcggagcggagatggcggagaagaagcgaggcgccggcactcgcaaggatgaggtggtgacacgcgagtacaccatcaacctccacaaacgcctccacggatgcaccttcaagaagaaggcaccaaatgccatcaaggagatcaggaagttcgctcagaaggccatgggtactactgatgtccggattgacgtgaagctcaacaagcacatctggagcagtggtatccgcagtgtgccgaggcgtgtccgtatcagaattgcccgcaaccggaacgatgaggaagacgcgaaggaggaactctactccctggtcacagttgctgagatcccaccggagggtctcaaaggtttgggaactaaggttgttgaggatgaggattaagccctgtataccatgagagaaatttgagaatgttacttcagcttattgttatctactgccaatgactcatgtaatagaaggttcgagacttgtctcctttcaagtgcttcgccaagtccaaatatcca

SEQ ID NO: 57952 - protein, 123 aa, Zea mays
  misc_feature: Ceres CLONE 1509530
  misc_feature (11)..(105): Pfam Name: Ribosomal_L31e Pfam Description: Ribosomal protein L31e
MAEKKRGAGTRKDEVVTREYTINLHKRLHGCTFKKKAPNAIKEIRKFAQKAMGTTDVRIDVKLNKHIWSSGIRSVPRRVRIRIARNRNDEEDAKEELYSLVTVAEIPPEGLKGLGTKVVEDED

SEQ ID NO: 57953 - DNA, 701 bp, Zea mays
  misc_feature: Ceres CLONE 1509533
  misc_feature: Encodes the peptide sequence at SEQ ID NO. 57954
  misc_feature (392)..(392): n is a, c, t, g, unknown, or other
  misc_feature (394)..(394): n is a, c, t, g, unknown, or other
  misc_feature (402)..(402): n is a, c, t, g, unknown, or other
  misc_feature (413)..(413): n is a, c, t, g, unknown, or other
  misc_feature (448)..(448): n is a, c, t, g, unknown, or other
  misc_feature (480)..(480): n is a, c, t, g, unknown, or other
aaaactggagctccccgcggtggcggccgctctagaactagtggatcccccgggctgcaggaattcgcacgagaccattacctagaacatcctaatcgaaaactcgccggacctccgactggcggtcgctgctatctctctggtaccgcggtctcttgcgcgcttctctccattcgctcccactcaccggcttgggggaatgaaggatgtggtagggagcccggggacctggagtggcatggcgctgcggttgtcgcaatgcgtgtccgctggcgcatccatgggcgctatggccacagcgtacggcttctccaactacactgctttctgctacttgattgcttcaatgggcctacaacttctttccacccttggccgggggaggggggggncnactccttnaaaactaaaanaaaccttcacaaccctgtccttttaaacctttttntttgttggggactgggtcactccaaattctgntctttggctgccccgtccggcctcccgcgggcgggaccatcccgtttaaaaagggacgtccacttctgcaggaaggacccccaatttgcctggcgcccggacacccacccccggtgggggcggggattaaaccccctggtccttaatcgaaacttttgggggtcccccggtacccgggggtcgccccccccccccgagtaggaacaaaaaaaaaccttgcg

SEQ ID NO: 57954 - protein, 79 aa, Zea mays
  misc_feature: Ceres CLONE 1509533
  misc_feature (65)..(65): Xaa is any aa, unknown, or other
  misc_feature (68)..(68): Xaa is any aa, unknown, or other
  misc_feature (72)..(72): Xaa is any aa, unknown, or other
MKDVVGSPGTWSGMALRLSQCVSAGASMGAMATAYGFSNYTAFCYLIASMGLQLLSTLGRGRGGXTPXKLKXTFTTLSF

SEQ ID NO: 57955 - DNA, 685 bp, Zea mays
  misc_feature: Ceres CLONE 1509534
  misc_feature: Encodes the peptide sequence at SEQ ID NO. 57956
aagctggagctccccgcggtggcggccgctctagaactagtggatcccccgggctgcaggaattcgcacgagaccattacctagaacatcctaatcgaaaaaacccactcacacactgtgaacagctgctgatgcgcctcatcgtccccgtccccccggcagagccgacccaccctccatctccaaacaacgccggcgaacccagccagccggccacgtcgcctcccggtcccggcttagaccagactcagaatcagatgaacctgatcgacgacctcagccaagaccgcggcggcgcggccgcccacgccggcagccgcagtcgcaagccgcccccacccctcgccgccgccgccgccgcggggggcccagcgggttctggagccgccaccgacaccacctggcccggaggtggtggcgctcgacctgctctggaacctcgccttcatcaccgtcgctgcggtcgtgctcgtgctcagccgcgacgaggactcgcccatgccgctccggacctgggtcgccggctacgccctgcagtgcgtcatacacatggtgtgcgtcgcaatcgagtaccggatgcgccatggccagcgcggcggcgccggcgcatcgcccgctgacgaggaaaggcgcagcgacggatcgtcgtcgtctagtgatgaggatgacagggagctcgatcgcc

SEQ ID NO: 57956 - protein, 62 aa, Zea mays
  misc_feature: Ceres CLONE 1509534
MPLRTWVAGYALQCVIHMVCVAIEYRMRHGQRGGAGASPADEERRSDGSSSSSDEDDRELDR

SEQ ID NO: 57957 - DNA, 683 bp, Zea mays
  misc_feature: Ceres CLONE 1509537
  misc_feature: Encodes the peptide sequence at SEQ ID NO. 57958
aagctggagctccccgcggtggcggccgctctagaactagtggatcccccgggctgcaggaattcgcacgagaccattacctagaacatcctaatcgaaaaaaaggagaggaagtaaggagcagcagcaatcgtctatgtccatggccctctcaagctcgctccgtggcctggtggccctgaccccgctggccctcccttccgctcgcccgagcggggccgcggcggcggccccggcaccacgcgcgcggggtcggacggggagaggggcgggggtcgtggcgctggcggcggctctgccgtcggacgcgcagtggctggagcggctgccggagaagaagaagccgctgtacacgcacagcctgccgtgcatcgaggcgtggctgcgcagcctcgggttcacgcagtcccgcgaggaccccgccgtctgggtcgccgagaagccgctctggcacgcgcgtctcagcctcgatgtcaccgacctccacatcaggtacttgaaaagcggccctggaaatcttgacaaggatatggagagaaggtttagctacgccctaagcagagaagacatcgagaacgccatactcggaggaccttaagctgaacacatggccaaggggctcagagctaggaattgcttagtcgaggttggcactgaagaaataatcgctccagtgatctgcg

SEQ ID NO: 57958 - protein, 151 aa, Zea mays
  misc_feature: Ceres CLONE 1509537
MALSSSLRGLVALTPLALPSARPSGAAAAAPAPRARGRTGRGAGVVALAAALPSDAQWLERLPEKKKPLYTHSLPCIEAWLRSLGFTQSREDPAVWVAEKPLWHARLSLDVTDLHIRYLKSGPGNLDKDMERRFSYALSREDIENAILGGP

SEQ ID NO: 57959 - DNA, 697 bp, Zea mays
  misc_feature: Ceres CLONE 1509538
  misc_feature: Encodes the peptide sequence at SEQ ID NO. 57960
aaagctggagctccccgcggtggcggccgctctagaactagtggatcccccgggctgcaggaattcgcacgagaccattacctagaacatgctaatcgaaaaatacggcataccacactagagccggcgccgccgccgtttcgcgcaccgtaccctagccctcgtcagcggcggcttcgagctcatccagccatgacgttcaagcggaggaatggcggacgcaacaagcacgggcgcggccgcgtcaagtacatccgctgctacaactgctgcaagtgctgccccaaggataaggatatcaagcggctcttgatgaggaacattgttgagcaggctgccgtgagagatgtgcatgaggcctgtgtacatgatggatatgttctacccaaattggatgcaaaggttcatcactgtgtctcatgtgcaatccatgagcacattgtacaggtccgctctcgtgagaacaggatgaaccgtgagcccccgcagcgcttcatacgccgggatgatggcccaaggtctggacagggaccgccgcgcccaatcagtgcagatcctgcagctgcagctgctgctgctcctcggacctaacttctggaattagtttcggagcttcactatgagaaacactacctgctctgagaaaccattgccactgtatccccatgatgccaaactctatagcacaatctgtggt

SEQ ID NO: 57960 - protein, 132 aa, Zea mays
  misc_feature: Ceres CLONE 1509538
  misc_feature (1)..(114): Pfam Name: Ribosomal_S26e Pfam Description: Ribosomal protein S26e
MTFKRRNGGRNKHGRGRVKYIRCYNCCKCCPKDKDIKRLLMRNIVEQAAVRDVHEACVHDGYVLPKLDAKVHHCVSCAIHEHIVQVRSRENRMNREPPQRFIRRDDGPRSGQGPPRPISADPAAAAAAAPRT

SEQ ID NO: 57961 - DNA, 671 bp, Zea mays
  misc_feature: Ceres CLONE 1509558
  misc_feature: Encodes the peptide sequence at SEQ ID NO. 57962
cttctcagctccattccctccctttcccctcacatcatgctcgactgttgcgcctgcgatcgctgacgttgaagtgctctccccctcccccctccccccctcctccctgcaacctgacccagaccatgaatcttcagcaagaaaatctcgcgcacgcaccaaacgtactgctgacctcgcagccaaaaacaagaaaatagctccagcttcacgccacagtgtccgtctgcgggataaggaacccgcgaactacgtggacatgtcctctaaggcgaccaatctgaaagctctgaagaacgagctggcaaactgctccaataatctcaaggcaaaggtcaagcgccatggtctgctgcgcaaatgcactctgaatgctgctgacctgagggcgctcgctggcaccatagcgttgccggctctggctactgctgaactggagcaggcgctggaaagttccacatgttagaattcaacttctgtgctatggtgaggctaggctcacatcctcctagcaagttatccccctgtatttcctattatgtttgtttctcctcagacttaatgtatgtcgctcttttacctccagttgctcttcacattcctcttgttatctggatgttctgctggtgttaatcatgagttcaaatcgtcttaaaaaaaaaaaaaaaaaa

SEQ ID NO: 57962 - protein, 68 aa, Zea mays
  misc_feature: Ceres CLONE 1509558
MSSKATNLKALKNELANCSNNLKAKVKRHGLLRKCTLNAADLRALAGTIALPALATAELEQALESSTC

SEQ ID NO: 57963 - DNA, 696 bp, Zea mays
  misc_feature: Ceres CLONE 1509566
  misc_feature: Encodes the peptide sequence at SEQ ID NO. 57964
aaagctggagctccccgcggtggcggccgctctagaactagtggatcccccgggctgcaggaattcgcacgagaccattacctagaacatcctaatcgaaaaactatcctaccaggcaccactcgcatcgtgtgctcagtcagatccccgtcccgcatttcctaaggccagttggcattgaagacgatgactgcttctgcagctgctggtgtgcagatggtggctgcacgcccttgcatttcggcctcgccaggaattcttaccgcacgggtttctaggactgattgcatgctcagtaccactgctacattccccaaaatcagctgctcctggcctctaaggtttaagcgcaatgatgttgttgtaagagcaatatcggaagagtgtggcccgcaggggcttcccattgatctcacaggtaaaagggcattcattgctggagttgctgatgataatggctatggatgggcaattgcgaaggcacttgctgcggctggtgctgaaattcttgtgggtacatgggtgccggcacttaacatatttgagacaagtctgaggcgtggaaagtttgatgaatcacggaagctgccagatggatctcttatggatattgttaaagtctatccacttgatgctgtctacgattcccctgatgatgttcctgaagatgtcaaatcgaacaaaagatatgcatga

SEQ ID NO: 57964 - protein, 169 aa, Zea mays
  misc_feature: Ceres CLONE 1509566
  misc_feature: SWISSPROT Homolog: EC 1.3.1.9 Enoyl-[acyl-carrier-protein] reductase (NADH)
MTASAAAGVQMVAARPCISASPGILTARVSRTDCMLSTTATFPKISCSWPLRFKRNDVVVRAISEECGPQGLPIDLTGKRAFIAGVADDNGYGWAIAKALAAAGAEILVGTWVPALNIFETSLRRGKFDESRKLPDGSLMDIVKVYPLDAVYDSPDDVPEDVKSNKRYA

SEQ ID NO: 57965 - DNA, 687 bp, Zea mays
  misc_feature: Ceres CLONE 1509568
  misc_feature: Encodes the peptide sequence at SEQ ID NO. 57966
  misc_feature (687)..(687): n is a, c, t, g, unknown, or other
ctggagctccccgcggtggcggccgctctagaactagtggatcccccgggctgcaggaattcgcacgagaccattacctagaacatcctaatcgaaaagaattccccattcacatctgtagccgcgcctctccgtatcactccgcgcctctctcccgccaggccgccgcccaagcaaccatggtggccgcgctgctccgccgcgcgctccacctccgccgtgtgctcccctcgcccgccgtcaccgccgccgcctcccagcgcctcatccccgccttctcgaccacccccacgccgaccccgaccacctcccagcagaacgccgccaccactacgatcgacctctcctccgacgagagccgccgccgcctcctcaataggttggtgtaccggagcaagcagcgaggttttctggaactggacctggtgctggggacctgggtcgagcagcacgtgcacgccatggacgaggccaacatccgcgccctcctgcaagtgctcgacctcgaaaacccagatttgtggaaatggttgactagccaggagcagccaccagaggatctgaattctaatccggtgtttgctgccatcaaatcaaaggtcacagataacctgaccaagcatgcttctcctgagacccgatctacaccaggtcaaccatgggttagaggatgggacgacataaaan

SEQ ID NO: 57966 - protein, 169 aa, Zea mays
  misc_feature: Ceres CLONE 1509568
  misc_feature (60)..(144): Pfam Name: DUF339 Pfam Description: Protein of unknown function (DUF339)
MVAALLRRALHLRRVLPSPAVTAAASQRLIPAFSTTPTPTPTTSQQNAATTTIDLSSDESRRRLLNRLVYRSKQRGFLELDLVLGTWVEQHVHAMDEANIRALLQVLDLENPDLWKWLTSQEQPPEDLNSNPVFAAIKSKVTDNLTKHASPETRSTPGQPWVRGWDDIK

SEQ ID NO: 57967 - DNA, 653 bp, Zea mays
  misc_feature: Ceres CLONE 1509569
  misc_feature: Translation starting site: 241
  misc_feature (418)..(418): n is a, c, t, g, unknown, or other
aaactggagctccccgcggtggcggccgctctagaactagtggatcccccgggctgcaggaattcgcacgagaccattacctagaacatcctaatcgaaaaatccatcatcgctcgctcttctcttggtcttgcaactccagtgctgctcactgccactgccagcagatcgagctgctccgcctcactagccctcttgctttgctgctgcacctgcaagtctgcaaccgcgcacagagagatgtcgacggtgagccgtgcgtccctcgaccagaagctcgccctcgccaagcgctgctcccgagaggcgaccctcgccggagccaaggcggcagcggtggcgactatcgcctccgcgatccccaccctgggcagcgtgcggatgctgccatgggccaagggcaaacatcaccccacgnccaggcgctcatcgtctcccacgtggctgggatggcatacttcatcgccgccgacaagaagatcctgtcgctggcgaggcgccactccgtcgagcaagcccctgaccacctcaagaaacacctccttccggggcaccgggccgtccccacccggcttttcttcaggccctgaagactgggcctccgccaaactaactacttacccctttcagtttcaatccgcaaggccaaaacc

SEQ ID NO: 57968 - DNA, 684 bp, Zea mays
  misc_feature: Ceres CLONE 1509575
  misc_feature: Encodes the peptide sequence at SEQ ID NO. 57969
aaagctggagctccccgcggtggcggccgctctagaactagtggatcccccgggctgcaggaattcgcacgagaccattacctagaacatcctaatcgaaaatctccagttcagcagccacggccagtctctgttctcaactgctgccatggcagccgcatcgaacatcacccacctccctccctctgtcaaccacgacctcgaagaaatggcacctgcatccgacagcacccacctccctccctccgtctaccacgacctccacgaagatgatgacgatgaggaattcgacgaagacgactacgacctcgttgacggaaccgcctacgacgacagctaaccctccgagtccccatccgaggcggctcgcctcgaggccgtgctccggcggctcaccgctgacgagatccgtatccgggtgcaccaggtcacgatccggggttgcgcccgcatgctccgcgcctcgctcaaggcggaggtcggcccggacatcgaccgctcctccactatgtgtgacctcgtgcgcgcctccgtcgccccctgaaaccggactcgtctcctcgtcgccattctaacatgcttgatcacctgcgacacggagtccctctgatattccaagaatctacttcgtctacttcatagaagatccttagtcccctgacccctcctcccgaaattttggct

SEQ ID NO: 57969 - protein, 43 aa, Zea mays
  misc_feature: Ceres CLONE 1509575
MAPASDSTHLPPSVYHDLHEDDDDEEFDEDDYDLVDGTAYDDS

SEQ ID NO: 57970 - DNA, 695 bp, Zea mays
  misc_feature: Ceres CLONE 1509576
  misc_feature: Translation starting site: 434
atagctggagctccccgcggtggcggccgctctagaactagtggatcccccgggctgcaggaattcgcacgagaccattacctagaacatcctaatcgaaaaatcattttgttcgtaattgagcaaacctgtgctactattctcgcgcccggcgtccgccttgtccaagaagcggttctaatcggcggtgataatcctaatctgagtcccaactcgtcagatgacatggacattagcagcctcaaattggagcagctcgcggagctgatgcgcctgtatctggccacggaggtcagcaacgaggtcaccgctaaagcctccctcgtctagcaactgagaatcgccccctagaagatcggaggtcatgacgacatctacgaggtcgacctcctgaaggacgaagaaaccaaaaggccgtaccaagaaaagcccgatgacagtttgtccctcgatgacaaagatggctctgaaagcgccacaggcgatactaaacaacgcatcgctttcattgcaagcgcgattgcctataagggaagcaacagtgctgtccagaaatttaaccctgacatgttccacaagtgtactaaactgttgaaggttagatggaatcacttggttgaggtgaacgacagtgcttacaagcttgcacgactctgtactagatacaatgagtggaacatgataagctcgttctc

SEQ ID NO: 57971 - DNA, 691 bp, Zea mays
  misc_feature: Ceres CLONE 1509577
  misc_feature: Encodes the peptide sequence at SEQ ID NO. 57972
aagctggagctccccgcggtggcggccgctctagaactagtggatcccccgggctgcaggaattcgcacgagaccattacctagaacatcctaatcgaaaaattgaactgctctgggaccgccctgtaacatccaccaactcgaggaggaggaggaggagaagagatccccccaccgagcctcggtttccaagcgccagcagaagaagaagagacaggacacatggcggcaggtttcggcccgaggttcgccgccggcgatgctccggcgagacggtgtaacctggagcggttcctcgaggccaccacgcccgtcgttgcgtcctccagctgctcgtccaaggtacccgatctaccggatcccgacggggccaacgctgcgcgacctggacgcctgcttcctcacctaccactccctgtccacgcagttcgcagcaggcgccagcagcaacggccccagaccggcgacggcagccaccgcgacggcgatgatgtggctcccgacgttcgcgatggcgtcgtacaaggtgaaggcggcggcgtggacgccgggctggcgcgaccggcaggtggccgcgtccctcgcgcaggccgccgacgcctggctcaggctcctgcgcgccgaccacccggaccaccgcttcttcgccgcccggcggcctcccaggagatggtgatcatttgagtgtata

SEQ ID NO: 57972 - protein, 138 aa, Zea mays
  misc_feature: Ceres CLONE 1509577
  misc_feature (1)..(129): Pfam Name: DUF789 Pfam Description: Protein of unknown function (DUF789)
MLRRDGVTWSGSSRPPRPSLRPPAARPRYPIYRIPTGPTLRDLDACFLTYHSLSTQFAAGASSNGPRPATAATATAMMWLPTFAMASYKVKAAAWTPGWRDRQVAASLAQAADAWLRLLRADHPDHRFFAARRPPRRW

SEQ ID NO: 57973 - DNA, 700 bp, Zea mays
  misc_feature: Ceres CLONE 1509580
  misc_feature: Encodes the peptide sequence at SEQ ID NO. 57974
ctaagctggagctcacgcggtggcggccgctctagactagtggatcccccggctgcaggattcgcacgagaccattacctagaacatcctaatcgaaaaaccagaactgaacccccccgctgtgcatccggaggcgtctcccagctccgcgccgccgctgacggagatggtctgccccgtctcctcagcgccccgtaccgtcgaggacatctaccaggactacgccgcccgccgctccggcctcttacgcgctctcacatctgatgtcaacgggttctacatcctgtgcgacccatagagggagaacctgtgcctgtacggtctcccgaccggcggctgggaggtatccctgccggtggaggacgtgccgtgggagatgcccggaccagccctccgtatcaagttctccagccaccgcatgaggtgtcgagactgggtctcggtcggcgccgtacacgctgacgcttggttttgtccgtcgcatacttcttcgccgccgaattcaggggcaaccacgtgaagggattatgccacgtggggaatggatatccctctcctgtatgaattagtggctgacccgtaggggacgggacgataacccctgctgtttgataccggcggccacaccccgccccccccacgtagccggtccaaatggccgggaagatcccggacccgcgcaattggcagcgtcggcgcc

SEQ ID NO: 57974 - protein, 43 aa, Zea mays
  misc_feature: Ceres CLONE 1509580
MVCPVSSAPRTVEDIYQDYAARRSGLLRALTSDVNGFYILCDP

SEQ ID NO: 57975 - DNA, 684 bp, Zea mays
  misc_feature: Ceres CLONE 1509587
  misc_feature: Encodes the peptide sequence at SEQ ID NO. 57976
caaagctggagctccccgcggtggcggccgctctagaactagtggatcccccgggctgcaggaattcgcacgagaccattacctagaacatcctaatcgaaaaaatcacggcggtcatctcgctaacgctttcctcttggacagttccacttctctgctggcctgccacaaggctacagcggcggcggctgcttcgccggccggccggccgccccctcctgtagcgcgctgagcaagtcaagtaagatggccggcgagcggcgcggtcttgccatcgggatcgatctgggcacgacttactcctgcgtcggggtctggcagaatgggggcgtcgaggtcatcgccaatgaccaaggcaaccgaaccaccccatcgtacgttgccttcaccggctccaggctcctcgtgggggatgctgccaagaaccaggccgaaatgaaccccagcaacacaatcttcgattccaagcggctcattggtagaagatttagcgatgcttctgtacagagtgacattaagcactggcccttcaaggtcattcctggacctgatgacaagcctatgatagttgttcaatacaggggtgtggagcagcagtttgcagctgaagaaatctcctcgatggtcctcgtcaaaatgcgggagattgctgaagcctatcttggcccacagtcaaggatgctg

SEQ ID NO: 57976 - protein, 146 aa, Zea mays
  misc_feature: Ceres CLONE 1509587
MAGERRGLAIGIDLGTTYSCVGVWQNGGVEVIANDQGNRTTPSYVAFTGSRLLVGDAAKNQAEMNPSNTIFDSKRLIGRRFSDASVQSDIKHWPFKVIPGPDDKPMIVVQYRGVEQQFAAEEISSMVLVKMREIAEAYLGPQSRML

SEQ ID NO: 57977 - DNA, 427 bp, Zea mays
  misc_feature: Ceres CLONE 1509589
  misc_feature (291)..(291): n is a, c, t, g, unknown, or other
aaagctggagctccccgcggtggcggccgctctagactagtggatcccccgggctgcaggaattcgcacgagaccattacctagaacatcctaatcgaaaatcttccttttggcttactgcgcaagaagaagggtaacaagaggacggcggcgatggcgaagaggctgctcccatctctgaaccgggtgctggttgagaagctggtgcagcccaaggaagaccgccgggcggcatccctcctccccggaaacatccaaagcagcttgaatggctgctaaaggtgggtggcntttgttggggccccctgggggggaagcggcgacaagggggggggggggaaaatccttgattccccctttttcttctttaaaaagaaaggggggacccttgtttttcccccccccccaaaaaaatttgggggggaaa

SEQ ID NO: 57978 - DNA, 673 bp, Zea mays
  misc_feature: Ceres CLONE 1509601
  misc_feature: Encodes the peptide sequence at SEQ ID NO. 57979
  misc_feature (248)..(248): n is a, c, t, g, unknown, or other
aagctggagctccccgcggtggcggccgctctagaactagtggatcccccgggctgcaggaattcgcacgagaccattacctagaacatcctaatcgaaaaaacgaggtgagagagtgttggggccgccgctcttgagggatagaagaagaggatacagcaagcgggggttgcgaggaggcggcgaacgctatgggcaacgccgggagtgcgccggaccagcccaagaactcggcggatggggccggngctgccgacgcggagtctcgccgcgggccgccgtctacggtgcgtttcttccccgatggggagcgccacaaggcacggcagccgccgccaataaagctcgaggaggaggagggcgtcccgccgccgcccgccaccgaggaggagatggccccgcgcaacctctggcaggcgtatgcgcttggggcgttcattgtgttgagatgggcctgggctacgaggaaggagaaccaggacagataggactcacctgatgctggggatgggaatgcaccggacagatcgacttaatctccggttgctgctgcgtgaactaggctacccgcgaagatgaatgccgtttcgcgataagccaacgatgatggatcattctagctaatgcatcatataatgggccatcgatgtggctggggaattaatgatttttc

SEQ ID NO: 57979 - protein, 98 aa, Zea mays
  misc_feature: Ceres CLONE 1509601
MGNAGSAPDQPKNSADGAGAADAESRRGPPSTVRFFPDGERHKARQPPPIKLEEEEGVPPPPATEEEMAPRNLWQAYALGAFIVLRWAWATRKENQDR

SEQ ID NO: 57980 - DNA, 703 bp, Zea mays
  misc_feature: Ceres CLONE 1509609
  misc_feature: Encodes the peptide sequence at SEQ ID NO. 57981
catagctggagctccccgcggtggcggccgctctagaactagtggatcccccgggctgcaggaattcgcacgagaccattacctagaacatcctaatcgaaaaaacctctcttgctcgctcccctcccacagtcacacactcgtctcgagcggcgccccaaacccccaaccaaaccctcggcgccgtccgcggacatggatcttcgccgcccgccgcgctcctcatcgggcggcgtggagcccaagatccgccaggtcggcttcttcaacccggatgcctccgcgccgtccgagcccctgccccccgccgcggaggtccaggcaccatcggcgcatcagaggccggtcacggagtagcctccggcatcagacgacttctcccagggacgcctttcccctgtaatgatccctcccccgcgccatgccaaccacctaggcctgtgtccacaccccccggaggaggtcgacgtcatcctcgccacttctgcgaccgtgcgtacgtccccgcgcctagacatcgatgtccgagatcggcaacgacgactcctggtcaaactctccttctgctgtggagctagaacagacaagcgtggtttggctgaatacggactgagggtgagtcaacttacatgctcgcaagctgaatacatctatggcaagagacgtgcattcacgaggacagacgtgctgctaaagctactcg

SEQ ID NO: 57981 - protein, 53 aa, Zea mays
  misc_feature: Ceres CLONE 1509609
MDLRRPPRSSSGGVEPKIRQVGFFNPDASAPSEPLPPAAEVQAPSAHQRPVTE

SEQ ID NO: 57982 - DNA, 690 bp, Zea mays
  misc_feature: Ceres CLONE 1509614
  misc_feature: Encodes the peptide sequence at SEQ ID NO. 57983
  misc_feature (578)..(578): n is a, c, t, g, unknown, or other
  misc_feature (581)..(581): n is a, c, t, g, unknown, or other
catagctggagctccccgcggtggcggccgctctagaactagtggatcccccgggctgcaggaattcgcacgagaccattacctagaacatcctaatcgaaaaactgcgactgtgagcttcgttcgttcagttcatccgtgttcttgtttgcgaggtcgagagagagaggatgtcgtgctgcggaggcaactgtgggtgcggctccggctgcaagtgcggcaacggctgcggagggtgcagcaagatgtacccggacatggctgagcaggtgaccaccaccacccaggctctcatcatgggtgtcgcaccatccaaggggcacgccgagggcgggttcgaggcggccgccggagctgagaacggcgggtgcaagtgcggcggcaactgccagtgcgacccctgcaactgcggcaagtgagctaggtgctccaccctgcaggccggccggaggaagctagctaattataaagcttaataaagtatagcggcgtcgctgtgtgtgtttcgagtcagtcagtcagttgcgtgccatggcatgctctgagtctgagatgatgatgatggctgatggcggcgnccntgtcctccactggcctcctggggcgcttctggcgagcagtgtgttgtgttgtgtgggtgccgcacgctagcaggctagccatgtgcccctgctgtgttgtgtcaccatc

SEQ ID NO: 57983 - protein, 82 aa, Zea mays; identical to SEQ ID NO: 43085
  misc_feature: Ceres CLONE 1509614
  misc_feature (1)..(80): Pfam Name: Metallothio_2 Pfam Description: Metallothionein

SEQ ID NO: 57984 - DNA, 676 bp, Zea mays
  misc_feature: Ceres CLONE 1509644
  misc_feature: Encodes the peptide sequence at SEQ ID NO. 57985
  misc_feature (330)..(330): n is a, c, t, g, unknown, or other
caaagctggagctccccgcggtggcggccgctctagaactagtggatcccccgggctgcaggaattcgcacgagaccattacctagaacatcctaatcgaaaactacgcgctgcacgccatcaaccgcaagctcggccccggggccccgccggcgctgcacgtcgaggccgtcagggacggcgaggagcccgtcagcttcggccccagcgcggccctcgccgactacggccgcggctggaggctgcagaccgtcaccgcgcacgacgcgcccgggatccatcacgcgccgcacgcggacacggcgaaacagggcgacaggcagccgtccnaagaagatgccgatggtacggagacagtcaggggcacttgcatctacgtcgccaagatcgtgctcggcgtttgcgtttctcttcctgctaagtggatcgcctcacgtacctgctgggaggtgatcccctgacttgctggaaaactgcatcggcccttggatttaactgaattttttctaccaacccgctgactgaaaaatgtttgaaccaggtgttccatttccttaacaataaatttattggggattgggggggggggttttttaaacttgggcaaattttaaattcgggggcccttgccccttaaaaaaaaaaaaaaaaaaaacttttttcaaatacccggacc

SEQ ID NO: 57985 - protein, 38 aa, Zea mays
  misc_feature: Ceres CLONE 1509644
MPMVRRQSGALASTSPRSCSAFAFLFLLSGSPHVPAGR

SEQ ID NO: 57986 - DNA, 681 bp, Zea mays
  misc_feature: Ceres CLONE 1509670
  misc_feature: Encodes the peptide sequence at SEQ ID NO. 57987
aaagctggagctcaccgcggtggcggccgctctagaactagtggatcccccgggctgcaggaattcgcacgagaccattacctagaacatcctaatcgaaaaatctcctctggtcttccgccatgggccagcccgtattcctctcctctctccgctcccgcctctgctccgcgccgccgtcgccgcaccatcacctccagcccagccgcggctaccacgtcgagctcggcgctcgcgagaaagcgcttttggaggaggatgttgctttgaagaggttcaaatcatacaagaacagtgtgaaacaggtctccaagattgggaatgttctcactttagctgttgtatttggttgtagctacgagcttggtttgttggcggcaagcatgaagtgaaggaaaacacagtcattattccgggaagtgatccatcagcgtagactgtcattctatcacctcatgtttttagcttgtctgtctctctgtttatttttttgtcgtgcaccatgtataaaataaaactaaactaggttaaccttgatttgcgaataaaaaaaaaaaaaaaaaagcttatcgataccgtcgacctcgagggggggcccggtacccaattcgccctatagtgagtcgtattacgcgcgctcactggccgtcgttttacaacctcgggactgggaaaaccctg

SEQ ID NO: 57987 - protein, 89 aa, Zea mays
  misc_feature: Ceres CLONE 1509670
MGQPVFLSSLRSRLCSAPPSPHHHLQPSRGYHVELGAREKALLEEDVALKRFKSYKNSVKQVSKIGNVLTLAVVFGCSYELGLLAASMK

SEQ ID NO: 57988 - DNA, 689 bp, Zea mays
  misc_feature: Ceres CLONE 1509674
  misc_feature: Encodes the peptide sequence at SEQ ID NO. 57989
  misc_feature (654)..(654): n is a, c, t, g, unknown, or other
aagctggagctccccgcggtggcggccgctctagaactagtggatcccccgggctgcaggaattcgcacgagaccattacctagaacatcctaatcgaaaaaatccactccctcctcccacgaaactcttggccatggcttggcgcggcgccgcctcccgctcaatcttcgccgccgtccgtgcccgcgccgcatcctcctcctcctcctcagcggccacgcgcctccgctcggcggctccaattgccgccaccccgcgccgcaccgtccccgcctttgctttcgcggccgcgaggccgttggcggcgatggcggggtaccccgcggcggtcgcggtgaggctcaccgggcactcggcgacgagcgtgcgggcgtgctgtgagctctcccagggaaatgacgatgatgcatgatgcttgggaagcagttttaaagcatggaaaaggcacttgaatgcacacttttgtcttccaatgcaagggtaggatctctcgtcgggcttgcggcctttttcctgcattttgcagagtgcctcgtgtgtcggcaaacggacagtacacttgctgcaactaaatataaacaagcctatgttagcctgctacgcagtacgcactgtgttcgtgcatgttttcatttgaccttgttccatgatgnctcgacgtgttaaaaaaaaaaaaaaagcttatcga

SEQ ID NO: 57989 - protein, 92 aa, Zea mays
  misc_feature: Ceres CLONE 1509674
MAWRGAASRSIFAAVRARAASSSSSSAATRLRSAAPIAATPRRTVPAFAFAAARPLAAMAGYPAAVAVRLTGHSATSVRACCELSQGNDDDA

SEQ ID NO: 57990 - DNA, 573 bp, Zea mays
  misc_feature: Ceres CLONE 1509675
  misc_feature: Encodes the peptide sequence at SEQ ID NO. 57991
  misc_feature (437)..(437): n is a, c, t, g, unknown, or other
aagctggagctccccgcggtggcggccgctctagaactagtggatcccccgggctgcaggaattcgcacgagaccattacctagaacatcctaatcgaaaaatggcgaaaataaccgccgccgccgccgtgctagagtcccggagcctgcgcggcgcccgcgccgttcgactcctccacaagatccatcatcgcttcctccgccttctcggcgccactgcacctaaagccggccgccgcaaggttgcgagatcgagggagcccaaaagcctcagggcggcggatgaaaagcaggagcaggacgtcgaggcacaggaccccaatgccgccgccgccgtttccgctaccgattctgcttccgaggcggccgtggcgggcaagtactgggcgcacaggtacagcctcttcaacctctatgactgcggcgtgtgcatggancgccgaggggctggtactccgccacccccggagtccatccgcggcgtttgcaggggcgcccggcgcgggggccccggggaaacttcgttttaaaaacaccctttttgcggaaaggggggggggaaaactcctcccc

SEQ ID NO: 57991 - protein, 142 aa, Zea mays
  misc_feature: Ceres CLONE 1509675
  misc_feature (112)..(112): Xaa is any aa, unknown, or other
MAKITAAAAVLESRSLRGARAVRLLHKIHHRFLRLLGATAPKAGRRKVARSREPKSLRAADEKQEQDVEAQDPNAAAAVSATDSASEAAVAGKYWAHRYSLFNLYDCGVCMXRRGAGTPPPPESIRGVCRGARRGGPGETSF

SEQ ID NO: 57992 - DNA, 575 bp, Zea mays
  misc_feature: Ceres CLONE 1509683
  misc_feature (286)..(286): n is a, c, t, g, unknown, or other
aaagctggagctccccgcggtggcggccgctctagaactagtggatcccccgggctgcaggaattcgcacgagaccattacctagaacatcctaatcgaaaaacactcaaccaggggttttgctagggttctcatcctgccgccacagcgatggccgctgccgccgccggcgaggacgacgcggcgtgggagcgcgccatctccgccgccaccaagtccacctcggcgcccaagaccctcaccctcgacggcgccgtcaagtcctccacgggcggcctcccctccngccgcgctcctcgagcgcttcgcgcctcctcgagagctctcgtcgcgggggcgcgctctctcgctcggggctgccccgctcggggctcggggctctcctcccgaaaccgctctgggggcgcgcctcccgcgtcccaaggatgggggcacgctcgccactcgactagggacaacgggtcccgaagtccagaactccccccttcccggggcccggcaaatcctcaacccgttcagggcccctccccaaggcaaggggaccgggataaggccttccccctaattcccacccc

SEQ ID NO: 57993 - DNA, 690 bp, Zea mays
  misc_feature: Ceres CLONE 1509685
  misc_feature: Encodes the peptide sequence at SEQ ID NO. 57994
ggagctccccgcggtggcggccgctctagaactagtggatcccccgggctgcaggaattcgcacgagaccattacctagaacatctagaacatccgctctagaactagtggatcccccgggctgcaggaattcgcacgagaccattacctagaacatcctaatcgaaaaaccttatcacgacccgacctccaaccccgacgccagccagccaggcacgcacgcacgcacctacctgctgcggcggcccagagagatggacggcgggcggccggagatgcggcggaccatgacgctgtccgagcagctgtcgtccacgcccgacccggccatccgcgacttcctcaagatcccccaagacgccgacgtcggcgggatcctccacgacgaagatagcccctcggctgtggacgcgcacgggccccgcgccggcaggacgagcggctggaagccgctgcgggaccggctccggctccggcgcgcggcgggcgcctggcagacgccgcctaataagccccgcgctgccgcggggcacgccccgaccaacagcggcaatctcagcaaccggtacaactacaacccccgcgaggcggggggcggcgttctcccgcaccttctcccgggcgccactcttgggggccgccgtcactccgggcgacgcccacgtttctcccgcgtcccgtccaccccgc

SEQ ID NO: 57994 - protein, 145 aa, Zea mays
  misc_feature: Ceres CLONE 1509685
MDGGRPEMRRTMTLSEQLSSTPDPAIRDFLKIPQDADVGGILHDEDSPSAVDAHGPRAGRTSGWKPLRDRLRLRRAAGAWQTPPNKPRAAAGHAPTNSGNLSNRYNYNPREAGGGVLPHLLPGATLGGRRHSGRRPRFSRVPSTP

SEQ ID NO: 57995 - DNA, 681 bp, Zea mays
  misc_feature: Ceres CLONE 1509686
  misc_feature: Encodes the peptide sequence at SEQ ID NO. 57996
aagctggagctcaccgcggtggcggccgctctagaactagtggatcccccgggctgcaggaattcgcacgagaccattacctagaacatcctaatcgaaaaacatcgccaccgcctctccgctcctcgacaagaccaatggcggctgctgcgtcctccgctctgcacgccgttggcgccgtcgcctccgccaagcctagatccgtcgcccccgcggtggcgacgaggaggagcgtgcgcgtggcgcccgcggccaagcgaggaccaggctcgggaggaggcaggctcgtggctcgcagcgccgttgcagccaaggcggatgaggcggccgcggcggcgggatccaagtcaggcggccatgagttgctgatgtttgaggcccttcgtgaaaccttgatagaagagatgaatttggatcccacaccgtgcgtcatgggtgaagatgtttggccttaatggaggttcttccaagttgaccaaggggttggctgaaatgttcgggaaaatctccgggtcccttgatccccccttccccgaaaacccccttcccctgcacggggatttgggaacagaaataaaagcgccttaaagcctcttttgggaaagcgcataaaaagggggttcccctttcccttgtgcccaaaacccaaatttctcaaaaaaactcgggggtgtgctttcc

SEQ ID NO: 57996 - protein, 105 aa, Zea mays
  misc_feature: Ceres CLONE 1509686
  misc_feature: SWISSPROT Homolog: EC 1.2.4.1 Pyruvate dehydrogenase (acetyl-transferring)
MAAAASSALHAVGAVASAKPRSVAPAVATRRSVRVAPAAKRGPGSGGGRLVARSAVAAKADEAAAAAGSKSGGHELLMFEALRETLIEEMNLDPTPCVMGEDVWP

SEQ ID NO: 57997 - DNA, 631 bp, Zea mays
  misc_feature: Ceres CLONE 1509688
  misc_feature (176)..(176): n is a, c, t, g, unknown, or other
  misc_feature (177)..(177): n is a, c, t, g, unknown, or other
  misc_feature (199)..(199): n is a, c, t, g, unknown, or other
  misc_feature (305)..(305): n is a, c, t, g, unknown, or other
  misc_feature (400)..(400): n is a, c, t, g, unknown, or other
  misc_feature (404)..(404): n is a, c, t, g, unknown, or other
  misc_feature (410)..(410): n is a, c, t, g, unknown, or other
  misc_feature (411)..(411): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (426)..(426): n is a, c, t, g, unknown, or other
  misc_feature (463)..(463): n is a, c, t, g, unknown, or other
  misc_feature (464)..(464): n is a, c, t, g, unknown, or other
  misc_feature (485)..(485): n is a, c, t, g, unknown, or other
  misc_feature (505)..(505): n is a, c, t, g, unknown, or other
tctccgcggtggcggccgctctagaactagtggatcccccgggctgcaggaattcgcacgagaccattacctagaacatcctaatcgaaaacttttagcaactcgtgatcaagaactccgagcactcactgctgagatgaatcaagtgcactccgaacttcgacatgcccgtggtnnttgatcgatgaaaaggattcanaagctccagcgtatccgtctgagcaacaaccagtatgttgaaaaaaacgataggctcagagctattctcggtgagtggagtgctccacccccaaaggttgaacctncctttggagggctattttttttttcaaaccccccaattgaggaaaaaaaattttttttttttttcccccccccccgggggaaaaagaaaaggggntttntttttnntttttttttnnnntntttttaaaaaaaaaaacaaaaaaaaaacccccccttnncgggggggggtgggggtttcnccgtgtttcttccctcccgncccccccccaaaagaaggtagggggcccccacttttcccaacaaaaaccccccaatcctccccccccccggccctcgagaaaaaccccgaatttgaaggtgccccgcggtcggtcgccgccccggg

SEQ ID NO: 57998 - DNA, 632 bp, Zea mays
  misc_feature: Ceres CLONE 1509714
  misc_feature (1)..(1): n is a, c, t, g, unknown, or other
  misc_feature (432)..(432): n is a, c, t, g, unknown, or other
  misc_feature (438)..(438): n is a, c, t, g, unknown, or other
  misc_feature (439)..(439): n is a, c, t, g, unknown, or other
  misc_feature (509)..(509): n is a, c, t, g, unknown, or other
  misc_feature (537)..(537): n is a, c, t, g, unknown, or other
naaagctggagctccccgcggtggcggccgctctagaactagtggatcccccgggctgcaggaattcgcacgagaccattacctagaacatcctaatcgaagaaaaaaacggccgtccctatctatcggattgcttccagttccagctcgagcactggggcttcgcaggcgagatgaagaggctgcttgctcgtggcaagtccggttgcccctcccggagtttggttggcagaatccctgccctgcctgtactttgcaacaacgttcttcccggccataggtactattcagccgagaaacacgatgacgacaccacgctaggtgagatcggggacaaggcaaggtcgacagccgaggagttcctgagggtgggccaaggagaagaccgacgacgtcgcggagggcgcgaaggagacgctgcacgagaccaangaagcnngtggtcgggagtcggacgacgagaaggagaagtcaaaaagggaggtgggagggaggggaagtaccatcantccgaagaaatagttgcttgtggtctcnttggctgcgtatgcaagtcatgggcttggattactatacatacccaaaaggccttgtagttttgtaaaaaattactcctttgcatcccgacctgt

SEQ ID NO: 57999 - DNA, 681 bp, Zea mays
  misc_feature: Ceres CLONE 1509721
  misc_feature: Encodes the peptide sequence at SEQ ID NO. 58000
atagctggagctcaccgcggtggcggccgctctagaactagtggatcccccgggctgcaggaattcgcacgagaccattacctagaacatcctaatcgaaaaattgcctctctttctagatcggcgcatttttgttcaagatactccgaggataagaggatgggggatgctactcgttcgatgcctgggttgcatctctggtcctcccattgactccagatctgcctgcattggcatcctcttcggaccgatggatgaccgaatacaatgacgcatcctgacttgttgatgacatcgattctgtgattgccgataaagggtctcttccacgatccggcccagaagttatgcgtgatgcttctttcattcggataataataactattcttgctactagactggataccttggattctttgtttgaccgaattcctactgagtcaatctctgacgaggatatgcacttacgcccagacattgctttccggtttgaactctcaagccaaggggatgggcacaagtttctttgtgccaaacttccctaacagggaggatctgcatggttaaagtaaaactgcatatgaaatgagcgtagtggctcggttaaatgacccaggaatttgttggccttcctagccaaattttggaggagaaagatgaggggccccaggaacctgcaca

SEQ ID NO: 58000 - protein, 65 aa, Zea mays
  misc_feature: Ceres CLONE 1509721
MRDASFIRIIITILATRLDTLDSLFDRIPTESISDEDMHLRPDIAFRFELSSQGDGHKFLCAKLP

SEQ ID NO: 58001 - DNA, 683 bp, Zea mays
  misc_feature: Ceres CLONE 1509888
  misc_feature: Encodes the peptide sequence at SEQ ID NO. 58002
  misc_feature (683)..(683): n is a, c, t, g, unknown, or other
aaagctggagctccccgcggtggcggccgctctagatctagtggatcccccgggctgcaggaattcgcacgagaccattacctagaacatcctaatcaaaaaaaaacacgcatccgactccgtctccagcaaccccattcggctcctccctccgtctccagcagttctccatccaaacaaaccgcgtgatccgtctgaccgctcgctcgctctcgccgggggtccggagctccccacctccagcgacccagtccatccgcgcgtgcagcgccgcggcgccgatggagtacgacttccgcggcggccgctcgagctcgggcccgggcccctacggcgcgcctccggggggcgcgcccgggggaggctcctcgctctacccgcgcgtcgggcagccctcccacggcgggggcggggcctccacggcgtctccgcgggccgcgccgtaccaccacggctccgggtccggatccggctccgggtcctcggctcccgtcgtaacgccgttggctccaacctccttctcctcgtcctcgtcctcgtcctcgaaagtgggcatacaagttgcgataaagcctgaattccgcattaccccacctcctcaattgccaccagagatggtagagattcctcgcagcaccttcaactttgattttgagtatgagagaatgattcttgctgaggcn

SEQ ID NO: 58002 - protein, 134 aa, Zea mays
  misc_feature: Ceres CLONE 1509888
MEYDFRGGRSSSGPGPYGAPPGGAPGGGSSLYPRVGQPSHGGGGASTASPRAAPYHHGSGSGSGSGSSAPVVTPLAPTSFSSSSSSSSKVGIQVAIKPEFRITPPPQLPPEMVEIPRSTFNFDFEYERMILAEA

SEQ ID NO: 58003 - DNA, 774 bp, Zea mays
  misc_feature: Ceres CLONE 1509897
  misc_feature: Encodes the peptide sequence at SEQ ID NO. 58004
  misc_feature (29)..(29): n is a, c, t, g, unknown, or other
  misc_feature (30)..(30): n is a, c, t, g, unknown, or other
  misc_feature (37)..(37): n is a, c, t, g, unknown, or other
  misc_feature (38)..(38): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
ggtagaaaccggcgcgcggggtggcgctnntttttgnnggggaaaaaannnnaaaaactggggctccccgcggtggcggccgctctagaactagtggatcccccgggctgcaggaattcgcacgagaccattacctagaacatcctaatcgaaaactctctcgcgcttggctttctttcactctccatggctccactcccatctcgccgccgcagccatggcgatcgcagcgccaactcccgacatccacggcgagcgccaatccggccaggacgtccgcacgcagaacgtgatggcttgcggggcggtggccaacatcgtcaaatcctcgctcgggcccgtcggtctcgacaaaatgctagtggacgatattggtgatgttacaatcacaaatgatggagcaaccatacttaagatgttggaagttgagcatccagccgccaaagttcttggtcgattggctgagctcccaaaccgccgagggaggagagggaactacttccgcttgtctccttggcgccagagttactctagaaaacgggatgatcggtgtggaagagatacgaccccgccgacccccgtgttagcaggggcataccggcttggttatgcgcgaacccctcccacatttgggggagggaaaattattccttcggggtctgaaaaaccttgggaaaagaatacccctttcaaccccggccggaaactgggcatcgcggccggaaaagctataactgcgggcacgcgcgtcccccgccggcaaggcccgggtcg

SEQ ID NO: 58004 - protein, 185 aa, Zea mays
  misc_feature: Ceres CLONE 1509897
MAIAAPTPDIHGERQSGQDVRTQNVMACGAVANIVKSSLGPVGLDKMLVDDIGDVTITNDGATILKMLEVEHPAAKVLGRLAELPNRRGRRGNYFRLSPWRQSYSRKRDDRCGRDTTPPTPVLAGAYRLGYARTPPTFGGGKIIPSGSEKPWEKNTPFNPGRKLGIAAGKAITAGTRVPRRQGPG

SEQ ID NO: 58005 - DNA, 686 bp, Zea mays
  misc_feature: Ceres CLONE 1509911
  misc_feature: Encodes the peptide sequence at SEQ ID NO. 58006
aagctggagctccccgcggtggcggccgctctagaactagtggatcccccgggctgcaggaattcgcacgagaccattacctagaacatcctaatcgaaaaagatcagccttcaaactagggtttactcctcccgctccgaaaaagcaaacaagcgtcagctccgccggcggcctcgcgctctctcccccgccgctccttctctacgcttggcctgccaagatgaagctcgtcagattccttatgaagctaaacaatgagacggtcaccatcgagctcaagaacggaacggttgtccacggcaccatcaccggtgttgacataagcatgaacactcatctgaagacagtgaagcttacactgaaagggaagaaccctgtaacgctcgaccacctcagcgtgcgaggaaacaacatccgctattacattcttcctgacagcttaaacttggagactttgttggtagaggaaacccctagggtcaagcctaagaagccaactacaggaaagcctttggggcgtgggcgcggccgtggtcgtggacgtggtcggggccgggggccgccacgctgacaggtttcccctgctgctggctctcttgcctgacaagttccctgcacgatgtaacctctttcccccgcacgctgtgtgaaagaacgttgcattgttacccttctgatgaacgtg

SEQ ID NO: 58006 - protein, 116 aa, Zea mays
  misc_feature: Ceres CLONE 1509911
  misc_feature (5)..(70): Pfam Name: LSM Pfam Description: LSM domain
MKLVRFLMKLNNETVTIELKNGTVVHGTITGVDISMNTHLKTVKLTLKGKNPVTLDHLSVRGNNIRYYILPDSLNLETLLVEETPRVKPKKPTTGKPLGRGRGRGRGRGRGRGPPR

SEQ ID NO: 58007 - DNA, 729 bp, Zea mays
  misc_feature: Ceres CLONE 1509919
  misc_feature (340)..(340): n is a, c, t, g, unknown, or other
  misc_feature (341)..(341): n is a, c, t, g, unknown, or other
  misc_feature (348)..(348): n is a, c, t, g, unknown, or other
aaactggactccccgcggtggcggccgctctagaactagtggatcccccgggctgcaggaattcgcacgagaccattacctagaacatcctaatcgaacaacttctacgtgtgaaacgcgtccgcgcctatggcctgcccgtgcccagctgccccctctccacgcgagcctctctaggcgtcaagcgtgccattaagcaaccgtggcccccacccctcctcggctctctgcgtgagcacaagcatgtctctgtagcccatgttcaacggatttgaaaggaaacaggtcacccatcacattcgtcatgtgcaattctctcatgtcgtgcagcccataattnncactgangaaaacatagaatgtgcatcataatgccacagaaggcttaaatgttgaagtgggcggcccatgcctaaaaagaagcaaaattgcctgtttgccaaatgcccttggaacccatacaattgtttgagggaaaaaaatttgggaaatttgcatccacaaaataccctcgttttaatttggaccaaaaaaaattgggttcttccccccccttctggaaaaaaaaagggttgtgctcttggggccccccgggttttttgagaaaaaaggggccccccctggggcggggaacaaaaaaaaaaatttttgggggagacccaaaacccctttttttttcagggggggtttcaccaaaaaacggggggaaaaacccccccctaaaaaaaa

SEQ ID NO: 58008 - DNA, 711 bp, Zea mays
  misc_feature: Ceres CLONE 1509920
  misc_feature: Encodes the peptide sequence at SEQ ID NO. 58009
  misc_feature (18)..(18): n is a, c, t, g, unknown, or other
  misc_feature (19)..(19): n is a, c, t, g, unknown, or other
  misc_feature (29)..(29): n is a, c, t, g, unknown, or other
  misc_feature (30)..(30): n is a, c, t, g, unknown, or other
  misc_feature (44)..(44): n is a, c, t, g, unknown, or other
  misc_feature (267)..(267): n is a, c, t, g, unknown, or other
  misc_feature (293)..(293): n is a, c, t, g, unknown, or other
  misc_feature (344)..(344): n is a, c, t, g, unknown, or other
  misc_feature (345)..(345): n is a, c, t, g, unknown, or other
aaagctggagctccccgnncggtggcggnnccgctctagaactnagtggatcccccgggctgcaggaattcgcacgagaccattacctagaacatcctaatcgaaaacgtttacctcacgctctctcgtggtcgttgcttcctggcggcggcgccgccctcttcgtcgggccattcaccggcgacgagcattcatctggaggagagcatcacactcatctaactgatattaggatgagtctatgtacaatagcacgccgactatgtncttcaaaacatcctctgtgaatcgtncttcagtaatttggctcatctatacagcaccgaggctgcaaaggacacggnntgctagaaagtacagtaccctgatgtatcgacccatacgggcctatgtcgctacgttcgaaaaaggtggggattttagtgaccgatttcttgtttccctccttgaggaaataaaaaaatggtccaacctcttttttagaactgaaaccaagacgctccacgggtttttccggccgggtttcaattttggggcccagggggggccgggggctctgtccccaaaagtctaaaaaaaaaagcttaaaaaaaacctctcctgctccgggggaaaaatttccggcgccgcgaaaaaaaaattttcgggggaaccggcccccctctctttttggggaaaaaaagaaaaaacacttttgaaaaaccccccccc

SEQ ID NO: 58009 - protein, 103 aa, Zea mays
  misc_feature: Ceres CLONE 1509920
  misc_feature (2)..(2): Xaa is any aa, unknown, or other
  misc_feature (11)..(11): Xaa is any aa, unknown, or other
  misc_feature (28)..(28): Xaa is any aa, unknown, or other
MXFKTSSVNRXSVIWLIYTAPRLQRTRXARKYSTLMYRPIRAYVATFEKGGDFSDRFLVSLLEEIKKWSNLFFRTETKTLHGFFRPGFNFGAQGGPGALSPKV

SEQ ID NO: 58010 - DNA, 692 bp, Zea mays
  misc_feature: Ceres CLONE 1509927
  misc_feature: Encodes the peptide sequence at SEQ ID NO. 58011
  misc_feature (530)..(530): n is a, c, t, g, unknown, or other
aaagctggagctccccgcggtggcggccgctctagaactagtggatcccccgggctgcaggaattcgcacgagaccattacctagaacatcctaatcgaaaaacgacactagctagctcgttcgtccaaacgtccaccagcgagaaggcagcagccgccagcaaccagttcgtcactgcctaaacctaacctaatccattagcagttcggcactgcgggtctacggcggccggcggcagcagtactacggagcccccagccagccccaggttgcggcagcggcagcaggtggccaggttgcggcagcggcgccctgggacctggtcggccgaccctgctcgagtgctcggcgtcacagcttctcctttctacgtgcagcggttcacaggttcaggcattcagcgccacgccgccgtcgcccccaagccagcgctcagggtgccttggaagtacgctagcttgttgtcatgaagaagtcattcaagttccttccactgaagttggtgcataaggctgcaacaccatctagntggagggtgttctggacaaagaaagcttgtaccttaaaataggaggatacaagaagctggagtggttgtctgaaggcttttgaactgcttgaagcattagtgtagctttggtgcttttgtgactgatcaactctggagcagctagagtgatatagttgtggg

SEQ ID NO: 58011 - protein, 34 aa, Zea mays
  misc_feature: Ceres CLONE 1509927
  misc_feature (21)..(21): Xaa is any aa, unknown, or other
MKKSFKFLPLKLVHKAATPSXWRVFWTKKACTLK

SEQ ID NO: 58012 - DNA, 526 bp, Zea mays
  misc_feature: Ceres CLONE 1509934
  misc_feature: Encodes the peptide sequence at SEQ ID NO. 58013
  misc_feature (266)..(266): n is a, c, t, g, unknown, or other
aaagctggagctccccgcggtggcggccgctctagaactagtggatcccccgggctgcaggaattcgcacgagaccattacctagaacatcctaatcgaaaagaaaatggatccgcaccagttcgccccctcccagcagtcggcgctgaccatggaatcggcggagagcacggccgccgccgctgcgcgggcgtccaacggcgctgccccgagctgtcgtcgaggacgacgacgagaacgacgacgtcccccgaggtgggccgccntgcattatcgaaccaatgctccaaaccccggggggttaccctgggaaaaaaaacccacccggccttttttttttttgggggggcccccccccccccgccctggggaaatttccccccccccccccgggggggaaccccccctttttcccgaggagaaaaaaaaaaaaaaaaaatttttttttttctccccaaaacaccccccccccccccccaggagagaatattcccccccccccccggggggggggggaaaaaaaaaa

SEQ ID NO: 58013 - protein, 140 aa, Zea mays
  misc_feature: Ceres CLONE 1509934
  misc_feature (54)..(54): Xaa is any aa, unknown, or other
MDPHQFAPSQQSALTMESAESTAAAAARASNGAAPSCRRGRRRERRRPPRWAAXHYRTNAPNPGGLPWEKKPTRPFFFLGGPPPPRPGEISPPPPGGEPPLFPEEKKKKKKFFFFSPKHPPPPPRREYSPPPPGGGGKKK

SEQ ID NO: 58014 - DNA, 899 bp, Zea mays
  misc_feature: Ceres CLONE 1509944
  misc_feature (21)..(21): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (89)..(89): n is a, c, t, g, unknown, or other
  misc_feature (139)..(139): n is a, c, t, g, unknown, or other
gttgttggccgtctcctcttntttttttcttttnnnnnnnnncttnnnnnnnacaaagctggagctccccgcggtggcggccgctctanaactagtggatcccccgggctgcaggaattcgcacgagaccattacctanaacatcctaatcgaaaagagttactgttacgagtcagcgcgggttgcgagttgcagaccgcaggagctcgcgctctgcaaaccttcatggcctccgaggcggtcgtcgttcacaccggcggttgccgctgccggcgcttgcggtggcaggtcgaggccccccgcgagcgtaggggcgtggatctgcacctgctccgactgttccatgcggcgcgaacacccacttcatcgttcccgccgcccaagttcaagctggcaggccgggcgcttaacaagtttcatcacccaccttacccccttcgggaacgccccccgggcccaatcacaccctttttggaaaagacctggttttacccccccccccctttctgacccccccccaggtccccaacccccgggaacggggggggggccctttccacccggggggccccggcgggtccaaacccccgcgggttacccccctggcagagttcccgcgtcctaggttcccccgcgacaatcttcccgaaaggggcacagagcaaacacgggggacagaatatttctttttcccgcggagcccctcgcagccacacccccccggggcaatctcccccaaccggggagagaaagagccgccgcagcgcgcggggtgtaagaacacgcccgcgcggaggtccaaaggcttcttgaggcctgctaaaccccccttctgcgagggctagcagggcgcacacgcgctggtggaacacgctgcgcccacccgcgcccgtgcgtgg

SEQ ID NO: 58015 - DNA, 691 bp, Zea mays
  misc_feature: Ceres CLONE 1509946
  misc_feature: Translation starting site: 217
aagctggagctcaccgcggtggcggccgctctagaactagtggatcccccgggctgcaggaattcgcacgagaccattacctagaacatcctaatccaaaacagctccgcctccctttcctaccttcttccctccgtctcccagctcgcgcaggcaggcgacacagcgacgctaaaaaccctagagcgaggaggcgtgccaggccagcggtttgcgatgacggcaccggcggacaaggggaagaaggccaagaccgatgccgacggcggcgaggagaacgagcaaatcgacggcgcccttgtcttctccatcgagaagctccaggagattcaggacgagctcgagaaggttaatgaggaagcaagtgacaaggttatggaggtggagcagaaatacagtgagattcgcagacctgtctacctcaagaggggtgacattatcaagaccatcccggacttttggctcacagcgtttttgagccatcctctactaagtgagcttctgactgaagaggatcagaagatattcaagtacttgggactccattgatgtcaatgattctgatgttaaggcaggatattccatttaccttaacttctctgaaaacccgtactttgaagacacaaagcttacaaaaaacctattcttttgtggatgaaggaaacacccccaataaaagcttcctcaaatg

SEQ ID NO: 58016 - DNA, 774 bp, Zea mays
  misc_feature: Ceres CLONE 1509951
  misc_feature: Encodes the peptide sequence at SEQ ID NO. 58017
  misc_feature (34)..(34): n is a, c, t, g, unknown, or other
  misc_feature (42)..(42): n is a, c, t, g, unknown, or other
ttggtttctccccaaggaggagcgaggaaatttnaggggggntcctcacactggaactccccgcggtggcggccgctctatttctaatggatcccccgggctgcaggaattttcacgagaccattacctagaacatcctaatcgaaaaaaaaagaaaaaggaaattcctctcaacatcaccagaccacgacctccctgccgagctccctccctctccgttggtgatggcatctcagagctccaagaccgcggacaccgccgcgcctccgccggaggttgcagccaccggagaggcggctccgggcgcggcttcttcaacaccggcacaaaaccctaacgctgctgcaaccgcagtggccggggccacggatctacacaagaagatgcgccgcgcggagcggtttggaatgctagtattgatggaagaatagaaaaagcgcatcaatccccccgagagatttgggacccccccccccaagtgtaaaggaggaaaagaagaaaaagtccagggcttgagaagtttggcccttgcctcgccctcttcttcagaggaggaagctaaaaaaaaaggcccgtttgaaacaatttagctcaaaacgaaaactgtccccaagggcgaaacaaaaaaaaaaaaaaggcccgaagctggccgaatttgcaaaaaaccgtctggggggaattcagccgcctcgggaaaaagggccaaaaaaaacctccaaagcccgggatcgcaagccgcttgttaaccggggttccattcttggatttgtgact

SEQ ID NO: 58017 - protein, 68 aa, Zea mays
  misc_feature: Ceres CLONE 1509951
MASQSSKTADTAAPPPEVAATGEAAPGAASSTPAQNPNAAATAVAGATDLHKKMRRAERFGMLVLMEE

SEQ ID NO: 58018 - DNA, 751 bp, Zea mays
  misc_feature: Ceres CLONE 1509954
  misc_feature: Encodes the peptide sequence at SEQ ID NO. 58019
  misc_feature (24)..(24): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
ttttaggtttttcccccctctccngccccccgcgnnnttnnnnnnnnnnnnnaatagctggagctccccgcggtggcggccgctctagaactagtggatcccccgggctgcaggaattcgcacgagaccattacctagaacatcctaatcgaaaattttccgcgcggaaaatgccgccgtttcggccggctcttggaagggcgcttcttctgtaggaccgcggcgcgaggctgcgatggcgttcgccgccagcgagggaaatctttccccggcgctgcccctggccactctgatcggccgcgagctccgcggcgacggtaccgagcgcccgcacgtgcgctacggccactctggcttcgccaagcgcggcgaggactacttcctcgtcaagcccgactgcctccgcgtccccggagacccttcctcctctttctccgtcttcgctgtattcgacggccacaatggcgtgccccccgcggtgctcaccaaggagaaattgctggagcaccgtgatgagcgcggtgcccgagggcatcagtcgcgaggactggctacaggggcttgccgcgcgcgctcggcgcaggaattcctcaagacagactttgactttcccagcgcaaggggtgaaaccgtcaggaaccaacggccaacactttgttggggggttgaagggggttcaccggtccccctgtggcccgtcggttggtaaaaattccagagttggctttccgggaaaacccccgggggaagc

SEQ ID NO: 58019 - protein, 157 aa, Zea mays
  misc_feature: Ceres CLONE 1509954
MAFAASEGNLSPALPLATLIGRELRGDGTERPHVRYGHSGFAKRGEDYFLVKPDCLRVPGDPSSSFSVFAVFDGHNGVPPAVLTKEKLLEHRDERGARGHQSRGLATGACRARSAQEFLKTDFDFPSARGETVRNQRPTLCWGVEGGSPVPLWPVGW

SEQ ID NO: 58020 - DNA, 766 bp, Zea mays
  misc_feature: Ceres CLONE 1509957
  misc_feature: Translation starting site: 340
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (47)..(47): n is a, c, t, g, unknown, or other
  misc_feature (48)..(48): n is a, c, t, g, unknown, or other
  misc_feature (766)..(766): n is a, c, t, g, unknown, or other
aattagaaaaacaacaatcaccgaaaaccacacnnnnntgagaattnnttcaaagtggagctccccgcggtggcggccgcctctttactagtggatcccccgggctgcaggaattcgcacgagaccattacctagaacatcctaatcgaaaactgcaaccccaaatctctccttcctcacacacgcgaagctgagagaccaaagaagaagaagaaggagcgagcaagcagaaagttagctagctgctagcgtggaagtgcccaaggcgagagagagagacaagcctaggacggccgcgccaggctagccagccagctgctagctcctgcggacgagccgatggctggcgccgacgtcgacgtcgggacggagctccggctcggcctgccgggaggaggcgccgcggcggccaaagaaggaaaccatggaactcaagctaaagctgcccacccgccggcatggaggaggcggccgccgcccgccaggccggagccggcagccaaaaagggccagaggcccgccgaggcgccggccgccgatgccgaaaaccacctgcccccaaggcacaggccgtgggctgggcaacaagccgggccgtaccgcaaggaacgcctggcccgtcataccaggcctgggagggagccagaagggaagagggaaccctggaaaagcatgcaacaagcccctgttggccgcccaacagcctttcggggaaaaggtccaacattggacacggtgcccaccccttaacacggggagagagggn

SEQ ID NO: 58021 - DNA, 704 bp, Zea mays
  misc_feature: Ceres CLONE 1509960
  misc_feature: Encodes the peptide sequence at SEQ ID NO. 58022
  misc_feature (697)..(697): n is a, c, t, g, unknown, or other
aaagctggagctccccgcggtggcggccgctctagaactagtggatcccccgggctgcaggaattcgcacgagaccattacctagaacatcctaatcgaaaaaaaagattgcgatcgcgagtccggaggtcggcagcatgaaccaccaccaggcccagcccgtccgcaccggcgacgtctacccaccgaccgccgtcaagcgagaggcgagccacgagcgggacaagatcattgaacaaggagatcagcggggcggcgccctccacgtcgaccagacagatcttcccgccagcagacgcatggtcaccgccagcgcaggcggccaggtgatggcacagttcaccgtgcccgtgccggacaccaaggtcgcggaggccacggacgcggtcaccctcggcgaggccctccatgccgcggcgcagacgtcggcgggcgacaagcccgtggacctcgccgacgctgcggcgctgcaggccgccgaggcgcgcgcgacggggctgggcggcaacgtacgcggcggcgtggcggccgccgcgcagcaggccgcggagaccaacccaaaccgagcgaaagacggcggcggtggcgacagggtgacgctcagggacgtggtgggcggcgaccccgcggcgggcgatggccgcccacaagggggccacgaaggaaggacgcccaaaaggtggcggctgcccgcggncccgcaa

SEQ ID NO: 58022 - protein, 189 aa, Zea mays
  misc_feature: Ceres CLONE 1509960
  misc_feature (83)..(145): Pfam Name: SMP Pfam Description: Seed maturation protein
  misc_feature (187)..(187): Xaa is any aa, unknown, or other
MNHHQAQPVRTGDVYPPTAVKREASHERDKIIEQGDQRGGALHVDQTDLPASRRMVTASAGGQVMAQFTVPVPDTKVAEATDAVTLGEALHAAAQTSAGDKPVDLADAAALQAAEARATGLGGNVRGGVAAAAQQAAETNPNRAKDGGGGDRVTLRDVVGGDPAAGDGRPQGGHEGRTPKRWRLPAXPQ

SEQ ID NO: 58023 - DNA, 699 bp, Zea mays
  misc_feature: Ceres CLONE 1509969
  misc_feature: Encodes the peptide sequence at SEQ ID NO. 58024
  misc_feature (699)..(699): n is a, c, t, g, unknown, or other
aagctggagctccccgcggtggcggccgctctagaactagtggatcccccgggctgcaggaattcgcacgagaccattacctagaacatcctaatcgaaaaagcaacgtctcgccctcccagctcctcccaccaaacaaactgaaccactgtccgctgcgtgctttccttcctctcaacgccagccttgccgagagcccgagaccaatcgccgccatctcccggaatgacggggtgacgaaaccgcgccgcaccagacaagacagaggagccgccgccgcgacccacaggccaccgggtcgccgaggaggggatccagcgagccatgtcgaccgacgtgcccatgagccccgagctcgagcaggtggacggcgagatccaggacatcttccgcgcgctccagaatgggttccagaagatggacaagatcaaggactccagcaggcagtccaagcagctggaggatctcacggccaagatgagagagtgcaagcgcttgatcaaagagtttgaccgtatactcaaggatgaggagaaaaagaacacccctgatgtcaacaagcagctcaatgacaagaagcagttcatgatcaaagaactcaactcctatgtgaccttgaggaaaacgtaccagagcagccttggtaataagaagatcgaactattcgatacgggtaatgaccaggtggctgagggaacn

SEQ ID NO: 58024 - protein, 125 aa, Zea mays
  misc_feature: Ceres CLONE 1509969
MSTDVPMSPELEQVDGEIQDIFRALQNGFQKMDKIKDSSRQSKQLEDLTAKMRECKRLIKEFDRILKDEEKKNTPDVNKQLNDKKQFMIKELNSYVTLRKTYQSSLGNKKIELFDTGNDQVAEGT

SEQ ID NO: 58025 - DNA, 731 bp, Zea mays
  misc_feature: Ceres CLONE 1509977
  misc_feature: Encodes the peptide sequence at SEQ ID NO. 58026
  misc_feature (554)..(554): n is a, c, t, g, unknown, or other
  misc_feature (578)..(578): n is a, c, t, g, unknown, or other
ggagctccccgcggtggcggccgctctagaactagtggatcccccgggctgcaggaattcgcacgacaccattacctagaacatcctaatcgaaatacactgagaaccgcagagacaggcgtcttcgtactcgcctatctccgcgactcaaagctttccccaattcccccccttctcccatttctcaccaccgccgccgctccccccgttcaacaacaccatgagggagtgcatctcgatccacatcggccaggctggtatccaggtcggaaacgcgtgctgggagctgtactgcctcgagcatggcattcaggctgatggccagatgcccggtgacaagaccattgggggaggtgatgatgctttcaacaccttcttcagtgagactggcgctgggaagcacgtcccccgtgctgtttttgttgaccttgagcccactgtcctcgaggaggtgaggactggaacctaccgccaggtcttccatcctgagcagctcctcggtgggaaggaggaagcagccaaaaacttccgccgggggccactacccctttggnaagggaaattggtggacttgtgcntttggaccgccatcaggaaagcttggaaaataaatggccctgggttctcccggggcttttcctcgtgctctccaagggcggtttgcggggggaggaaaccggggcttccggtgcattgagttacccccaccctccgcgagaagtgccagtgtt

SEQ ID NO: 58026 - protein, 158 aa, Zea mays
  misc_feature: Ceres CLONE 1509977
  misc_feature (112)..(112): Xaa is any aa, unknown, or other
  misc_feature (120)..(120): Xaa is any aa, unknown, or other
MRECISIHIGQAGIQVGNACWELYCLEHGIQADGQMPGDKTIGGGDDAFNTFFSETGAGKHVPRAVFVDLEPTVLEEVRTGTYRQVFHPEQLLGGKEEAAKNFRRGPLPLWXGKLVDLCXWTAIRKAWKINGPGFSRGFSSCSPRAVCGGRKPGLPVH

SEQ ID NO: 58027 - DNA, 857 bp, Zea mays
  misc_feature: Ceres CLONE 1509985
  misc_feature: Encodes the peptide sequence at SEQ ID NO. 58028
  misc_feature (11)..(11): n is a, c, t, g, unknown, or other
  misc_feature (12)..(12): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (549)..(549): n is a, c, t, g, unknown, or other
tttattgtccnnccccccccccaccccaccgcgtnnntgggcnnnnnnnnacaaaagctggagctccccgcggtggcggccgctctaaaactagtggatcccccgggctgcaggaattcgcacgagaccattacctagaacatcctaatcgaaaaacttccgcccaaatccaccaccgccataccagcgtgtccgcgattccgtcgagtagactgggcgagagagtagtctcggacgagaagaggcgaatatgagttccggcggcggcaggggcaagcccaaggggtccaaggctgtgtcgcggtcgaccaaggccgggctgcagttccccgtcggccgcatcgcgcggctacctcaaggccgggcaagtaccccgagcgcgtccgggggtggggcgcccggtccaccttttccgccggccctcgattattttagggggaaaaagtcgttggaaaactgggggggaaagggggggggggggaaatatcccccccccaacccccaatccgggaccaggtcaaaattccagtttccccccgtggcggtaanagaacaaaagaaaacttcagaaaaggctcggtccagaaaattttgtcaaacctattccccccccggcgaaggtgtggtgtgcgcccacaaatatttcataaaaaacgcgttggctccgccacaaaaaagctcccggggtgtaaaaggggaaaaggtcaaaaaattctgttttcgcacgctcccccagaatatttttaacacgccgccccgggggggaggggtggagaaaggtgcttccccaatgaataggttacccacgcccggcggtccctcccctctgctggggaggaacccccccaccacctact

SEQ ID NO: 58028 - protein, 202 aa, Zea mays
  misc_feature: Ceres CLONE 1509985
  misc_feature (100)..(100): Xaa is any aa, unknown, or other
MSSGGGRGKPKGSKAVSRSTKAGLQFPVGRIARLPQGRASTPSASGGGAPGPPFPPALDYFRGKKSLENWGGKGGGGKYPPPNPQSGTRSKFQFPPVAVXEQKKTSEKARSRKFCQTYSPPGEGVVCAHKYFIKNALAPPQKSSRGVKGEKVKKFCFRTLPQNIFNTPPRGGGVEKGASPMNRLPTPGGPSPLLGRNPPTTY

SEQ ID NO: 58029 - DNA, 689 bp, Zea mays
  misc_feature: Ceres CLONE 1509989
  misc_feature: Encodes the peptide sequence at SEQ ID NO. 58030
atagctggagctccccgcggtggcggccgctctagaactagtggatcccccgggctgcaggaattcgcacgagaccattacctagaacatcctaatcgaaaaacactctgcccagctaagctaagctccctccgtccatcggcatggcgactaccactactaccatcctcctcctcctcctcgtcgcagccacagccgtctcggcggccgacctctccgtgtaccacaacgtgcacccgccgtccccgtccccgctcgagtccatcatcgcgctcgcccgcgccgacgacgcgcggctcctcttcctctcatccaaggcggcctcgtccggcggcgtcacctccgctcccgtcgcctccggccagactccgccctcgtacgtcgtccgcgcggggctcggcaccccggtccagcagctgctcctcgcgctcgacaccagcgccgacgccacctggtcgcactgcgcgccgtgcgacacgtgccccgccggcagccgcttcatccccggcagctcctcctcgtacgcctccctcccgtgcgcctccgactggtgcccgctcttcgagggccagccgtgcccggcgaatcaagacgcctcggcgccgctgcgggcgtgcgccttctcaaagcgttcgcggacactcgttccagcgtcgctgggcagcgaccgctgcccctgggcaagaccc

SEQ ID NO: 58030 - protein, 182 aa, Zea mays
  misc_feature: Ceres CLONE 1509989
MATTTTTILLLLLVAATAVSAADLSVYHNVHPPSPSPLESIIALARADDARLLFLSSKAASSGGVTSAPVASGQTPPSYVVRAGLGTPVQQLLLALDTSADATWSHCAPCDTCPAGSRFIPGSSSSYASLPCASDWCPLFEGQPCPANQDASAPLRACAFSKRSRTLVPASLGSDRCPWARP

SEQ ID NO: 58031 - DNA, 779 bp, Zea mays
  misc_feature: Ceres CLONE 1509992
  misc_feature: Encodes the peptide sequence at SEQ ID NO. 58032
  misc_feature (45)..(45): n is a, c, t, g, unknown, or other
  misc_feature (47)..(47): n is a, c, t, g, unknown, or other
  misc_feature (56)..(56): n is a, c, t, g, unknown, or other
  misc_feature (57)..(57): n is a, c, t, g, unknown, or other
tttaaaaaattttttgttccgccctgtccctgcgcggcattttcngnggggggggnncgccgcgggggggctccccgcggtggcggccgctctagaactagtggatcccccgggctgcaggaattcgcacgagaccattacctagaacatcctaatcgaaaacatcaggattggagtgttttcctcgtcttcaagcgagaagggtcttcaggacttgttttttgggcgggcgcagttgcggagatgcagaggctgggggatttcaggctccctcccttcttcaactaccctccttacttcactttgcagcctatgcgtgaaacacgggaaaagcaagtacagttatggaaaaatatgatactcgattactgtagaagtcaaaagatacatacaatatccctggaagaagatttccccatgttctccaatccaaagattgagagatctcttacctatgaagcaaaggaagtgttccttgcagctctggtcagcgaaggtcgcgctgagtggatgggacaagggtcacaaaaagtgccctagtttgtttggctaaagatactggattgggccaactttcacaatgaaacttctgcaaaggatatatgggctggggaagcaatggactatttgaaaaaaattacgcctctggaaatttgatacccccgccggaaaactgaaactttgaggggaaaatccgaatacggggggtggtttcctccttatgcggagggccacttgccgggttcatttttaaaaaaggcataaaagaggggtaaaaa

SEQ ID NO: 58032 - protein, 98 aa, Zea mays
  misc_feature: Ceres CLONE 1509992
  misc_feature (7)..(98): Pfam Name: ESCRT-II Pfam Description: ESCRT-II complex subunit
MQRLGDFRLPPFFNYPPYFTLQPMRETREKQVQLWKNMILDYCRSQKIHTISLEEDFPMFSNPKIERSLTYEAKEVFLAALVSEGRAEWMGQGSQKVP

SEQ ID NO: 58033 - DNA, 841 bp, Zea mays
  misc_feature: Ceres CLONE 1509998
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
tgtgttctccctggttgggcttcaaccttgggcggnnnnnnnggctaaaaattaaaaagctggagctccccgcggtggcggccgctctaaaactagtggatcccccgggctgcaggaattcgcacgagaccattacctagaacatcctaatcgaaaattgctccccttcgttcacctcgcgtacgcgacaaactaggccgaccgccgccgccctacgctcagctgcccacctgccctggtcttcgactcttcgtcgtgcgctttgccggcggagagcacccatcacaccaggtgctttattggggccgtccatacgggaggatggcgctaaggggggtctggcagctgcaaaaactcgtgagaaaattactggcaactggggagggaacaagaaggggacatcaggggcattcctggggaggcccctctttcccaaccctttaggggaaaaagaacctgcaatcttaaaagggggggggacaggtgccccccccccgggggcccccaaccctgagctggaaggggaaaattttacaagaatcccttacaaaaacggggggggtgtatggcggtgaaaaaaatataaacggcgcagaaggaaaaaaaaaacccgtgtcgaggcctccccctcgggtaggagaacctcctcccggggccataaaaaggaggggggaaatctcggggtaccccaaaatattggacagacacaccccccccaccggtttccgggagaatctgggcgaaacggcacatcgtgaaaatggcgggaaacacaagaggctacaaaggtggtcccataggaacacaatggggactcggcaactgcaatatatgtggcgcg

SEQ ID NO: 58034 - DNA, 743 bp, Zea mays
  misc_feature: Ceres CLONE 1510008
  misc_feature (185)..(185): n is a, c, t, g, unknown, or other
  misc_feature (743)..(743): n is a, c, t, g, unknown, or other
tacccgcggtggcggccgctctagaactagtggatcccccgggctgcaggaattcgcacgagaccattacctagaacatcctaatcgaaaagccgcttgttcgttcctcgcgcttgccaccaggcaccaccacacacatcccaatctcgcgagggcaagcagcagggtctgcggcggcggcgganaaaaagaaaaaaaattagtgaagactttggatggaccaccacaaaagggaaccacctcataaaaatggcgttcttactcgcgccaacgcaaagagggaaatgggtaacaaaaaaaataataggttgcgccctctaaaaacaacacaacagaaaaaaagtttgtgtattataaaaaaaaaataaagaaaaaaaaacaaacaaaaccgaaccccgttgtgtgtgttattgtgttccccccctacacaaaatgttatgggtctaatataaataaaaaaacaaaggtaaaaataaacagatactgttaagacaatacaccgttctgtttatgaaaaaaaaatttgttgggtaattaaataataacgagtaacagtttaaaaaaattgtcaccccctaatttaaaaacaaaacatgaggttaaaaaaaaaacatgcaatagatcggataaaattgtacaaaaaaaaacaaaccccatatgtctttaaaaaatcaataatgaaaaaaacataaatcaaagaaaagaaaacaaacaaacagaataaaacagccgagcgccggcan

SEQ ID NO: 58035 - DNA, 775 bp, Zea mays
  misc_feature: Ceres CLONE 1510009
  misc_feature: Encodes the peptide sequence at SEQ ID NO. 58036
  misc_feature (775)..(775): n is a, c, t, g, unknown, or other
aaaaaacaaacaacacccacccccagtacccggtcttgtagatggttgggataaatggagctccccgcggtggcggccgctctatactagtggatcccccgggctgcaggaattcgcacgagaccattacctagaacatcctaatcgaaaagagtttcgacacgcgtgcccaggaatcggtcggattccccaatcccgtcaccatggccgcgccgccttctccttcgtcccgctccccgtcgagcgaggttgccgtccacagattcagcggcaccttggatgtatcatcatcgccctcaaggaccgagttgttgagcatggtgaagaagcactcacatttgattgggtggacgattattggtgccgaggatgatgcatcagatgtgggaatggatgataaattctggcatgaaatgcttgacctattctttgtgcgtggcaggcaatccaaaagaagtgaagaggatgaccttgtcttctttgttaataacatgaaattgcatggttatggtttcaatgataacatggaagatccacctcccttttttgtacggagatgggctcccccgcttgaaaagatcagtattaatacggtggaggttgattggggagcgttcattctaatttgaattttaatccgctcacaacgatcggaaactgttcacttgtttggcaatatttggggaatttgaaagaatcttccgcaagacccgggcaacgggaaaaaaccgaacaggttttggcctccccgggttttaataaagggagtaaccan

SEQ ID NO: 58036 - protein, 141 aa, Zea mays
  misc_feature: Ceres CLONE 1510009
MAAPPSPSSRSPSSEVAVHRFSGTLDVSSSPSRTELLSMVKKHSHLIGWTIIGAEDDASDVGMDDKFWHEMLDLFFVRGRQSKRSEEDDLVFFVNNMKLHGYGFNDNMEDPPPFFVRRWAPPLEKISINTVEVDWGAFILI

SEQ ID NO: 58037 - DNA, 642 bp, Zea mays
  misc_feature: Ceres CLONE 1510012
  misc_feature: Encodes the peptide sequence at SEQ ID NO. 58038
tgtgatcccccgggctgcaggattcgacgagaccattacctagaaatcctaatcgaaaaatttattcctccctcacttccggccttcccccttttcctccggtcgacgcgagggagcgggaggttggcctctaggcagggtggcgggcgaagatgttggacatacagaagcggcgcgtgcggctgctgctcttcatcacggccgtcctcgcgctcagcatcaccgctgagaagttcagggaacttgttggaaaggaggctgcatcaaagagtggtcaatttcacattcatgaactgctttgacatgggctctgggcagcctttgcgtgcacttggcaaaaggaagggggggccaagttgtgaactttcacaacacctttcccaaaaggggccccccctccccaaaaaggggggggggggaaaaaagaagacctctggggaaaaaaaactttttttcccccgaaaaagccgcgggagaaccaaaaagagctcccctcacaccctccctttgtaggagaaagaagacccccccacaacaaccaccccccaaaaaaaaaaaaaaaaataaattcgggggggtgtaaacacccccccaaacacaaacttttccctggtggtggcggccaatctacaaaaaacaaaa

SEQ ID NO: 58038 - protein, 49 aa, Zea mays
  misc_feature: Ceres CLONE 1510012
MLDIQKRRVRLLLFITAVLALSITAEKFRELVGKEAASKSGQFHIHELL

SEQ ID NO: 58039 - DNA, 870 bp, Zea mays
  misc_feature: Ceres CLONE 1510014
  misc_feature: Encodes the peptide sequence at SEQ ID NO. 58040
gtgtgtttgcctcccctcctcattctaaaatgttatgggtggccctctttgagacgggactccccgcggtggcgggcgctctttaatcgtggatcccccgggctgcaagaattcgcacgagaccattacctagaacatcctaatcgaaaatttcggccacttcggtcgcttcgaggagaccacgaggatccctcctatgcgctttacagagaagccgcctgactccccggtgtacccgcgcactacactggacgtcttttcgatcaaagctgcacggaaagaggggggtttaccgtggccaccccatgtgtttgggaagggtgccctaccgcgagcagcgtgatcgcaaacgcgagacgagacttcgatcgcactagagatcactagcctaatcctttacaaaagaagttctcgtattttgaaactgacaacccctgagccaagcaagaagtgcaaggtgaatcccgttgacccccccccccctgaaccaggaaggtttataggcccgcactttgaatctcggaggataaaaccccctggaggctttccctaacccagtgctcacttccttgggtccattgtatcccccgcgtctgaggatacatgccatgacgttagcacggagaagttttgtacagtacagggctttgttcctcggctgaggagaggtggctagcattcgtctgattgataagtctcgctctctcagtgacgacgcctaaaaaattaaagtgtgatgttgagagaacccatcgtatatggtattatatggaattcttcaaatcagttcttcctaatgtatctaagaaatatgtactatacctctactactgatatggaattattagcgctccaaacgcactccaacaa

SEQ ID NO: 58040 - protein, 48 aa, Zea mays
  misc_feature: Ceres CLONE 1510014
MRFTEKPPDSPVYPRTTLDVFSIKAARKEGGLPWPPHVFGKGALPRAA

SEQ ID NO: 58041 - DNA, 674 bp, Zea mays
  misc_feature: Ceres CLONE 1510015
  misc_feature: Encodes the peptide sequence at SEQ ID NO. 58042
  misc_feature (335)..(335): n is a, c, t, g, unknown, or other
  misc_feature (482)..(482): n is a, c, t, g, unknown, or other
aagctggagctccccgcggtggcggccgctctagaactagtggatcccccgggctgcaggaattcgcacgagaccattacctagaacatcctaatcgaaaactgtttgccgtgccggcttgctctcacacccgctgtgccccccgcgccgccaacctcgatgctcgccgccaccaccgcctcccttcggccgcccatccgcagcttcccgcgcgtagcctctcacccgggtgcctcccatggaggcgcctgcggagcgaacccgctcctcacacggcgcaggcggcgagcgctagtatgccgcgcggacctgcagcaggacgcgccgttcgcggncgccatcggcgcctgcgtactcgcctcgctcgtgctgcctcctccgaagtcccgaggggaggcgggcgaccacccggaagatgaaggggagtttggcgcgacgaaccaaagatggcgttgatggggatcatctcctttctggcttancttcactggctgagctgaatctttgcgtggctggacagcggaaggcgggcgtacctggtctacgctggcgtctacctgggctccgtactttaaaactaacttatcactgtcacctgatggaaagctggttacctgtccctaacatctttatctgcattcctactatcccgctagaaacaagcattcagaatg

SEQ ID NO: 58042 - protein, 98 aa, Zea mays
  misc_feature: Ceres CLONE 1510015
  misc_feature (59)..(59): Xaa is any aa, unknown, or other
MLAATTASLRPPIRSFPRVASHPGASHGGACGANPLLTRRRRRALVCRADLQQDAPFAXAIGACVLASLVLPPPKSRGEAGDHPEDEGEFGATNQRWR

SEQ ID NO: 58043 - DNA, 754 bp, Zea mays
  misc_feature: Ceres CLONE 1510018
  misc_feature: Encodes the peptide sequence at SEQ ID NO. 58044
  misc_feature (50)..(50): n is a, c, t, g, unknown, or other
  misc_feature (525)..(525): n is a, c, t, g, unknown, or other
gttcttgtggcgggggggtcttaaacataatatttgaaagataacctccnaaaactggagctcaccgcggtggcggccgctctagactagtggatcccccgggctgcaggaattcgcacgagaccattacctagaacatcctaatcgaaaacctccccaccgcctacttatcctaccacaagcagggatcccaccatgccgcgtcggggtggggagccatcgccgccgcagtcccagctgcagtttacatgctccaggaccaggaggctcatgctgcagagatggagcgcaccttcattgccatcaagcctgatggtgtccaaagaggcctgatttctgagattatgagccgatttgagagaaaaggctataagcttgttgccatcaagctgattgttccatccaaagaatttgctgagaagcactaccatgatctcaaggaaaggcctttcttcagtgggttgtgtgattttctcagctctggccctgtgcttgcaatggtttgggaaggagagggtgtcatcnagtatgggagaaaactaattggtgccacagacccacagaaatctgacccatgaaccatcaggggtgatcttgccattgttgttggaagaaacatcattcatggaagtgaatgggcccaaagacagcgaaaggaagagaaccgcttttatgggtttgaaccccaagggagctgggccttctttaaaccagccaattgcgggaaaaagtgggaatcttttggggggtgaaa

SEQ ID NO: 58044 - protein, 98 aa, Zea mays
  misc_feature: Ceres CLONE 1510018
  misc_feature (2)..(98): Pfam Name: NDK Pfam Description: Nucleoside diphosphate kinase
  misc_feature: SWISSPROT Homolog: EC 2.7.4.6 Nucleoside-diphosphate kinase
  misc_feature (82)..(82): Xaa is any aa, unknown, or other
MERTFIAIKPDGVQRGLISEIMSRFERKGYKLVAIKLIVPSKEFAEKHYHDLKERPFFSGLCDFLSSGPVLAMVWEGEGVIXYGRKLIGATDPQKSDP

SEQ ID NO: 58045 - DNA, 718 bp, Zea mays
  misc_feature: Ceres CLONE 1510130
  misc_feature: Translation starting site: 169
  misc_feature: SWISSPROT Homolog: EC 3.2.1.23 Beta-galactosidase
ggagctccccgcggtggcggccgctctagaactagtggatcccccgggctgcaggaattcgcacgagaccattacctagaacatcctaatcgaaaaaaaatcatcttcctcctcttctctcctctcctcttactcttccccaccaacgccaccaaaaccaacactccgatggatgttttcaccaagcaactcctccccatgcctcaccagcgggaccccaactacccttcctcttccacctcttcctcctcgtcgtcgtcctcctccacgcccccatctcgccctcaccaccgtgcgcaaccccaaccccaaccccacaacctcccccagtccccgagacccgtcgccgtaccgtccgtccttgtttcgtgaggtgcttgctttgctgttctccttgatcgacgccgtatcgataccgtcgacctcgagggggggcccggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaatcagctcattttttttaccaataggccgaag

SEQ ID NO: 58046 - DNA, 858 bp, Zea mays
  misc_feature: Ceres CLONE 1510134
  misc_feature: Encodes the peptide sequence at SEQ ID NO. 58047
  misc_feature (391)..(391): n is a, c, t, g, unknown, or other
tgaaactattccaaaataccccaattaaaaaaccaaccccttaaccccctaaaactggaactccccgcggtggcggccgctctagaactagtggatcccccgggctgcaggaattcgcacgagaccattacctagaacatcctaatcgaaaagtcctcttctacgtcagtaacagggaaatcacggctgagtggcgccaccgcccgtggggcccatcaccggtgcgtgcgctcaataacgagtgagcgcgccaccgtcgagcggcctctcggcggtgcgcacaaggccagcggtcgaggcgccatttccttagtcgactagggtctccgtctctccgactgctagttttcctgcatattcgagaaatatatggatcttttctgctcttcangtccttctcttggttataggcctcctatagtcttatccaggccttcctggaatcaaaacccatcctaggttgggattcccccccccacccaattctaaaattcgaaaaaaggaaaaaatttcccaaaattttccggttttcccacccctttctgggagggtgaaaacatcttgaaaaccacccaaaatcttgggagaacccccttttctcggggggccttgtgtcttcctttgtaaaaaatataccaaaaagggggccgggttttgtttacatgggcccctcaaaagaaaatcccgtggccaaaacaaaaagaaatatttttttttttaatacaaaaaaaataaggttttaaaaaaccccaacatccccggaaataatagttttaaagaaaaaaaacacaggcccaaaaatatttttataaataaaaaaaaaaaaatttttctatatattccccatcctccgggggg

SEQ ID NO: 58047 - protein, 29 aa, Zea mays
  misc_feature: Ceres CLONE 1510134
  misc_feature (8)..(8): Xaa is any aa, unknown, or other
MDLFCSSXPSLGYRPPIVLSRPSWNQNPS

SEQ ID NO: 58048 - DNA, 694 bp, Zea mays
  misc_feature: Ceres CLONE 1510144
  misc_feature: SWISSPROT Homolog: EC 4.1.3.27 Anthranilate synthase
  misc_feature (501)..(501): n is a, c, t, g, unknown, or other
gctctagaactagtggatcccccgggctgcaggaattcgcacgagaccattacctagaacatcctaatcaaaaaaacacgtgacacctccgcccaccctcgccccctccctaccggcaccgcccagatggcctgctcccacatcgtcgccgccgcgggggtctcctcccccgccgcagcggcggctcgttccccggcgcattctcccgctgccgccttcgcgcgcctccggtcgacgcctcttttcgcgagcgctggcttgtcggttaagggaaacggagcggcgtatcccgttggtcgccgccgcggggccggccgcggaggtaccggtggccgacctggacggtcgcctggccacggagaagcagcccatcgtcgtcgttgatgagtacgacaccttcacatacaacctctgccaatatatgggggagcttggattgaacttcgaagtatacccgcaatgatgaactgaccatacaagatgtgagaaggaagaacccgnggggaatacttatttctccaggacctggtgaacctcaagattcgggaatatcattgcaaactgttcttgaattaggcccaaacctcccaatttttggagtttgcatggttcttgcctgcatatgagaggcttttggaggaaagataacccgggcctcctcctggaaggaggcagggaaaaaactctccaattt

SEQ ID NO: 58049 - DNA, 889 bp, Zea mays
  misc_feature: Ceres CLONE 1510155
  misc_feature (46)..(46): n is a, c, t, g, unknown, or other
  misc_feature (47)..(47): n is a, c, t, g, unknown, or other
  misc_feature (51)..(51): n is a, c, t, g, unknown, or other
  misc_feature (482)..(482): n is a, c, t, g, unknown, or other
aagattgtttgtctcgtctccgtggtttcatccccgccttaccccnnaccntaaaaaaactggcactccccgcggtggcggccgctctagaatagtggatcccccgggctgcaggaattcgcacgagaccattacctagaacatcctaatcgaaaaaaaaaggctgagaggctgtaaagagtgttgaaggacgctcggttccttcaggtgcggcggcgaccttgtctaggattttacccgtggaacgtggcgaccacttccgacgggccactcgccgccgctcgcccggcctgctcttgcacccttctcccgggaccgggacaagcgatctcccgtccccgtaatccgcaagaaaaagatttttttctcagtttccaatgaaaaaattatcccgggggcgggggctccggcctctttgacggggggggagggggggtgggtattattttgaccggactgtggcgaacgcgaggagggaaaancccccacagtgggccaaaaaagggggggtttgtcctcgaccccggggcgggatggggggcgaaaaccccggatatagttgccgggggagaatttctccgggacaaaacccatgaggggggcttctggggtcatgaggaacgtgcccgccactggggccggcataaaggggtttggtccgcgttggtattccccttcttcgggagaggcgggtttcctttaaaaggcgcgcggcgggggtattgcggaaatatgtggtgtgggggggcacctaattttgcggggggggagttatccctgcgggcgggcggtttttatctacggagagcatatttgattttttccgccgcgcgcgtatttttgcggaagcccggccctcttttatactctcccccccccccagtagagg

SEQ ID NO: 58050 - DNA, 715 bp, Zea mays
  misc_feature: Ceres CLONE 1510160
  misc_feature: Pfam Name: Sec62 Pfam Description: Translocation protein Sec62
tggagctccccgcggtggcggccgctctagaactagtggatcccccgggctgcaggaattcgcacgagaccattacctagaacatcctaatcgaaaacaatataaatgcagaggagacaacatttagagaactggttcgtttttggcctgaaaaagatgaaggagagcggccaaagtggacatcaagacttttctatgctcttgttgctctattggtgatattactgcttaggcaccatgctcctgacgaagcagctagagccaggtaccaaaagaaggtttctaacataattgatgatgttcttgaatggtccccaagttagctatttctggaatgattgaaaacacactggggctaacatacggaagaaagcaataccctagcagggctgcgagtagtcatgtgcctcctttcacaaagccaaggcttcagagcccggttcgatacgaaattggagcctacttaatgaacccccaaaaaggaaattggtgtggaccagaaccaccgagcttaaaacccctctatcttggatttttggagcacctttgttttgttacccgggggacctgggaaaatctttcgggaccaaaaaatttgggggggggttttgggtcaccccaaattggggcggggggggggttttaggggccccaaaaattttttgaaggggggaaattttttttttttttctgggaagggtgttttttttttttt

SEQ ID NO: 58051 - DNA, 946 bp, Zea mays
  misc_feature: Ceres CLONE 1510170
  misc_feature: Encodes the peptide sequence at SEQ ID NO. 58052
  misc_feature (776)..(776): n is a, c, t, g, unknown, or other
gcccccccctcgagaagtaccccacaacaaccaccacaaccttacacccaaactggcactccccgcggtggcggccgctctagaatagtggatcccccgggctgcaggaattcgcacgagaccattacctagaacatcctaatcgaaaaaatccaccctcgttctcaggcactgtcacacagacacagctgacctgccactgccaggaaagtaggtcgaggatgccccgcagcggcttctcggggtccttcacgtcgcccaagatcgacgtcgtcatcgacatgggaaaccccttcctcaaccgcaccgtcgacggcttcctcaagatcggcgccgtcagcgcctgtaaagtggctgccgagtagaccttctagtgcctccacaggggggatgttttcgaaccacaacggttgaatctgcccctgaaaaaaaagcgccaagaagggggaatatttggggaaatggaggcgccccccccccctgggcaaatggaggatagggcaaaggaaaaggggtcccccggggcctctaattggactggataaaaaaccccccaattatattgggtgggggcccctatggtcccaggagcccctcagtaacttcacaggggtcccccgtcacaacaaatcacaaaagaaacggccaccggcgcccgccattatagtgatgcgcccaccctactccgtcgctggaggttgggattcaccccacaagccccgcgtcaaacaatacttcaatacgcgggcttatatacccacgcccccaccctaatnataataacaagtgcccttttctcgccggatccgccttccgactctttccaataattttgatcaagacaggcacctgtgggccgggggtgaccccccccaaaaaataaaaaagaataagactgcttatttcgcaccttctcgatatcttattggggcgcgccggccgccac

SEQ ID NO: 58052 - protein, 47 aa, Zea mays
  misc_feature: Ceres CLONE 1510170
MPRSGFSGSFTSPKIDVVIDMGNPFLNRTVDGFLKIGAVSACKVAAE

SEQ ID NO: 58053 - DNA, 722 bp, Zea mays
  misc_feature: Ceres CLONE 1510176
  misc_feature: Translation starting site: 221
  misc_feature: Pfam Name: Rhomboid Pfam Description: Rhomboid family
tccccgcggtggcggccgctctagaactagtggatcccccgggctgcaggaattcgcacgagaccattacctagaacatcctaatcgaaaactccccttgcacgacgtctccaccactacaccacacctcaagtccacaacaccaccagcctcgtctcagccgcttcagcataccacaccgcacgcaaacccaccgcgcgctacgaccaccaccgtcaccatggccgccgcgcgctacgacgtggagaagggcgggaggaataacggggatgggaagccttcgccgccgccgccgggccacctgtacccgcagcgcgacggggagagggagtgggtgccgtggttggtgccgctcgtcgtggccgtcaacatcgtgctcttcgccgtggcgatgtacgtcaacaaccgcccggcccacgccgcctcgtctcgccgcggcggcgccggatcatgcgtcgcccgcgggttcctccaccgcttctcgttccagccgctcagcgagaacccgctcctcggggcctcgtcggccacgctgcataagctgggagcgcttgtatgggaaaaagttgtgcgggaggcaccaagggtggagggtcgtcacctggctctggctggccgccggtgttgcccaccctttggccaaaatgatcagcctcgtgctcatcgggccccgaaaggaaacaagattttggaaacctgaaaagtggcatcacctaccttgg

SEQ ID NO: 58054 - DNA, 735 bp, Zea mays
  misc_feature: Ceres CLONE 1510194
  misc_feature: Encodes the peptide sequence at SEQ ID NO. 58055
  misc_feature (411)..(411): n is a, c, t, g, unknown, or other
  misc_feature (453)..(453): n is a, c, t, g, unknown, or other
  misc_feature (478)..(478): n is a, c, t, g, unknown, or other
ggagctccccgcggtggcggccgctctagaactagtggatcccccgggctgcaggaattcgcacgagaccattacctagaacatcctaatcgaaaagcgggtttgttgcagcagcatccatcgcgtgcgtacattaatctaagcgatcttcatccagccttctgctctgctccctcgaaatggaggcgacgagcaaggcgatggcttcaggcctcctcgttctgctgcttctcatcaacacaggctttgtcctgcccgtccattccgaggactgctgggccgacacccgcgtcatctgcaccaagacgcacaactgccgggacgacacttgcgcggggcgcggcatgccggacggccgctgccactgggagttccccacctggtgcccttttctgcagtgctgcgccccanctgccactagtcccgggcgccctcgattggctcacttcgccngcgatgatggatggtgccaactgcnactgcccagtctgctcccattcgttgtggttaaggcataataaataactgccaaatcacatgaaatttgggaaaatttgttaccaacctatgaaatgacgggaaaccgtggttcggaatggccttcaaaaaaaaaaaaaaaagtttaccctacccgccaaccccagggggggcccggaacccaatttcccccaaaaggggagcaaaaaccccgccccctgggcccctttttacacaggggggggaggggaaaacccg

SEQ ID NO: 58055 - protein, 112 aa, Zea mays
  misc_feature: Ceres CLONE 1510194
  misc_feature (78)..(78): Xaa is any aa, unknown, or other
  misc_feature (92)..(92): Xaa is any aa, unknown, or other
  misc_feature (100)..(100): Xaa is any aa, unknown, or other
MEATSKAMASGLLVLLLLINTGFVLPVHSEDCWADTRVICTKTHNCRDDTCAGRGMPDGRCHWEFPTWCPFLQCCAPXATSPGRPRLAHFAXDDGWCQLXLPSLLPFVVVKA

SEQ ID NO: 58056 - DNA, 679 bp, Zea mays
  misc_feature: Ceres CLONE 1510195
  misc_feature: Encodes the peptide sequence at SEQ ID NO. 58057
  misc_feature (341)..(341): n is a, c, t, g, unknown, or other
  misc_feature (397)..(397): n is a, c, t, g, unknown, or other
  misc_feature (500)..(500): n is a, c, t, g, unknown, or other
agtggatcccccgggctgcaggaattcgcacgagaccattacctagaacatcctaatcgaaaactaactcagcactcggcagtcccagctcatccccatccctgcccgtctccccggccggccactcgaccagaagcacgcgagcgagcggagaccgatcgaggccgacagccatgggcaagcaagcgatggcgctggcgctgctgtgcgccgtcctgctggcggcgacggcggacgccgcggcggcggcgtcgtgcaacccgtcggcgctgagcgcgtgcgcgcccgcgttgttcggcagggcggtcacgctggggtgctgcgcgtcgctgcgcgcgcancagccctgcctctgccagtacaagcgcgactccgtgaaccccccctacgtcaacgngcccgccgcgcagcgcttcacccgcgcctgcggcctcacccagatgaagtgctgatggaccgagagcctgcatgcgctccggcggccgctggcgatgttgganaatgcccggctacctggatgaactattactacgagcccccgggggggtccatggaaatacataccgtggccgttaaataaaaacgccgatctcggggaactccccaggtcgggcctctgggaaaatcgggggccatccaccaaatacttcttccaaaaggagcaagggctggccccctg

SEQ ID NO: 58057 - protein, 92 aa, Zea mays
  misc_feature: Ceres CLONE 1510195
  misc_feature (28)..(92): Pfam Name: Tryp_alpha_amyl Pfam Description: Protease inhibitor/seed storage/LTP family
  misc_feature (56)..(56): Xaa is any aa, unknown, or other
  misc_feature (75)..(75): Xaa is any aa, unknown, or other
MGKQAMALALLCAVLLAATADAAAAASCNPSALSACAPALFGRAVTLGCCASLRAXQPCLCQYKRDSVNPPYVNXPAAQRFTRACGLTQMKC

SEQ ID NO: 58058 - DNA, 719 bp, Zea mays
  misc_feature: Ceres CLONE 1510199
  misc_feature (460)..(460): n is a, c, t, g, unknown, or other
  misc_feature (476)..(476): n is a, c, t, g, unknown, or other
  misc_feature (477)..(477): n is a, c, t, g, unknown, or other
tggagctccccgcggtggcggccgctctagaactagtggatcccccgggctgcaggaattcgcacgagaccattacctagaacatcctaatcgaaaactcactctcactctcacttccacactcctactcctccccgcccccgtcgccttccgccgccgtcttttgcgctaacgcttcgcctttcgatcccctttctgacttcttatagcatcatcccaagtcctcgcccggactccgcagattctctggttgctacgagttcttcgcctggtttttgggcaaggccaaaatttctgatttttttccccgccgcaaacccctttgctgtgccataccgccattccattccctaactgggcgtgggcggttgaaaaaagaagcgaggcccggctgttcgctgaaccccgccgccttttttctttttctttctgggactgattgaaaaccgtaccaaattangggaggaaggaacgcnngcgcccgtcggtcggtcaaaagattcacctggggttccccgggtgttccggaagggccgggaaccctgtccccatggtaaaaccgggcccctccggaatggcaatccccttcgggaacaaggaaaaagggaagggcccgaacccccaaaaacggggaggcccttctgggactcctgtgcaaaggcccccaattccaaaaacaaaaaagggggcccacccggcccccgcccccgagaaaaggg

SEQ ID NO: 58059 - DNA, 717 bp, Zea mays
  misc_feature: Ceres CLONE 1510691
  misc_feature: Encodes the peptide sequence at SEQ ID NO. 58060
caagctggagctccccgcggtggcggccgctctagaactagtggatcccccgggctgcaggaattcgtctcacccctagaaaaagagcacaccacactgcacgcccacaccacggaatagacctctcaacccagaacccagcaggcaccatggccgccgccgtgcccctcctcctccagctgctgctactgccactcctggtcgcgtcagcggcgggcggcggcggcggcgagaagagcacgcacatgaagctgtactggcacgacgtggtgagcgggccgagcccgacggcggtgcaggtggcgcgggcggcggtgaccaacacctccaagaccgccttcggcgtggtggtggtgatcgacgacccgctgacggagggcccggacctcaagtcctcgaagcccctcggccgcgctcagggcacgtacatcggcgccggcaaggacgagctgtccctcatgatgagcatgaacttcgtgttccaggccggcaagtacaacggtagcaccgtggccatcatgtgccggaacgcggtgttcgactccgtccgctagatggctgtggtgggctgcacccgccacttcaggatggcgcgccggttacgcgaaggcccgcacgcatcgcccctcgaaccttattactggctacgcccaccgccaagtacaacctctacatctaggcactggaagggaacctgacccaccactctgggaaatg

SEQ ID NO: 58060 - protein, 134 aa, Zea mays
  misc_feature: Ceres CLONE 1510691
  misc_feature (10)..(134): Pfam Name: Dirigent Pfam Description: Dirigent-like protein
MAAAVPLLLQLLLLPLLVASAAGGGGGEKSTHMKLYWHDVVSGPSPTAVQVARAAVTNTSKTAFGVVVVIDDPLTEGPDLKSSKPLGRAQGTYIGAGKDELSLMMSMNFVFQAGKYNGSTVAIMCRNAVFDSVR

SEQ ID NO: 58061 - DNA, 930 bp, Zea mays
  misc_feature: Ceres CLONE 1510692-R
cgtctcgtttttttttttttttttgcagcacccagtagcaaccttttttccgtgcctattcactttggataaagcctgacgggggtaacggcatccactcgatccaaagtccttgctggttgatgtacgggtctgctggagcccatgattgacccagggctgacaactgacgcttccccaccttgcactccaaaacccagatgggccatgtcatacctgatacgaacttagatcaaccccccggacttgggttcactacccggttgctaactggataacttggccgggccggccccaccgctggcttcctctccttcccttcagagttgccgttaccaccaccgctggtgcctcttacatatgcgccgccactatcaccttagccaccgccacccctgtatgtcagctcccgtcaactcgtcgcgatatacgccgaactgcatttaggcgctctcgccgtcgacattgtcaatttcctccaaagctctactcatcttttcctccgtgaaacaactactctgttttgctcaggactggggctcggagaccgtgatgttgccgccattcagctcctgacacgtcttgccctaggatggcattccatgtatccccccttccggacaatgttgatatgcttacgccgcgagacctctgcgacccccttccgatgatgatattagactctaggtacacttcgtatgagcttaacagatctcgaaggagaaatagattgctctgccctttatttgacgatcgtcagagactcttacataaaaacaaatacttcctactaattggattagcatttttctcggagtcagaagaatcctgccaacccggggatcactagttggtggagagacggcaacccgctggtactcagcttttgtccctgttgggagaggttatctgcagcctggggtatcatgt

SEQ ID NO: 58062 - DNA, 713 bp, Zea mays
  misc_feature: Ceres CLONE 1510692
  misc_feature: Encodes the peptide sequence at SEQ ID NO. 58063
aagctggagctccccgcggtggcggccgctctagaactagtggatcccccgggctgcaggaattcgtctcacccctagaaaaatcgcttccaattaggaggaagtgattttctctcttcccccttcctgttctctgactgtcactagatgatcggcagagcacttcttttttctagagattctagagaaagcgacacaaagatgaagcgaaccagttttctttgtgtaagatcaggtgctatatcatatctcactccctcggaaatcacaaagaaggcaagtggggattacattggatgaatcctttccgcagacatatcaaccaagaaatccaggctatactaagcgctccttgcctttggtttgaacaaaacacattcttgcttcaccgacgaaaacagagaagatctggataaattgacaatgtccacttgaattgactaattccgctccgcctattccacattaatgcgagtacatctatgtttctgctttacgaatatgatactttttggacatttcccataatagcaagccttattcctattttggcattctggatttcaggacttttagccccggctagtgaaggaccagagaagctttctagttatgaatcgggtatagaacacatgggtcggacttgatctctattcccaatacgctattacacgttcgcgctagttttcgtggtctctgacgtggagacaacc

SEQ ID NO: 58063 - protein, 54 aa, Zea mays
  misc_feature: Ceres CLONE 1510692
MFLLYEYDTFWTFPIIASLIPILAFWISGLLAPASEGPEKLSSYESGIEHMGRT

SEQ ID NO: 58064 - DNA, 964 bp, Zea mays
  misc_feature: Ceres CLONE 1510695
  misc_feature: Encodes the peptide sequence at SEQ ID NO. 58065
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
nnnnnnnnnnnnnnnnnnnnnnnnggtttttttttttttcccttannnnagcaagctggcactccccgcggtggcggccgctctagaactagtggatcccccgggctgcaggaattcgtctcacccctagaaaaaccccgatgtccgccatggagaccgacatcaacgcgccgccgcccgccccagccggcgagggatcctccgtggtcggtccgtcctcctcatcctcccgcaagcccaacaagcgcttcgagatcaagaagtggaacgccgtcgcgctctgggcatgggatatcgtcgtcgacaactgcgccatctgccgcaaccacatcatggatctatgcaccgagtgctcgggcgaaccatgcttagcgcgtcccagcgaaggagtgcacttgtcgccttgggggtggcctgtaaaacaatgctttttcccctcccacctgaaataagacaggtggctttaaaaacctcccccaagggtgtgccccctcacaccaacaacgagtgtgaggggggaaggtgtccccaaaaaataggggggtaccatcctatttcccgaggtggccacacggacatttcgcaaaagtctccggaggcgtcttttgtctgtgcccactccttcaagggggttctgtgtgtgtcctcgcgcacaaaaacaacctccccctctctctccactaccgcgagtcatctcccacaggccgactgcaaatcccctgttcccccccgcgggcaagattattatataccatacttaccgcttctctactattatcacccccctcgacgttcgccccacctccctcaccccacccccacctctcttggccgcatagtgagcgggaccaccttattttctaatgttgcttccttccactcactctccaataccctaacacttttccttatatcgacgtgtagctccccactttccggaaccagaccctcagttcgtactccg

SEQ ID NO: 58065 - protein, 100 aa, Zea mays
  misc_feature: Ceres CLONE 1510695
METDINAPPPAPAGEGSSVVGPSSSSSRKPNKRFEIKKWNAVALWAWDIVVDNCAICRNHIMDLCTECSGEPCLARPSEGVHLSPWGWPVKQCFFPSHLK

SEQ ID NO: 58066 - DNA, 876 bp, Zea mays
  misc_feature: Ceres CLONE 1510701
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (33)..(33): n is a, c, t, g, unknown, or other
  misc_feature (47)..(47): n is a, c, t, g, unknown, or other
  misc_feature (49)..(49): n is a, c, t, g, unknown, or other
  misc_feature (50)..(50): n is a, c, t, g, unknown, or other
ttttnnnnttttggggggnnnttggtgtggttntttttctccaatanannaaaaaaaactggaactcaccggcggtggcggccgctctatactagtggatcccccgggctgcaggaattcgtctcacccctagaaaaacgccattccgctgtccgcaatccactccctcctcccacgaaactcttggccatggcttggcgcggcgccgccctcccgctcaatcttcgccggccgtcccgtgcccgccccgcaacctccgcctcctgcgcggggggagttggcgcggttggcggttccctttgccccctccccccgctgcccccgccccccccgactcgcgggcccctatattatttgtttgtgtttgttgtgtttctttttgtgttagtgggaggaagagtatatcaggaaattctgttattttatcactgacctatcagcgtcctgcagagcgtctcgaacttctcatctactccttctttcgccccccccaccacgtactcatcagaccggcgatttttccttgtgaagttatcgtcagttgttctgttatactactcttagtattccatactactatgcccttctgtacggacctactccattaaaccccatacaacctcaatcgtgccgccgacgctgccgggcccgaaaacgtgacggtccggcctttgtctaaatatatcttagaattagttaaataattattatttttctttcatcagatctacccccacccctcccctcaaacttaccaaaagagcgcctgaccaccgcgcggtgcggcggtgccacgcgcgcgggcccgccgcgccggctgcaccgctccatctggcgcacgccggtggcgcgcccgtgcgttactcctttcccagg

SEQ ID NO: 58067 - DNA, 828 bp, Zea mays
  misc_feature: Ceres CLONE 1510705
  misc_feature: Encodes the peptide sequence at SEQ ID NO. 58068
  misc_feature (6)..(6): n is a, c, t, g, unknown, or other
  misc_feature (7)..(7): n is a, c, t, g, unknown, or other
  misc_feature (13)..(13): n is a, c, t, g, unknown, or other
  misc_feature (17)..(17): n is a, c, t, g, unknown, or other
  misc_feature (18)..(18): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
tttttnntttttntttnntttttgtgtcccccccnnnnccccnnnnnnnnacaaagctggactccccgcggtggcggccgctctagaactagtggatcccccgggctgcaggaattcgtctcacccctagaaaaaactgccgcaaaaccacagccacacaggcaacaagcgcccagcgccctttcacatcaccacatccaccgtccacgctcctccgttccatggccatgtcgagcagcgccagcaagaagcaagcccaggcccagaaggccgggcggaggcccccggcggtgtcgtctgccgcggccgctgacgcggagatgcaaaaggtgttctctcgcatcgacgcggacggcgacgggcggatctcgccgtcggagctggcggcagttgactcgcaccaatctccccggccagtgaggtcctcgcgcgtgcggatcgaaggaggcggccatgtattgacgagcttggacactgaccccccaccggggtttggggaatctgggacgaatatcaggagagtaacccctacccttatatgttttgctagtacgactgggtgaatgaggtcaaaggtgccgcgtgtatctccggcccccccccttcccccacgggtaccgatgatcaaaaagaggatgtgatgccacatactaggcataaaatgaagttggaaaaaaaccacaccacaccctttcccttccctccgggtgtaaaacccaaaaatacggaccaacctgattgaacagaaacaaaagaactcacccaaccacttccctatcaattattttgtgctcgaggaggcctagtatatcaggcacacgtgtaaac

SEQ ID NO: 58068 - protein, 113 aa, Zea mays
  misc_feature: Ceres CLONE 1510705
  misc_feature (33)..(61): Pfam Name: efhand Pfam Description: EF hand
MAMSSSASKKQAQAQKAGRRPPAVSSAAAADAEMQKVFSRIDADGDGRISPSELAAVDSHQSPRPVRSSRVRIEGGGHVLTSLDTDPPPGFGESGTNIRRVTPTLICFASTTG

SEQ ID NO: 58069 - DNA, 722 bp, Zea mays
  misc_feature: Ceres CLONE 1510708
  misc_feature: Encodes the peptide sequence at SEQ ID NO. 58070
aaagctggagctccccgcggtggcggccgctctagaactagtggatcccccgggctgcaggaattcgtctcacccctagaaaaaaaacactcatcacgccgccactgatctgctctgttgctggtgactaggagcagtagcgagagggattctggatggccaagtcgaagaaccacacggcgcataaccagtcgttcaaggcgcacaagaacggcatcaagaagcccaagcgccaccgccagacctccaccaaggggatggacccgaagtttctgaggaacttgaggtactcaaggaagggcaacaagaagagtggcgaggctgagtccgaggagtaagatgatggtgattgagtttgtggcgacaaatgcatctcttgtatcgctaagagtcttagctgtgaacttagttctcacttctgtgtgactgtgatcaaaggacttgtgtatgatcaaaggagatccatcacttggtaccaaagcgaattttaagccctggtgggtacctgggaatttattaaaacctcaccttgtttccttttaaaaatgggccaattgatgggccctttccccggtcacaaaaatttaaaaaattttgcccctatatacacaaaaaaaatccggccctcccagggcccccattttcccccttaagggggagtttttttcacccccgccaccaggggcggtgtttttaacacacgcctgtgctgggggaaaacc

SEQ ID NO: 58070 - protein, 60 aa, Zea mays; identical to SEQ ID NO: 1569
  misc_feature: Ceres CLONE 1510708
  misc_feature (3)..(42): Pfam Name: Ribosomal_L29e Pfam Description: Ribosomal L29e protein family

SEQ ID NO: 58071 - DNA, 710 bp, Zea mays
  misc_feature: Ceres CLONE 1510709
  misc_feature: Encodes the peptide sequence at SEQ ID NO. 58072
atagctggagctccccgcggtggcggccgctctagaactagtggatcccccgggctgcaggaattcgtctcacccctagaaaaaaagcgtcccgcgagaaactggtgttccggaccaccacgcggatgggctcgggcgacccggcggccgaccccctttcttccttcctccgccaccccggcgcgttctccttctcccgtcgcgtcgccatggcgcgcgacgccaccgccacatccgtgccagcgctccgcccctggcttgttgacctcctcccgctcctcgtcgtcctcctcatcgccgcccacgtcctcgctctcggttactggatctacaggctcgccacggacgggtccaggcagcccgcgcggagcaagaagcactaaggggacggcgcccgcggccggatgcttgacaccagtttgttatttcagtcctgcatccttggcttgttgatctcaagccttccaacgtcagatgatggcgtggaaagttcctgaaagaactaggacaggaaaccgatcttatcccaatggtttgttcaaatgttgggtgtcaaaagtgaccattagcttgatagcctgatatgtgggaaggagggccctttttgaccattaaataagttttccggttgcctggaaaaggtttgacatccttctaaaccttctccttgttaaaaaaaacagtatcttagacacgaattggcccgtttt

SEQ ID NO: 58072 - protein, 57 aa, Zea mays; identical to SEQ ID NO: 56654
  misc_feature: Ceres CLONE 1510709

SEQ ID NO: 58073 - DNA, 682 bp, Zea mays
  misc_feature: Ceres CLONE 1510720
  misc_feature: Encodes the peptide sequence at SEQ ID NO. 58074
  misc_feature (456)..(456): n is a, c, t, g, unknown, or other
  misc_feature (682)..(682): n is a, c, t, g, unknown, or other
aagctggagctccccgcggtggcggccgctctagaactagtggatcccccgggctgcaggaattcgtctcacccctagaaaaaatcacaagcaaaagcaacaaggcagcagcacaagcaagaaccacacctcctcccttcgcctgtgatcatgtcgtcttgctgcggcggcaagtgcgggtgcggctccagctgctcctgcggcagcggatgcaacggctgcggtatgtaccctgacgtggagaccgccgccaccagcagcgtcaagaccacggtcctcgccgcgccgaccaccaaggccagcgccggcggcttcgaggcggccaccgagggcggcggctgcgactgcaacacctgcaagtgcggcaccagctgcggctgctcctgctgcagctgccactgagctggccccggccggcgatggcgcacgagagtccagagggagacgacgaccacnatgcgtataattttataacggcgtcaagtaaataagatccggtcaacgcacccgccattattcctgggccgctccgtccttccccggggtttcccgggccggggggtcccccaaaacccccctcccggtttcccaagagggaaagcccgccccccaaaaaaactctgtccccctccggggcggaatttaaaattaaacctcttttgggggggtttttttccgcccn

SEQ ID NO: 58074 - protein, 83 aa, Zea mays
  misc_feature: Ceres CLONE 1510720
  misc_feature (1)..(82): Pfam Name: Metallothio_2 Pfam Description: Metallothionein
MSSCCGGKCGCGSSCSCGSGCNGCGMYPDVETAATSSVKTTVLAAPTTKASAGGFEAATEGGGCDCNTCKCGTSCGCSCCSCH

SEQ ID NO: 58075 - DNA, 856 bp, Zea mays
  misc_feature: Ceres CLONE 1510721
  misc_feature (6)..(6): n is a, c, t, g, unknown, or other
  misc_feature (18)..(18): n is a, c, t, g, unknown, or other
  misc_feature (26)..(26): n is a, c, t, g, unknown, or other
tttttnttttggttttgngtgtgttntttttttttcttgttgttttctgctgttgttcctcgttccccacaacaactaaactggtactccaccgcggtggcggccgctctagaactagtggatcccccgggctgcaggaattcgtctcacccctagaaaaaatctccttgcccgttgtgctctctctcttcattcgttcccggcctcaccccgagccagtcgtctcgctagggtttcgcggccgccgccgccatgccttcgcgcagctcaggaagggctgcccccaccccagctccccgctgctggtttatctgtttaacttctcccagtcctgttgtgctggttcctccctccagtttcggtgctcaaagggggggggctccctggttttgaggtattttgtgctgtccttttccctgggtttggggtttttgttctggtttgtttcgcttttcttccttttgtgctgtttgtttcccgtgtttgtgtttcctcgtgggcgtgtgctcctctcggttgtttctttgtgccccctggtggggtctgctggtgggtgggctgttgttttgttggcctgctggcctcttgtacttgtgcttttttttctccggtgttgtcttttgtcttgtggtgctgtttccgcttagtgtgttcgggctgttgctccatgtgtgcctctgcggtgtgtgggcccggtttgtgttctttcttttgttgtgccctgcctttgttgtttttgggggcgctcctcgctgtggggcgccgggctgtcgtgcgtgggtacgtgtcgagcgtttctcttgtcgctgtataaatactccgctcccctgtggtcttggcgagcttagcccgggcg

SEQ ID NO: 58076 - DNA, 736 bp, Zea mays
  misc_feature: Ceres CLONE 1510723
  misc_feature: Encodes the peptide sequence at SEQ ID NO. 58077
atagctggagctccccgcggtggcggccgctctagaactagtggatcccccgggctgcaggaattcgtctcacccctagaaaaaatcacacactcgactctcctctctcgcatccgcagcctctcgagctctactccatcccctcgatctcgaagcgcagcagcagcagtcaggcggccatggacgcgagcgcagccggagccggcgggaaggcgaagaagggcgcggccgggcgcaaggccggcgggccgaggaagaagtcggtgacgaggtccgtcaaggccgggctgcagtttcccgtcggccgcatcgggcggtacctgaagaagggccggtacgcgcagcgcgtcggcacgggcgcccccgtctacctggccgccgtcctcgagtacctggccgccgaggtgctggagctggccggcaacgctgccaaggacaacaagaagacccgcatcatcccgcgccacgtgctccttgccatccgcaacgacgaggagctcggcaagctgctgtccggcgtcaccatcgcccacggcggcgtcctccccaacatcaacccggtgctcctgcccaagaagaccgcggagaaagcggcggccaaggaggccaagtcgcccaagaaggccgccaagtccccccagaaggcatagaggggccgggcgccttttcccgctgtgatgttgaatgccccgtgttcaataaatcctttacgcctgtagtggtccccccttgttat

SEQ ID NO: 58077 - protein, 156 aa, Zea mays
  misc_feature: Ceres CLONE 1510723
  misc_feature (31)..(104): Pfam Name: Histone Pfam Description: Core histone H2A/H2B/H3/H4
MDASAAGAGGKAKKGAAGRKAGGPRKKSVTRSVKAGLQFPVGRIGRYLKKGRYAQRVGTGAPVYLAAVLEYLAAEVLELAGNAAKDNKKTRIIPRHVLLAIRNDEELGKLLSGVTIAHGGVLPNINPVLLPKKTAEKAAAKEAKSPKKAAKSPQKA

SEQ ID NO: 58078 - DNA, 819 bp, Zea mays
  misc_feature: Ceres CLONE 1510732
  misc_feature: Translation starting site: 226
  misc_feature (20)..(20): n is a, c, t, g, unknown, or other
  misc_feature (46)..(46): n is a, c, t, g, unknown, or other
ggggggggggggggtggggntttttttcttatttttttgatagacnttcacactggagctccccgcggtggcggccgctctagtctagtggatcccccgggctgcaggaattcgtctcacccctagaaaaagaagcttatcgcttatcatacgcgcctctacatttcttctctctctgctcctccgcctccgcctccgcctgatccatccaagacagggatcgccatgtctgactcggaggagcaccacttcgaatcgaaggccgacgctggggcgctccagacctaccactatcacgctggcaccaaccacaagaacaggttcatcttcatcattaaccgtccctgcccagctgtggaggtctcttcctccaatactggttttcatggccactccaaaagccccttcgacaccataaacatattccatgccccaaaagcttgaaaattatgcttccttcatcccaccccccccccctttcctccatgtgaaccctacctggcgtaccccctccattcacaccctcccaccgaccaatcccctgcaccccccccccccccccccctcccccttcttattaatatctttataactcccccattcgtatcactcccgccctccgcccccatattattgctctagcgttcttgtttcgcaaaaacggcccctcgccctcgcactcgcccgcgactccgcgctgcgtccacacccccccagccccctgtctcttcccccgcgcccccgtccccccccctccccatactctaattcaccacatttcgctaaatccaaaacaacccaacatcctagacccatacg

SEQ ID NO: 58079 - DNA, 761 bp, Zea mays
  misc_feature: Ceres CLONE 1510737
  misc_feature: Encodes the peptide sequence at SEQ ID NO. 58080
ggatcccccgggctgcaggaattcgtctcacccctagaaaaagcagtcatccccgagaagagccgccgccgccgcgcaaagccgcttcaacgccgtcactcctcggggcgcaaccatggtggccgcaaagaagacgaagaagtccacggacaacatcaacaacaagcttcagcttgtgatgaagagcggcaagtacacgctcggctacaagactgtcctcatgaccctcaggaattctaagtcatagctagtgatcattgctaacaactgtcctccgcttcggaagtctgaaattgagtactttgctatgcttggttaaggtgacagtcccaccccttcctgggaacaaaggttgcccctgggaacaccctctgcgaaaaaacctcccgggtcctcgtggcctccaatttttcccaccccgggggaaccctagatacaacataatattcccctcgggggagagtaggtaggggggggcaaacatccctttggcccccggggtcttcagaatccccatcaaccccggacgattctggagccgcctgggggtttgtaggggggcccccacccaaagatacaaaaaagctcggcggccaaatcttggggaagttttgtaacgttcttccccccctatatttttttaccattggggagaagaagttctattcgtcagggtgcggtccctcctatcgtccctaacaaaaaaaaataacacccggccccccgggaggacactctcctctctcttcctggactgggtc

SEQ ID NO: 58080 - protein, 43 aa, Zea mays
  misc_feature: Ceres CLONE 1510737
MVAAKKTKKSTDNINNKLQLVMKSGKYTLGYKTVLMTLRNSKS

SEQ ID NO: 58081 - DNA, 727 bp, Zea mays
  misc_feature: Ceres CLONE 1510738
  misc_feature: Encodes the peptide sequence at SEQ ID NO. 58082
atagctggagctccccgcggtggcggccgctctagactagtggatcccccgggctgcaggaattcgtctcacccctagaaaaagccgaagccgcgcgacggaaaccccaaacccaacctcatctcttttctcggcctctaccgccccctcgatcggtcggccggtcagctatgacgccgggaagctcggccgccggatccggcgtcgtcgttcctcggaacttcaggctcctagaagagcttgaacgtggagagaagggcattggagatgggacagtgagctatggaatggatgacgcagatgacatctacatgcgatcatggactggcactattattggccctcataataccgtccatgagggtcgtatctaccagctgaagttgtgctgcgacaaggactaccctgagaagccaccatcagttcgatttcattcaagaataaacttaacctgcgttaatcatgaaactggagtgtttgaccccaagaagttcaccgttctgggtaactggcagcgtgattactcaatggaatacatcccaacccatctccagaaagaaatgacatcccccccaaaaccccagcctagttccgccctccgaagggaacattcttctaaaaaagggcagcgactccatgtcccatccagggggactctggaaaaccgcctccccccaccttggtttcctataaattttaaacaacccaaggcccgcaccctcccccc

SEQ ID NO: 58082 - protein, 185 aa, Zea mays
  misc_feature: Ceres CLONE 1510738
  misc_feature (19)..(156): Pfam Name: UQ_con Pfam Description: Ubiquitin-conjugating enzyme
  misc_feature: SWISSPROT Homolog: EC 6.3.2.19 Ubiquitin--protein ligase
MTPGSSAAGSGVVVPRNFRLLEELERGEKGIGDGTVSYGMDDADDIYMRSWTGTIIGPHNTVHEGRIYQLKLCCDKDYPEKPPSVRFHSRINLTCVNHETGVFDPKKFTVLGNWQRDYSMEYIPTHLQKEMTSPPKPQPSSALRREHSSKKGQRLHVPSRGTLENRLPPPWFPINFKQPKARTLP

SEQ ID NO: 58083 - DNA, 800 bp, Zea mays
  misc_feature: Ceres CLONE 1510739
  misc_feature: Translation starting site: 154
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
atagctggagctccccgcggtggcggccgctctagaactagtggatcccccgggctgcaggaattcgtctcacccctagaaaaaagcaaataagacgacttgtttcattgattcttgaagagatcgagcttctgttgcaccacaaggtctaggatgtcttgcaactgcggatcaagctgcggctgcggctcaagctacaagtgcggcaagaagtaccctgacctgcaggagacgagcaccgccgcgcaggccaccgtcgtcctcggcgtggtcccggagaccaaggccgcacccgatttcctcgagcctcgcgggattcgggtgaggccgcccaagcatgctgttggggaagcacctgacaaggcgacccctgcaacgggtgatccattccttcgaagaccctggaatggtttttatccctcccacctgggggggggggggaaaaaaaaaaaagaaaagggccaaacctgcccccaaaaacagggttgggggggccgggagaaaaaaaaaaaaaaaaaaatttttcccgagtgcgttttctttcccccccagagggggggcccacccctcccccccccccccccggggggtccaccccgcggggagaaaaaaaaaaagggcccgtggtgcccaccaaaaatattgggcccccccgcgaattattttcccccccccttatttatttattaaaaaaaaaccgcgccttcttttataaaaaaaannnnnccccccccccccctgttgtgggagggagggaaaaaaaaaaaaaagggggggggggggggggggcgcccctttct

SEQ ID NO: 58084 - DNA, 841 bp, Zea mays
  misc_feature: Ceres CLONE 1510744
  misc_feature: Encodes the peptide sequence at SEQ ID NO. 58085
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (48)..(48): n is a, c, t, g, unknown, or other
  misc_feature (49)..(49): n is a, c, t, g, unknown, or other
  misc_feature (51)..(51): n is a, c, t, g, unknown, or other
nnnnnntttttttttttnnnnnttttttttnnnannnnnaccggtctnntntcaagctggatctccccgcggtggcggccgctctagactagtggatcccccgggctgcaggaattcgtctcacccctagaaaaagtgctttcttagaggtgggttggcttctcctccccctccggttcgggttcgggttcgtgaggttctccggggttcggcttcgtgggtgagtggatcgagatggcggcgtcggatgttgagtaccgttgcttcgtcatcagcctcgtctggggctcggacgaccactccctccacaacgacttcatcacctacggggaggtcctcgagtccaacatcatccaccatcggcacacacataagtcccggcgctttggcttcgtcaccttctcctccggaagatgcaatgcagtacagcatcaaggccaagaaccgcaaggaactggtacagcccaacatcaccccacaaccaagcccccctcccccgaccgtccttcgtattccatctgactgtatgtttcctgatttttcctctgcatgtctttcttctccttgctaatatttcccccgcccttacaatgtatgacgcgctgagaactggttttttgtcctctcttcttttttactcgatttgtgagggctttattactcttccatttccgactcaccatccattcctaaaaattttttcacatttggttttgcttcctgcccgcgcgaaacttcgctacttcttcaccattcctctctcacctctcactcctccggtgagtttcggtgtttaatacaagctcatgttttggtcgcccctccctccccttctctcctc

SEQ ID NO: 58085 - protein, 95 aa, Zea mays
  misc_feature: Ceres CLONE 1510744
MAASDVEYRCFVISLVWGSDDHSLHNDFITYGEVLESNIIHHRHTHKSRRFGFVTFSSGRCNAVQHQGQEPQGTGTAQHHPTTKPPSPDRPSYSI

SEQ ID NO: 58086 - DNA, 773 bp, Zea mays
  misc_feature: Ceres CLONE 1510756
  misc_feature: Encodes the peptide sequence at SEQ ID NO. 58087
  misc_feature (39)..(39): n is a, c, t, g, unknown, or other
  misc_feature (43)..(43): n is a, c, t, g, unknown, or other
  misc_feature (46)..(46): n is a, c, t, g, unknown, or other
tttgtgaattttgtttggtgggagggagagtggcgaagngganganggggtgcaaactggagctccccgcggtggcggccgctctagaactagtggatcccccgggctgcaggaattcgtctcacccctagaaaaaaccagagtcatcgcggcgtgttcaaatcccacaatcttcttgtagcacaccactgtcttcgtccaactcggcggcgatgtctgggcgcggcaagggcggcaaggggctgggcaagggtggtgcgaaacgccaccgtaaggttctccgcgacaacatccagggtatcacgaagccggcaatccggaggctggcgaggaggggcggcgtgaagcgtatctccgggcttatctacgaggagacccgcggcgtgctcaagatcttcctcgagaatgtcatccgcgacgcggtcacctacaccgagcacgctcgccgcaagaccgtcaccgccatggatgttgtgtacgccctcaagcgccagggccgcactctgtacgggttcggtggttgagcgcatctcttccctcgtctgcagcgggtgccgggggcgtttcctcagttccctctgccttgcttggcttgatggtaagagttatcagattaaaatatctcgtgatgtgcttcgttattgggggggaatcctgtgtccccatcagggcctgagaaaccgagatcaagagaaaagaaaaaaaacgaagaacgctcaaaggaccccaattcgccccaagagggaagtcgcgatttacgcaagactcctgtg

SEQ ID NO: 58087 - protein, 103 aa, Zea mays; identical to SEQ ID NO: 6459
  misc_feature: Ceres CLONE 1510756
  misc_feature (25)..(94): Pfam Name: Histone Pfam Description: Core histone H2A/H2B/H3/H4

SEQ ID NO: 58088 - DNA, 735 bp, Zea mays
  misc_feature: Ceres CLONE 1510757
  misc_feature: Encodes the peptide sequence at SEQ ID NO. 58089
  misc_feature (735)..(735): n is a, c, t, g, unknown, or other
aaagctggagctccccgcggtggcggccgctctagaactagtggatcccccgggctgcaggaattcgtctcacccctagaaaaaagcagggcgccgcacggaagaagaggccgagcgctctacgtctgccatggcgagctcttccgaccccgacaagctcatgagcaaagccgacaaactgtaattaggcttgcaaggaagctaccaacaggtgatctgcaggccatcaagaaatctgacgatggcgaggaatccttggacgaggatgacctgacttaaaacgatctcccgagccaaaaggtgcagagaacaaacgtcatagtttgccatcggtgggggaacaactgtaaaaagaacttatgcgagttacatactaaaaacttgggggcagcattcccatatctataaacatgaaatttcgtaaggcccaattatgttgtatccgtactggtggtttggtgtcaccgacacttacagggacgtctatggcttcttgtaccacatgattcttgaaaaccccgattggtgtacaataactatgttggtccccagaacaaaaaaaaaaccagaccctcccaggaaccgaattcccccctatggtgaggccttaattaccccccgcttcactgggtccccccctttttacaaacggtctgtgacagaggaaaaaacccctgggcgtaagacacaaagtttacgccccccttgggaccccaagactcccccccctttccn

SEQ ID NO: 58089 - protein, 92 aa, Zea mays
  misc_feature: Ceres CLONE 1510757
KAGAPRGGGRSRTSGSPGLQEFVSPLEKSRAPHGRRGRALYVCHGELFRPRQAHEQSRQTVIRLARKLPTGDLQAIKKSDDGEESLDEDDLT

SEQ ID NO: 58090 - DNA, 709 bp, Zea mays
  misc_feature: Ceres CLONE 1510779
  misc_feature: Encodes the peptide sequence at SEQ ID NO. 58091
  misc_feature (709)..(709): n is a, c, t, g, unknown, or other
aagctggagctccccgcggtggcggccgctctagaactagtggatcccccgggctgcaggaattcgtctcacccctagaaaaaatccctccttcaccatcagcaaatcggtctgccctggtttcccccgtcgtgaagcagaaacctctctgctgccattaccgtgctgcgcgccgtcgcggtgaggcttggccacaaccgtggaactgtctccatatggcgtaggcggcgtaccgagcttcgcctgatggatttgcagtccagtgggcccataatttctcgccggaccgcgagcagcaacaacctctcctcgccggccatgacctctacgcactccaagctctcctccgaggaccgtcatcttcgtgcatgtagtcgagtaaggtcacgaggatctgaagaatcaccctggtatctggaatctcaagtgctaggagaagagcaggtggttcaggaggagccgcctaacactgaggagttcgatctgatctaggtggcgtttcccagtcgacattggcgccgacgatccttagttcgttttatgtttattcttttattttgaaataagtcttccgctatgtaataagtactctgattgtttatgacatttatctctatacactctgtgattatataaaaaaaacaaaacacataacattttttctcttttcttcttgattattaaaaaataaccgaaacgcttcaggtcn

SEQ ID NO: 58091 - protein, 81 aa, Zea mays
  misc_feature: Ceres CLONE 1510779
MDLQSSGPIISRRTASSNNLSSPAMTSTHSKLSSEDRHLRACSRVRSRGSEESPWYLESQVLGEEQVVQEEPPNTEEFDLI

SEQ ID NO: 58092 - DNA, 673 bp, Zea mays
  misc_feature: Ceres CLONE 1510782
  misc_feature: Encodes the peptide sequence at SEQ ID NO. 58093
aagctggagctccccgcggtggcggccgctctagaactagtggatcccccgggctgcaggaattcgtctcacccctagaaaaaattcgttgcagtagtcgcagctgacggacgactgaaccaccgacagacaacatggccgcctccgcctccaccgtctccggcctcgccggcgcctccctggccagccgcccggcgttctccaccagcttcacgcggggcagccgggtgtcggcgaggaaccccctgatgagcaggaacctggagaggaatggcaggatcacctgcatgacgtttccccgggactggctgcggagggacctgagcgtcatcggcttcgggctcatcggctggatggggccgtccagcgtcccggccatcaacggcaacagcctcacggggctcttcttctccagcatcggccaggagctggcccacttccccacgcccccgcccgtcacctcccagttctggctgtggctagtgacatggcacctggggcctgttcatcgtgctcaccttcggccagatcggattcagggccaggacgaaggactatttcgaagaatgaagcggttatgaacggaatccttcaccgctggtgctgcgttgcctgcctgcccggcccaatccaaccttttgctgtgtatagggttccaaattcctggaaagga

SEQ ID NO: 58093 - protein, 148 aa, Zea mays
  misc_feature: Ceres CLONE 1510782
MAASASTVSGLAGASLASRPAFSTSFTRGSRVSARNPLMSRNLERNGRITCMTFPRDWLRRDLSVIGFGLIGWMGPSSVPAINGNSLTGLFFSSIGQELAHFPTPPPVTSQFWLWLVTWHLGPVHRAHLRPDRIQGQDEGLFRRMKRL

SEQ ID NO: 58094 - DNA, 741 bp, Zea mays
  misc_feature: Ceres CLONE 1510784
  misc_feature: Translation starting site: 156
  misc_feature (741)..(741): n is a, c, t, g, unknown, or other
acccgcggtggcggccgctctagaactagtggatcccccgggctgcaggaattcgtctcacccctagaaaaaaacgctctccgccgccacttctcctccggcatcgacgaggcgaagccccagcgcccgagtccctctccctgctcccacgacccatggcggcggatatggcgtacgcgccgccgatgaaggcgggcaaggccgggttcgaggctggcatgatggatccgcagcacaggatccgcatcacgctctcctccaagagcgtcaagaacctcgagaaagtctgcggggatctggtgaagggcgccaagggtaaggagctcaaggtcaagggccccgtgcggatgcctaccagggtgctccacatcacccaccagaaagtctccctgtggaagaagtaccaacacctggggattccttttgagatgaaggatccccaagagggtgatcgatcttcgccggtaccccagaacgtttcaaagcaaaatcccctcattccccccttgaaaccaggggtccaaggtttgaaggggaccatcaatggaccccttaaaatgggaaccccttttcctttccaaaagggcttctaatggaacaaggaattttttcatttccctaggggaaacccttgggaaacaaagaggaacccaatgtttttcccttctcaaattttaaaacccctctccaggggtcctccggtcaggaatttttccctgttttcaaaaatattctcccccn

SEQ ID NO: 58095 - DNA, 936 bp, Zea mays
  misc_feature: Ceres CLONE 1510785
  misc_feature: Encodes the peptide sequence at SEQ ID NO. 58096
  misc_feature (1)..(1): n is a, c, t, g, unknown, or other
  misc_feature (2)..(2): n is a, c, t, g, unknown, or other
  misc_feature (29)..(29): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (722)..(722): n is a, c, t, g, unknown, or other
  misc_feature (750)..(750): n is a, c, t, g, unknown, or other
nnttttttttttttttttttttttgttanaacannnnccctaaannnnnnnaaaaactggagctccccgcggtggcggccgctctagaactagtggatcccccgggctgcaggaattcgtctcacccctagaaaaacacagcacgcaggcagcacccagcaccacaccacagaccaaaacgaccaccgcacccgcagcagcgaagtgtccaagcggcggcatggcggagagcaaggcgcgtgtcgcgctgttcctggcggcgctcgcggcggcgagcctgctggcgctggccccggccggggcccgtattacgggtgcgtcgaatcagctgaccccgtgcgtgtcctccatcgtcgggaatacgtgaacccaccagggacgagggggggatattcttctgtgggtatttgggggagggtggtttgtttgtgttccccgcgctatcccggggggggggggggggggggtcttaacttcactcatctccctccaaggataggtttttgccccccgcttaaaataaatttaaccctgtcacaaacaaaacccacgaggccctctccgcgccctccccctcccgcgctcccctgcgtgtgtgggaaaaaagtggtggacaaccgctttactcaagggcggggcgcggggggcatgccgtaggagcacgcccccataccgcgggcgaggcacctacctaaacttacacacccctacgccacactccngttcgcgacgcccactaccatgcggccntggcgtgtgccttatttatttgtattatatctacattcattctattcacgagcctcaccatacccgcgcacacaacacacacggacctggggggagagagctgacatttgtttgtcttttaaatcgctttctcgttcttacgccacctatagcggggacgcgcacggggctcaggagatgtaaact

SEQ ID NO: 58096 - protein, 48 aa, Zea mays
  misc_feature: Ceres CLONE 1510785
MAESKARVALFLAALAAASLLALAPAGARITGASNQLTPCVSSIVGNT

SEQ ID NO: 58097 - DNA, 733 bp, Zea mays
  misc_feature: Ceres CLONE 1510786
  misc_feature: Encodes the peptide sequence at SEQ ID NO. 58098
caagctggagctccccgcggtggcggccgctctagaactagtggatcccccgggctgcaggaattcgtctcacccctagaaaaaaaaaacaccgacgcgtacgtagcacagtccattattgccgtctcccttttgcgtgagcaaagaaagagagcgagaagcagtcgccatgtctggcatcatccacaagatcgaggagaagctccacatggggggcgaccacaagaataaggaggaggagcaccacaagaaggccgaggagcaccacaagaaggaggagggggagcaccacaagaaggacggcggggagcacaaggaaggcatcgtggagaagatcaaggacaagatcaccggcgagcacggcgacaagtccggcgaccacaaggagaagaaggacaagaagaagaaggataagaagaagcacggcgagggccacgaccacgacggcggccacagtagcagcagccagcgacagcgactgagatctggtgtcgcagcacaggtgcaacacaagtatgcttgctggatggaggattcataccagctgatgccgatgtagtgtttcactggtgtcctgcatgcatgtatcgggcctttttattcaaaaagaaaaaagaaataacggtccgggatgggtttggtttgccatgggaacttggacacctcccacctaaaatttggggcggctggcccggggcgtgctagctttggacaaaaaaaagtggtccaactg

SEQ ID NO: 58098 - protein, 129 aa, Zea mays
  misc_feature: Ceres CLONE 1510786
  misc_feature (2)..(102): Pfam Name: Dehydrin Pfam Description: Dehydrin
MSGIIHKIEEKLHMGGDHKNKEEEHHKKAEEHHKKEEGEHHKKDGGEHKEGIVEKIKDKITGEHGDKSGDHKEKKDKKKKDKKKHGEGHDHDGGHSSSSQRQRLRSGVAAQVQHKYACWMEDSYQLMPM

SEQ ID NO: 58099 - DNA, 753 bp, Zea mays
  misc_feature: Ceres CLONE 1510788
  misc_feature: Encodes the peptide sequence at SEQ ID NO. 58100
aaagctggagctccccgcggtggcggccgctctagaactagtggatcccccgggctgcaggaattcgtctcacccctagaaaaactgccctggtggaagtctctattcgatcttagcgatttatgattgcatgtcctggataaagcccaaagttgggacagtgtgctttggtgttgttgctagtcaagcagcaattatccttgcaggtggcgagaagggaatgcgctatgcaatgccaaatgctagagtaatgattcatcaacctcaaggtggatctgagggtaatgtggaggaggtgaggcgacaggttggagaaaccatctatgctcgtgataaagttgataaaatgtttgctgctttcaccgggcaaccacttgacatggggcaggaggggacaaaaaaggatccgttcatgtcttcctcaaagggcatggatttcggattgcttgaagctttactggaaaccaagatactagagaaagggacacaccccacattcctattaccaaactagaaatactgccggaactggaagccaaacttagatgctttgccctccctctccaataaaacccctgtaatgaccgaatgttttccccgagaaaccaagattttgttccctttgccactctgggttggtacccttccaccctcttattggttggctccctcaatcggctcttctttgtccctccttgcttaatacaattaatcatcgtctttccgatagggcccaacgaacatctttgtgcg

SEQ ID NO: 58100 - protein, 127 aa, Zea mays
  misc_feature: Ceres CLONE 1510788
  misc_feature (1)..(113): Pfam Name: CLP_protease Pfam Description: Clp protease
  misc_feature: SWISSPROT Homolog: EC 3.4.21.92 Endopeptidase Clp
MSWIKPKVGTVCFGVVASQAAIILAGGEKGMRYAMPNARVMIHQPQGGSEGNVEEVRRQVGETIYARDKVDKMFAAFTGQPLDMGQEGTKKDPFMSSSKGMDFGLLEALLETKILEKGTHPTFLLPN

SEQ ID NO: 58101 - DNA, 865 bp, Zea mays
  misc_feature: Ceres CLONE 1510789
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (865)..(865): n is a, c, t, g, unknown, or other
nnnnnnnnnnnnnnnnnnnnnnnttgtttgtttttttttcccccctnnnnnnaacctggagctccccgcggtggcggccgctctagaactagtggatcccccgggctgcaggaattcgtctcacccctagaaaaaaatccgcggcgtctcatcccgtcctctcgctctcgtccgcagcaccaccgccgccgcgttccattcccatcgttcctgtgcgcgcctgggccgcaccccatattgagttgggggtaggcccgccgcgccacccccccccccccctcccccccgaccccgcccacgccccccctgttattttttctttttttctttgtgggtccgttcccctgacccccctctttgtttctagttgtggtttttcttgttggttggccgtcgcccgccgcagggcgacccccccccctccccctgaattgttgtatcccccccctgcttgcgcggggcggggcgggggttttctcccctgttcttcccttcttccccccccccgttttctctggtcgcttgccccgccgttgcccgtcccccccgcggctctcccctcctcccttccctccttcccccaccccctcctccctccccgtccccctgctctctaccctccaactcatgccttactatccaccacttccccactcccacctccccctcttctcgtcgcctcgtctcgaccttctgttgttcgccccctcgcgccgcggcacctggggggggtaggggctgaaaggcttcctaatccttctttctcattctcctcctcttctcctccctccctctccctccccccccccctctatcttcttttgtgtttagtggttttcgtattttgttttctgtttgctagtgn

SEQ ID NO: 58102 - DNA, 767 bp, Zea mays
  misc_feature: Ceres CLONE 1510792
  misc_feature: Translation starting site: 186
atagctggagctccccgcggtggcggccgctctagaactagtggatcccccgggctgcaggaattcgtctcacccctagaaaaactttcctcgagtttcctattttcctctcctcccccacagcagcccggcgaaaaccctagtaagcaaaccaccggagcagcggcgcttgcgcgagcggagccatggcggacgacgattacaacgaaattgacatggggtatgaggatgagcccccagaaccggagattgaggaaggagctgaagaagagcctgagaacaatgaagatgcccctgatgacgtcataggtggtgagggtgaagataaggaacagggaaaagacccagcgtgaacgccaaacaacaaaatacttgacgaagtacgaacgtgcgcgcatcttgggaacacgagcccttgagataagcatgaaatggctccagcatgggttgaacctggaggaaaaaacggccccctctaaaatttggaatgaaagaacctaaaaaccccccaaaaaaccccttcccgaaaaaagggttactttcccggagggaaacctttaaaaaacgtgggaaataaaaaagaccctttggggagaacccccccagaaacccccgggttggggggaacaaaaaaaccccgataattctttgggtggaaaaaggggtctgggggcaaaaggggggttcccctgaaaaacaactaccccccccccccccccttagggggattattttgcccactaccaccccacaaaaattgttccttg

SEQ ID NO: 58103 - DNA, 950 bp, Zea mays
  misc_feature: Ceres CLONE 1510793
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
ggggggggtttggggggggnnnnnnnngagggtnnnnnnttttnnnnnntcatactggagctccccgcggtggcggccgctctagaactagtggatcccccgggctgcaggaattcgtctcacccctagaaaaatggggacgtccctcccggcctcccccacccgccatcgcccaaaaggagcagcgatccatccatcctatcccctgtgccaaaccctagccggctatggagcatcccgccgccacctcctcacctgatccgacgccgtagctcctctccctgtccctgtccccatctccctccgtctccctggccaagcactccacctgagagcaccctgccccgaactgcaccgcagtccgtcgaccgtaagcggtgggcccatcctcccccccgggtgcgctaggtgaacccccttcgccattggagcaaggaaacaacccccttccttcctggtcatgtgtgtacctaagagtgtcacgccctacccccccttggccttcaaatgtggccataagccgcttaatcttccctctccacaaaagcaccctgccccatttccgtgctctcccttcgttttttccctaatactccatgaggtcttatatatttccacccgcgcaccgtgctcgcgaacgtggccccgcgaaggcggccgctcaaagcgggcccccgctccccgcccccccccgcctccccgtgtttgttccgcccccctctccacaaatcatctaatcctacccataaaaaacaacgtctccttcgcgtatatgattatattatacccctcgccgccttgctccgcttgacgcctcggcccctccctccttcccctcctcctccacacctccccatccctcacacgccccctccgtggttctcctctcccgctctccataccacccccacccctagggttttctgttggccaactgttgtcctgggcgc

SEQ ID NO: 58104 - DNA, 758 bp, Zea mays
  misc_feature: Ceres CLONE 1510797
  misc_feature: Encodes the peptide sequence at SEQ ID NO. 58105
  misc_feature (1)..(1): n is a, c, t, g, unknown, or other
natagctggagctccccgcggtggcggccgctctagaactagtggatcccccgggctgcaggaattcgtctcacccctagaaaaatccgtatttccgtcacaactcacaacccgagccccccaaacccgaagcagcaggagctcccctgaccttgctccgcctccgatcaaggaaaaggaagatgagctactacggccagcagccccccgtcggcgtcccgccgcagcaaggctacccggggaaggacggctacccgccagcggggtacccgccggccggctaccccccgccggcgcagggctacccgccgcagggctacccgcaacagggtttaccacagcagggctacccgccgcagtacgcgccagccgctccacagcagcagcagagcagcgggccttccttcatggaaggaagcttggcctgcccttctgctgctgctgcctccttggacgcctgcttcaaaagggaaccatcctgtgccggggcccaacacaggcctgcaggtgacggcaccagccttaagggaaaaacttggaactggggcccgtggctttccaagggtttgtgctgggggttattcccccggcttttccttttccgttccttgttttgtgtcccctccctcctccccccccggtttcaagcacttccccggcctccctcccatcttcccattgtattcttccgcacggccacgccaccaccccccgcgcctccccccactcgcccctgcggtccatctcggggtcaaccg

SEQ ID NO: 58105 - protein, 192 aa, Zea mays
  misc_feature: Ceres CLONE 1510797
MSYYGQQPPVGVPPQQGYPGKDGYPPAGYPPAGYPPPAQGYPPQGYPQQGLPQQGYPPQYAPAAPQQQQSSGPSFMEGSLACPSAAAASLDACFKREPSCAGAQHRPAGDGTSLKGKTWNWGPWLSKGLCWGLFPRLFLFRSLFCVPSLLPPRFQALPRPPSHLPIVFFRTATPPPPAPPPTRPCGPSRGQP

SEQ ID NO: 58106 - DNA, 713 bp, Zea mays
  misc_feature: Ceres CLONE 1510798
  misc_feature: Translation starting site: 146
aaagctggagctccccgcggtggcggccgctctagaactagtggatcccccgggctgcaggaattcgtctcacccctagaaaaatcctcagtgcgtactgtctgtgcgaaggcgaccattccttcttcgctccttcgccgccgctatggttaagtactcgcaggagccgggcaaccctaccaaatcggccaaggccatgggaagggacctgagggtccacttcaagaacacaagggagacagcttttgcgcttcgcaagctgcctttgaccaaggctaagcgataccttgaggatgttattgctcacaagcaggcaattcccttccggagatactgtggaggtgttggtcgcaccgcacaagcaaagtctcgccactccaatggggagggggcgctggcctgttaagtcacccaggctcatattggatttgctgaagaatgctgagagtaaccctgatgtgaaaggcctgcacttggacaaccctctatgtttcccacctcccggtgaacccaggccaagaacaaaaaggggcctcacctacccgggctctcggaaccccataaccccttacatggcccccccctgtcccccaatgagcctaatcttgtgagaaaaaagaaaaaccccccccaagcaagaaagggtgttcatctttgctccccccgacatgaacccctttcgtaatgtgtatacccatccccagcaagccggt

SEQ ID NO: 58107 - DNA, 731 bp, Zea mays
  misc_feature: Ceres CLONE 1510799
  misc_feature: Encodes the peptide sequence at SEQ ID NO. 58108
atagctggagctccccgcggtggcggccgctctagaactagtggatcccccgggctgcaggaattcgtctcacccctagaaaaaccccgagccgccaaaaccctagcgccgccgccgcgaatcccgcacgaccccaaccatgaccgtgctgagccgccctaccccgggcacggcccagtgcttcgggcggaagaagaccgccgtcgcggttgcgtacacgaagccggggcgcggcctgatcaaggtgaacggcgtcccgattgagctgatccgaccggagatgctccgcctcaaggccttcgagcccatcctgctggcggggcggtcccggttcaaggacatcgacttgcggatccgcgtccgcggcggcgggaagacgtcgcagatctgcgccatccgccaggccgtcgccaaggggctcgccgcctactaccagatgtacgtcgacgaggccgccaagaaggagatcaaggacatctttacccgctacgatcgcaccctcctcgtcgctgacccccggcgctgcgaagccgaaaaagttcggccggacgttggtgcccgcgccaggttcccaaaatcgttacccgttaagcggctggcctgctccctcctctatttttcccgatccgttgtggggggtgccttcccttttatatccctatcaaatggaattctggctaacctggggcccactttctcaagcgggcaacttttaccactaatgggtttag

SEQ ID NO: 58108 - protein, 197 aa, Zea mays
  misc_feature: Ceres CLONE 1510799
  misc_feature (16)..(152): Pfam Name: Ribosomal_S9 Pfam Description: Ribosomal protein S9/S16
MTVLSRPTPGTAQCFGRKKTAVAVAYTKPGRGLIKVNGVPIELIRPEMLRLKAFEPILLAGRSRFKDIDLRIRVRGGGKTSQICAIRQAVAKGLAAYYQMYVDEAAKKEIKDIFTRYDRTLLVADPRRCEAEKVRPDVGARARFPKSLPVKRLACSLLYFSRSVVGGAFPFISLSNGILANLGPTFSSGQLLPLMGL

SEQ ID NO: 58109 - DNA, 627 bp, Zea mays
  misc_feature: Ceres CLONE 1510801
  misc_feature: Encodes the peptide sequence at SEQ ID NO. 58110
tccccgcggtggcggccgctctagaactagtggatcccccgggctgcaggaattcgtctcacccctagaaaaagttcatccactctcatcaccagctaagaacagggcttcgtctcaatggaaggcaaaacagggcagctcaggtgctgtttcgtcgccatcgtgctcgtcctgggtcttgtccttgagtcccaccaggctgaagctggaggcaaatggtgctgcgaaaccgccaccggaaaataccattttaatcgctgcgttgactcgggtttggtcgacaatattgggttctgtgcgggtaatgcccggttgcatcattatggaagacagatgtggaggccgtttggccggtgcttgttccccctccccttttcccggggggggagttaattaattatagccaagtcccttgaaaaaccaagggcccaaaccacttgtcctccccccccattggttttttttgtaaaaccttgccttttgtccttctttattccacctttcccaaatagccccccttccgtgaaaagtgctccccccccttcaaaagctctgtccaactggttccctttttccaagggggattgttgttccatttaatcccccgggccccccccccccggaggc

SEQ ID NO: 58110 - protein, 91 aa, Zea mays
  misc_feature: Ceres CLONE 1510801
MEGKTGQLRCCFVAIVLVLGLVLESHQAEAGGKWCCETATGKYHFNRCVDSGLVDNIGFCAGNARLHHYGRQMWRPFGRCLFPLPFSRGGS

SEQ ID NO: 58111 - DNA, 692 bp, Zea mays
  misc_feature: Ceres CLONE 1510804
  misc_feature: Encodes the peptide sequence at SEQ ID NO. 58112
ggatcccccgggctgcaggaattcgtctcacccctagaaaaaaatctcgtcttgtgttgttcggagcgggcagcagcacacagccccatcccaatcctagtcgatcttcttcccctcctcaaggaagaaaagaagctgaaccatggggaggagaaagtcagctgctaagccacctcctaagaagcggatggacaagcttgacactgtcttttcctgcccattctgcaaccacgggagtagtgttgagtgccgaattgacatgaagaatctgattggcgaagcatcttgtagaatctgtcaggaaaacttcagcacaactgttaatgcactcactgagcctattgatatatatagtgaatggattgatgagtgtgagcgtgtcaacactgtttgagggccacgatgatgcgtgagcttgccccatgtgatgaaactgttacctacaatccgaatgtaatgtggctgtattcctcgaatgccctagcccatagtcagccatggcctttgaaataacgttagtgccttaactgatattgccagtagggcacccttatcctggatcttaccagaacctacaaaaaagttttgtccttatacttttagggggacaaccctttttaaaggtggcctattgttgtggtacccttatccctaaacgccttaaacccaaaaaataaaaaaaaaacacccca

SEQ ID NO: 58112 - protein, 83 aa, Zea mays
  misc_feature: Ceres CLONE 1510804
  misc_feature (8)..(68): Pfam Name: Elf1 Pfam Description: Transcription elongation factor Elf1 like
MGRRKSAAKPPPKKRMDKLDTVFSCPFCNHGSSVECRIDMKNLIGEASCRICQENFSTTVNALTEPIDIYSEWIDECERVNTV

SEQ ID NO: 58113 - DNA, 705 bp, Zea mays
  misc_feature: Ceres CLONE 1510805
  misc_feature: Encodes the peptide sequence at SEQ ID NO. 58114
atagctggagctcaccgcggtggcggccgctctagaactagtggatcccccgggctgcaggaattcgtctcacccctagaaaaaagcattacccggcggcggaagcgtaagcgcaaaacgaagcaagcggccgccatggtgaagggacgcacgggacagcgcgtcaggctctacgtccggggcaccatccttggatacaagaggtccaagtcgaaccagtacgagaccacgtctctcgtgcagatcgagggggtgaacaccaaggaggatgtcgcgtggtacgctggcaagcgcatggcgtacatctacaaggccaagaccaagagcaatgagacccgctacaggtgcatctggggcaaggtcacccgtccgcacggaaactcgggcgtcgtccgtgccaagttcatgtccaacctcccgcctgagtccatggggcgcaaggtcagagtgttcatgtacccgagcagcatctaaggttttgttggagtaaagatggactagaaatggccatgtgtttatttctcacttttctctgaacttaaaatgccttgtgttggtaacttagattgttcaagtgctgaaactgtggaaattgtgccaaaatttgtttgtcaaacggatgaactatttgccgtatggtatggcagcaacatatcttaatttgccccgttaaaaaaaaaaaacaccatacgcaaaataatcatc

SEQ ID NO: 58114 - protein, 112 aa, Zea mays
  misc_feature: Ceres CLONE 1510805
  misc_feature (12)..(106): Pfam Name: Ribosomal_L35Ae Pfam Description: Ribosomal protein L35Ae
MVKGRTGQRVRLYVRGTILGYKRSKSNQYETTSLVQIEGVNTKEDVAWYAGKRMAYIYKAKTKSNETRYRCIWGKVTRPHGNSGVVRAKFMSNLPPESMGRKVRVFMYPSSI

SEQ ID NO: 58115 - DNA, 730 bp, Zea mays
  misc_feature: Ceres CLONE 1510806
  misc_feature: Encodes the peptide sequence at SEQ ID NO. 58116
aagctggagctccccgcggtggcggccgctctagaactagtggatcccccgggctgcaggaattcgtctcacccctagaaaaaaaccccaccacaacccagcgccggcagtcgccgtcatcgatcgatcgccggaaaactaacccctaacgatgtctggagccggcgaggaggacaagaagcccgcggagggcggcgcccacatcaaccttaaggtcaagggacaggatggcaatgaggtgttctttcgcataaagaggtccacccagctgaagaagctgatgaacgcttattgtgaccgccagtctgtggacatgaatgccattgcgttcctgcttgatggccgcaggcttcgcggcgagcagacccctgatgagctggagatggaggacggcgacgagatcgacgccatgcttcaccagaccggaggcagcgttcctagcaccacctaaaagcctcgttttgctctccgtcctgcgtagtagtaaacaaaagggaaaaagtctttttaaggaacttgtgatgctctggctccttgtgccattgctgagggaacatccttagcctttgtttaagaagatggggttggcacctttggtcctgccaccactcgtttattctattccctaataccatgccgcccttgattggtgaaaaaaaaacaaaaaaaccgtaacccttcggggtaccccaattctccccctttaagttgagtcctaaatacccccccg

SEQ ID NO: 58116 - protein, 99 aa, Zea mays
  misc_feature: Ceres CLONE 1510806
  misc_feature (21)..(91): Pfam Name: ubiquitin Pfam Description: Ubiquitin family
MSGAGEEDKKPAEGGAHINLKVKGQDGNEVFFRIKRSTQLKKLMNAYCDRQSVDMNAIAFLLDGRRLRGEQTPDELEMEDGDEIDAMLHQTGGSVPSTT

SEQ ID NO: 58117 - DNA, 686 bp, Zea mays
  misc_feature: Ceres CLONE 1510807
  misc_feature: Encodes the peptide sequence at SEQ ID NO. 58118
aaagctggagctccccgcggtggcggccgctctagaactagtggatcccccgggctgcaggaattcgtctcacccctagaaaaaattctctgtcgccttcgcccctccaaggttctctgattccagacgcaaccctgcggctgcggggtcaaggagccagagggggtgcacagcgatcgttctgccggagatcgaaaccctcagctagggtctgaggcgccgggctgcggccgccgagatgtcgacgccggcgaggaagcggctgatgcgggacttcaggcgcctgcagcaggacccgcccgccgggatcagcggcgcgccgcacgacaacaacatcatgctctggaacgccgtcatattcgggccggatgatacgccttgggacggaggcacgttcaagcttaccttgcagtttacagaagattacccaaacaagccaccaactgttcggttcgtctctaggatgtttcatccaaacatatatgctgatggaagcatctgcttggatatcctacagaaccagtggagtcctatatatgatgttgctgcaatcttgacttctattcagtccctgctgtgtgatccaaacccgaactcccctgcaaactcagaagccgcaagactgttcagcgagaacaagcgggagtacacccgcaaagtccgcgagattgtggagcagagctgga

SEQ ID NO: 58118 - protein, 149 aa, Zea mays
  misc_feature: Ceres CLONE 1510807
  misc_feature (8)..(145): Pfam Name: UQ_con Pfam Description: Ubiquitin-conjugating enzyme
  misc_feature: SWISSPROT Homolog: EC 6.3.2.19 Ubiquitin--protein ligase
MSTPARKRLMRDFRRLQQDPPAGISGAPHDNNIMLWNAVIFGPDDTPWDGGTFKLTLQFTEDYPNKPPTVRFVSRMFHPNIYADGSICLDILQNQWSPIYDVAAILTSIQSLLCDPNPNSPANSEAARLFSENKREYTRKVREIVEQSW

SEQ ID NO: 58119 - DNA, 706 bp, Zea mays
  misc_feature: Ceres CLONE 1510809
  misc_feature: Encodes the peptide sequence at SEQ ID NO. 58120
ggagctccccgcggtggcggccgctctagaactagtggatcccccgggctgcaggaattcgtctcacccctagaaaaaaccgacagacaacatggctcgcctccgcctccaccgtctccgggctcaccagcgcctccctggccagcagtccggagtgctccacgagcttcacgcggggcagcggggtgtcggcgaggaaccccctgatgagcacgaacctgcacaggaatggtgtgatcacctgcatgacgcttccccgggactggctgcagacggacctaaacgtcatcggcttcgggctcatcggctgaatggggtcgtccagcgctccggccatcaacggaaacagcctcacagggctcttcttctccagcatcggccaggagctggcccacttctccacggccccgcccgtcacctcccaattctggctgtacctactgacatggcaactgggcctgttcatcgagctcaccttcgaccagatcggattcaaggacaagaccgacgactatttcgagaagcgaagcggatatgatcgtatccctcctcgctggtgctgcgttgcttgcatgcctgccgaaatcgaacctttgctgtgtataggtgtccgatctcatgctacgtacaatgctactctggaccttcaatgtgaaatctatgccgcccgcgcctaaaaaaaataaaaaaaccagacgcccgaggg

SEQ ID NO: 58120 - protein, 121 aa, Zea mays
  misc_feature: Ceres CLONE 1510809
MGSSSAPAINGNSLTGLFFSSIGQELAHFSTAPPVTSQFWLYLLTWQLGLFIELTFDQIGFKDKTDDYFEKRSGYDRIPPRWCCVACMPAEIEPLLCIGVRSHATYNATLDLQCEIYAARA

SEQ ID NO: 58121 - DNA, 885 bp, Zea mays
  misc_feature: Ceres CLONE 1510811
  misc_feature: Translation starting site: 241
  misc_feature (21)..(21): n is a, c, t, g, unknown, or other
  misc_feature (23)..(23): n is a, c, t, g, unknown, or other
  misc_feature (24)..(24): n is a, c, t, g, unknown, or other
  misc_feature (30)..(30): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (38)..(38): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
tttttttgttttttttttttngnngggaanaannnngnggnnnnnncaaactgggactccccgcggtggcggccgctctagtactagtggatcccccgggctgcaggaattcgtctcacccctagaaaaaaaaccagcactactcatccgtcgccccacggaagtttcggcggcgccggcgtgctcgtgatctcgaccaaggcgtgcctccgctccggtcacccgtcgctccacgcaaccatgtcgaggaggaagaccagtgagcccaaggaggagaacgtcacccttggacccactgtccgtggaaggagagtatgtcattggtgtggctcacatctttgcatccttcaaggacaccttcattcatatcgctgatttggtgtggaaggggaaactcggggtccggaccaccggtaacaatcttaaagaccccccccccgagcaccactctatgctgcatgttgttttttcggttctccaccccccttgtggtttttccttgtaacccctgtagaggggcttggtagaatgaagaggtgttcccgttgatcaggttgtccgctttttctctggcctgttccctggctacctcatatctctcgttcgctcgctccttttgcatgcattcttacgcgcactcccgcccccagggccgctcaatggcggacggcacctgcgctgacaccaaactatgcactgttggccccttttttaatatatttgactgttgtaatagagtataagtatgagtataatgacctccctatcttcttgtggtgattttccccccctgtccctatctgcccctctctctcatccccctcttccgctccctgtgggtactagttttggtcctatttatgcgtctgtgtactatgaggttgt

SEQ ID NO: 58122 - DNA, 718 bp, Zea mays
  misc_feature: Ceres CLONE 1510813
  misc_feature: Encodes the peptide sequence at SEQ ID NO. 58123
aagctggagctccccgcggtggcggccgctctagaactagtggatcccccgggctgcaggaattcgtctcacccctagaaaaactctcgagcctgacccttacgccttcgctcgcgccgccgccgccgccgccgctacgccccgcacctcgcttcatttcgtgtcgccaagatgacgaagcgcactaagaaggcaggaattgttggcaaatatggaaccaggtatggtgctagcttgcgtaagcaaatcaagaagatggaggtatctcagcattccaagtacttttgcgagttctgtgggaagtttgctgtgaagaggaaagcagttggaatttgggggtgcaaggactgtgggaaggtgaaggctggtggtgcttacaccatgaacactgctagtgcggtcaccgtcaggagcacgatccgccgcctgagggagcagactgaagcatgatatagctctttatattattggggtttcctgtagttgctcttgtcaggcatgttgtgggggccttatctagtggaaatgtggaatcactgtactggctgttttgccgagacaatgctccttatatttggtttatgctctaggatctcaaagttgtgttgttgagatttgccctcggttaccgttctgaatctgacaaatgatatttgatcctgtgccaaaaaaaaaaaaaaaacgagacgctcgaggtacccaattcgccctatagtgg

SEQ ID NO: 58123 - protein, 92 aa, Zea mays; identical to SEQ ID NO: 7812
  misc_feature: Ceres CLONE 1510813
  misc_feature (2)..(91): Pfam Name: Ribosomal_L37ae Pfam Description: Ribosomal L37ae protein family

SEQ ID NO: 58124 - DNA, 716 bp, Zea mays
  misc_feature: Ceres CLONE 1510815
  misc_feature: Encodes the peptide sequence at SEQ ID NO. 58125
  misc_feature (635)..(635): n is a, c, t, g, unknown, or other
atagctggagctccccgcggtggcggccgctctagaactagtggatcccccgggctgcaggaattcgtctcacccctagaaaaaacccttggctcctactcactctctctccccatccgcgccagtccaaccaagtcagcacccgcgcgcggcaaggagttcacgcccatggcgagcaccaacatggcgtcggccacctcgcggttcatgctggccgcgggcgtgcccaccgccagtagcggcagcggccgcgtcagcttcgcctcggcgcccaaccggcttgccacgaggcttgtggtccgggccgatgaggagtccccggcagagccggcgcctactgcggaaggtgagggcgccgtggccaccaagcccaatgccgagaagccgccgccgatcgggcccaagagaggcgccaaggtgaagatcctgaggcgggagtcctactggtacaacgggatcggcaacgtcgtcaccgtcgatcaggatcctaacacccgttacccggtggtggtgcggttcaacaaggtgaactacgccggcgtgtctaccaacaactacgccttggacgagatcctcgcagtgaaatgagtgaggccagtctgctcaaggaccccatgctcctgtgtgatttgtanttgtgaagtgaggctgctgcctaactgctacgttagctgctagcggcacaacatcaatcttgtaataactaatctccacaa

SEQ ID NO: 58125 - protein, 139 aa, Zea mays
  misc_feature: Ceres CLONE 1510815
  misc_feature (78)..(139): Pfam Name: PSI_PsaE Pfam Description: Photosystem I reaction centre subunit IV / PsaE
MASTNMASATSRFMLAAGVPTASSGSGRVSFASAPNRLATRLVVRADEESPAEPAPTAEGEGAVATKPNAEKPPPIGPKRGAKVKILRRESYWYNGIGNVVTVDQDPNTRYPVVVRFNKVNYAGVSTNNYALDEILAVK

SEQ ID NO: 58126 - DNA, 804 bp, Zea mays
  misc_feature: Ceres CLONE 1510817
  misc_feature: Encodes the peptide sequence at SEQ ID NO. 58127
  misc_feature (545)..(545): n is a, c, t, g, unknown, or other
ctagctggagctccccgcggtggcggccgctctagactagtggatcccccgggctgcaggaattcgtctcacccctagaaaaaaagtccccaccacccccaaccccgtctctccactgcggcgcaggcttcgcttcggctccgctcggctcgagcagaagaaaatgcaacgggcagtgcaggccgtcaggtcacacggcaatgttcttaaatatgctgttctacaacacatcagcgctcccaagccagcaatgcttcctgctgccttttctcgtttcatgtccagttcatctgctcccctagaggaacggggatttaaacctgcccctgaaccacatgtccttgacatctaaggggaaaaagggtgaatggatctcgcccccggagggcgcgcgggaggaaaacctccaataaccctttctcaatcccacaccaccaccataaagctggaaaaatttttcggggggttggtaaaaccggggaagcgagaaaccccccaccataatttaaatacccccccggcccgatactctcgagaataaactnggaaatagggatgtccatccacccccccggcccccccgccacacgaggcccacccacaacccccccccaaacctggggatacccccccgctattgtgagcgtctcatgctgtgagttgcttcccggcgaccccgtaaaaaaactctgccccccgtggtgtccgccaccaatagcgctccacacaccccctccgtgcccccctccctcccccccactccctcccccacgcccccgacccccctcctcccccccgcctccc

SEQ ID NO: 58127 - protein, 62 aa, Zea mays
  misc_feature: Ceres CLONE 1510817
MQRAVQAVRSHGNVLKYAVLQHISAPKPAMLPAAFSRFMSSSSAPLEERGFKPAPEPHVLDI

SEQ ID NO: 58128 - DNA, 735 bp, Zea mays
  misc_feature: Ceres CLONE 1510819
  misc_feature: Encodes the peptide sequence at SEQ ID NO. 58129
aagctggagctccccgcggtggcggccgctctagaactagtggatcccccgggctgcaggaattcgtctcacccctagaaaaacctccactcgccctcccacacagaaaaccctagccgccgccaccgaagcggcctcccaggtaagcaggagcgtccaccccgccgccgtcatgaagcgcaatccccgcgtcgcgagctcccgccggaagtgccgcaaggcgcactttacggccccgtcctccgtccgccgcgttctcatgtccgccgggctgtcgacggagctccgccacaagtacaacgtgcgctccatcccgatccgcaaggacgacgaggtgcaggtcgtgcgcggcaccctcaaggcccgcgagggggaggtggtgcaggtctaccgccgccgctggggtcacccacgttcaagcggatcccccggcgagaaggggaacggcttccaccgtgaaacgtgggcatccccccctcccagggtgatcgtcccctaaactgaaactccaccaaggacccgcaaggcgtctccttggacgccaagggcccggggccccccccgccgacaagggctaaggggcaagtttacggccgacgacattcacttccccccccctctggggggggcccccccccggccgcctcttttccaggagatccacattgggctctttccgggtcatctggaagggttgtcgtttcacctttttccctcatccctttaaagttttac

SEQ ID NO: 58129 - protein, 108 aa, Zea mays
  misc_feature: Ceres CLONE 1510819
MKRNPRVASSRRKCRKAHFTAPSSVRRVLMSAGLSTELRHKYNVRSIPIRKDDEVQVVRGTLKAREGEVVQVYRRRWGHPRSSGSPGEKGNGFHRETWASPPPRVIVP

SEQ ID NO: 58130 - DNA, 755 bp, Zea mays
  misc_feature: Ceres CLONE 1510821
  misc_feature: Encodes the peptide sequence at SEQ ID NO. 58131
  misc_feature (53)..(53): n is a, c, t, g, unknown, or other
  misc_feature (80)..(80): n is a, c, t, g, unknown, or other
  misc_feature (554)..(554): n is a, c, t, g, unknown, or other
  misc_feature (558)..(558): n is a, c, t, g, unknown, or other
aaagctggagctccaccgcggtggcggccgctctagaactagtggatcccccngggctgcaggaattcgtctcacccctnagaaaaaaaaaaaaaaaaaaaaaatcaggcatccaagaagctcaaagcaagcagatctaagctccaggcagcgtcgcgacagagtgagtgagtagcacgacaacaacaatggcttccctgaaggccgcgaagcccagcggagttgcggcgcagggcaaggagccggcgcccaagctcagcgagacggcgacgaagccgtcagccgcgaagagcggcggcgttaagaaggctgagcagaagccccgggaaaccaaaaggaaggtgaagagcagcaaacaggcggccgcggccaaaaaatgacgtacagaacgtgtggagggtaatgaagcttccatgcatgagtgaaatccatgcctggttaggatccaacccctcccttccttggtacttccaaggggacgcggcggggggctccccctcggtggggaggagtgccgaaagaaacccaccaaaaaaaaagtgggttggagcacngggnagagaaaacgccatttataaaggttcaaacgacgtcaatttttaaaaaaaataaaaaaacgaaaacggctgggggggccccattcgccctcaaagggggacgctattacccccgccccccgggccccgtttttttaacggggggggggggaaaaacgcgggggtccccacaatatatggcgggggaaaacacccccg

SEQ ID NO: 58131 - protein, 63 aa, Zea mays; identical to SEQ ID NO: 28299
  misc_feature: Ceres CLONE 1510821

SEQ ID NO: 58132 - DNA, 719 bp, Zea mays
  misc_feature: Ceres CLONE 1510824
  misc_feature: Encodes the peptide sequence at SEQ ID NO. 58133
  misc_feature (397)..(397): n is a, c, t, g, unknown, or other
aaagctggagctccccgcggtggcggccgctctagaactagtggatcccccgggctgcaggaattcgtctcacccctagaaaaaatcctcagtgcgtactgtctgtgcgaaggcgaccattccttcttcgctccttcgccgccgctatggttaagtactcgcaggagccgggcaaccctaccaaatcggccaaggccatgggaagggacctgagggtccacttcaagaacacaagggagacagcttttgcgcttcgcaagctgcctttgaccaaggctaagcgataccttgaggatgttattgctcacaagcaggcaattcccttccggagatactgtggaggtgttggtcgcaccgcacaagcaaagtctcgccactccaatgggcagggtcgctngcctgttaagtcagccaggttcatattgaatttgctgaaaaatgctgagagtaacgctgatgtgaaagcttggaacgtggacaccctctatgttcccaaatccaagtgaaccaagcccaaaaacaaaggcccccgcccctaccggggctcccggacccttttaccccttacttgccccccccctttgccaaattgaactaattctgccaaaaaaagaaaacccctgaaaaaaaaagggtaaaacctttttcccgcaaaggaaacaataaaattttttaccccccgcaaaaaagagcccctttcaaaaaaattaaaccgcaac

SEQ ID NO: 58133 - protein, 119 aa, Zea mays
  misc_feature: Ceres CLONE 1510824
  misc_feature (17)..(119): Pfam Name: Ribosomal_L22 Pfam Description: Ribosomal protein L22p/L17e
  misc_feature (84)..(84): Xaa is any aa, unknown, or other
MVKYSQEPGNPTKSAKAMGRDLRVHFKNTRETAFALRKLPLTKAKRYLEDVIAHKQAIPFRRYCGGVGRTAQAKSRHSNGQGRXPVKSARFILNLLKNAESNADVKAWNVDTLYVPKSK

SEQ ID NO: 58134 - DNA, 743 bp, Zea mays
  misc_feature: Ceres CLONE 1510825
  misc_feature: Encodes the peptide sequence at SEQ ID NO. 58135
atagctggagctccccgcggtggcggccgctctagaactagtggatcccccgggctgcaggaattcgtctcacccctagaaaaaatcaactcgcaattccgcattcgttccaactcctgagcactttctcctcgtccccgacaagccaatcgaagccgagatacggccatggactccaccggcaccggagcagggggtaaggggaagaagggagcggccgggcgcaaggtcggcgggccaaggaagaagtcggtgtcgaggtccgtgaaggccgggctccagttccccgtcggccgcatcgggcgctacttgaagaagggccgctacgcgcagcgtgtcggcaccggcgcccccgtcttcctcgccgctgtcttcgaatacctccccgctgaggttctggagccccctggtaaaggtgccagggacacaagaagcatccgattatttccggcccccgggctttcgggggacccgaaaaaaaaagaaacttgggaaactgttggggcgggttacccctccccccccggggggggggccccccaaaaaaaacccgttgtttgtgccccaaaaaaaagcggaaaaaaggccccccggggggaggaaaaagggaaaaaaatccccaaaaaaggcccccaaacccccccaaaaagaggaaaaggcacacctgggggagaacctaattttttttacaaccgcccttccccacccggggggggggataacgcaccttttaaatggcgccc

SEQ ID NO: 58135 - protein, 191 aa, Zea mays
  misc_feature: Ceres CLONE 1510825
  misc_feature (31)..(101): Pfam Name: Histone Pfam Description: Core histone H2A/H2B/H3/H4
MDSTGTGAGGKGKKGAAGRKVGGPRKKSVSRSVKAGLQFPVGRIGRYLKKGRYAQRVGTGAPVFLAAVFEYLPAEVLEPPGKGARDTRSIRLFPAPGLSGDPKKKETWETVGAGYPSPPGGGAPQKKPVVCAPKKSGKKAPRGEEKGKKIPKKGPQTPPKRGKGTPGGEPNFFYNRPSPPGGGDNAPFKWR

SEQ ID NO: 58136 - DNA, 825 bp, Zea mays
  misc_feature: Ceres CLONE 1510826
  misc_feature: Encodes the peptide sequence at SEQ ID NO. 58137
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
nnnnnnnnnnnnnnnnnnnnnggggggggggttnnnnnnnnnnnaaagactggagctccccgcggtggcggccgctctagaactagtggatcccccgggctgcaggaattcgtctcacccctagaaaaactccaccacaccacacgcgccgcaaagcagagcacgggggcctgagagcagagcgccatcagccatcctttgcctgcccaagcagcaagcagcagcagcaacggcggctggcccgatggctctgtctctctccggcacctccgcccgcttcgccctcgcgtcgctggtcccccgggccagggcctacgcggcgtcggcggcgtccggggccatgaggcgcgcggcggagggcgcggccgcgggcgaggccaaggaggccgggcgcgccgccgccgccgctgccgagggctcgtgggtgcccgaccccgtcacggggccactaccgccccgccaactggggcccgccgcccgtgaacccggacgaccttcgcgccgctcaacttcgcccgcaccttactcccgggcctgaagcggccccgggttcccttcaccctgctccacctttggtttccgtatgaccataggccgcaaccgttcggtcccccggcggcacaccaaggtaaagggcccgcgggctccgggggggaccgaacctgagacgttaagaccattcccccaccctgcggcccccggtttttgaaaacccccccaaaaccgtttttcgaaagaataccccacgcagagggccaaaggcgacatccccacgggccgcgacccgagtggccctagcgtagagggcccacaaacacaccacac

SEQ ID NO: 58137 - protein, 97 aa, Zea mays
  misc_feature: Ceres CLONE 1510826
  misc_feature (1)..(75): Pfam Name: LEA_3 Pfam Description: Late embryogenesis abundant protein
MALSLSGTSARFALASLVPRARAYAASAASGAMRRAAEGAAAGEAKEAGRAAAAAAEGSWVPDPVTGPLPPRQLGPAAREPGRPSRRSTSPAPYSRA

SEQ ID NO: 58138 - DNA, 745 bp, Zea mays
  misc_feature: Ceres CLONE 1510832
  misc_feature: Encodes the peptide sequence at SEQ ID NO. 58139
  misc_feature (745)..(745): n is a, c, t, g, unknown, or other
ggatcccccgggctgcaggaattcgtctcacccctagaaaaaatcacacactcgactctcctctctcgcatccgcagcctctcgagctctactccatcccctcgatctcgaagcgcagcagcagcagtcaggcggccatggacgcgagcgcagccggagccggcgggaaggcgaagaagggcgcggccgggcgcaaggccggcgggccgaggaagaagtcggtgacgaggtccgtcaaggccggcctgcagtttcccgtcggccgcatcgggcggtacctgaagaagggccggtacgcgcagcgcgtcggcacgggcgcccccgtctacctggcccccgtcccttcagtacctggccccccaaagtgcctgaaattggcccgccaaaccttccaaggaacaaacaaaaaaaaaccgttttatccccgggcccagtggctcctttggcaatcccgaaacaaaaaaaaaaaccccgaaaagtttgtttccccggggttccccctttccccccaggggggggtttccccccccaaaaaataacccgggggtgctcctccccccaaaaaacccccgtttaaaaaggggggccccaatagggcccactttccccccaaaaaggccccccacccccccccaaaaaaactaattagggggggcgcccccctcccccctcttttattaaaaaacccccttttcccaaaaatgttttcgctcggtgggaggcgccctctatttaaaagaaacan

SEQ ID NO: 58139 - protein, 133 aa, Zea mays
  misc_feature: Ceres CLONE 1510832
MDASAAGAGGKAKKGAAGRKAGGPRKKSVTRSVKAGLQFPVGRIGRYLKKGRYAQRVGTGAPVYLAPVPSVPGPPKCLKLARQTFQGTNKKKPFYPRAQWLLWQSRNKKKNPEKFVSPGFPLSPQGGVSPPKK

SEQ ID NO: 58140 - DNA, 717 bp, Zea mays
  misc_feature: Ceres CLONE 1510833
  misc_feature: Encodes the peptide sequence at SEQ ID NO. 58141
  misc_feature (568)..(568): n is a, c, t, g, unknown, or other
  misc_feature (586)..(586): n is a, c, t, g, unknown, or other
  misc_feature (643)..(643): n is a, c, t, g, unknown, or other
aaagctggagctccccgcggtggcggccgctctagaactagtggatcccccgggctgcaggaattcgtctcacccctagaaaaagtgctttcttagaggtgggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcggtggcggctaccgcggtggcggcggctaccgtggcggcggcngctaccgtggtggtggcngcggctacggcggtggcaaccgtggcggcggctacgggcactccgacgggaactggnagaactgagcggtggggccccgcgcgcccagttatcctggtcgctaccgtgatgtttaccctagtccagagggt

SEQ ID NO: 58141 - protein, 155 aa, Zea mays
  misc_feature: Ceres CLONE 1510833
  misc_feature (10)..(81): Pfam Name: RRM_1 Pfam Description: RNA recognition motif. (a.k.a. RRM, RBD, or RNP domain)
  misc_feature (48)..(150): Pfam Name: GRP Pfam Description: Glycine rich protein family
  misc_feature: SWISSPROT Homolog: EC 5.2.1.8 Peptidylprolyl isomerase
  misc_feature (129)..(129): Xaa is any aa, unknown, or other
  misc_feature (135)..(135): Xaa is any aa, unknown, or other
  misc_feature (154)..(154): Xaa is any aa, unknown, or other
MAASDVEYRCFVGGLAWATDDHSLHNAFSTYGEVLESKIILDRETQRSRGFGFVTFSTEEAMRNAIEGMNGKELDGRNITVNEAQSRGGRGGGGGGYGGGRGGGGYGGGGRRDGGGGYRGGGGYRGGGXYRGGGXGYGGGNRGGGYGHSDGNWXN

SEQ ID NO: 58142 - DNA, 745 bp, Zea mays
  misc_feature: Ceres CLONE 1510834
  misc_feature: Encodes the peptide sequence at SEQ ID NO. 58143
  misc_feature (392)..(392): n is a, c, t, g, unknown, or other
ggcggccgctctagaactagtggatcccccgggctgcaggaattcgtctcacccctagaaaaattccccgccgcctcgcgcccccgctcgcttcacttctctaggtgcgcaccgatcagaagagatggcggtgccgctgctgacgaagaagatcgtgaagaagcgggtcaagcagttcaagaggccccacctcgaccgctacaagtgccttaagccaagctggcgcaggccaaagggtattgattcccgtgtcaggaggaagttcaagggatgcaccttgatgcccaacattggttatggttctgacaagtctaccaggcactacctccctcagcaagttcaagatatttttttttccccccccccctgggggaaacgaaggggggctcctnctccccacccaccccctactggggttgaaattgctcaacaacctgttcccctccttagcgcagggggagtcgggccaccttccttccccaccctcgcctgtgcggggcgcccaaccagctttggcttgtgttcgtgggtcacgggaggaggagatgcggctgggccgcctgtgcctttaccgacctacactccatgttgccccttttgtttcctgcttgcggttcacctgttgcgctgctgaccggctgacacccgaacacccccaacgccctccccccccctctcttcgacctcggaccacccccccttcttgcgggcgctctccctctcggtcccccaccccacctccgcc

SEQ ID NO: 58143 - protein, 169 aa, Zea mays
  misc_feature: Ceres CLONE 1510834
  misc_feature (14)..(110): Pfam Name: Ribosomal_L32e Pfam Description: Ribosomal protein L32
  misc_feature (90)..(90): Xaa is any aa, unknown, or other
MAVPLLTKKIVKKRVKQFKRPHLDRYKCLKPSWRRPKGIDSRVRRKFKGCTLMPNIGYGSDKSTRHYLPQQVQDIFFSPPPWGKRRGAPXPHPPPTGVEIAQQPVPLLSAGGVGPPSFPTLACAGRPTSFGLCSWVTGGGDAAGPPVPLPTYTPCCPFCFLLAVHLLRC

SEQ ID NO: 58144 - DNA, 819 bp, Zea mays
  misc_feature: Ceres CLONE 1510835
  misc_feature: Encodes the peptide sequence at SEQ ID NO. 58145
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (9)..(9): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
nnntttttntttnnnnnnnttttttttctgtttgttttttgggctaggctcaaggtggagctcaccgcggtggcggccgctctagaacagtggatcccccgggctgcaggaattcgtctcacccctagaaaaaatcacacactcgactctcctctctcgcatccgcagcctttcgagctctactccaccccctcgatctcgaagcgcagcagcagcagtcaggcggccatggacgcgagcgcagccggagccggcgggaaggcgaagaagggcgcggccgggcgcaaggccggcgggccgaggaagaagtcggtgacgaggtccgtcaaggccgggctgcagtttcccgtcggccgcatcgggcggaacctgaagaagggccggtacgcgcagcgcggcgggaacgggcgcagccgtctacctggggcgccgtcctcgagtacccgggccgcccgagggtgctggaagctgagccggcaccgctcgcccaggacaacagagaagaaccctgggtcttccgcgcgcggaagtgggtccgttgtcggtccgggaatctactgagtgagccccgggcgaggcggcgtggcacgggcttgcaccttgcggccaaccggtaaacgtttcttccgccaagttgtaacgctgggggcgtccgggccccagaaaaaaaccccactgaataatggtttgtgtacccaaaaaaggccagactcccacccacgctaacggccccccgccaccccgcccaagaaaggcctaaaaatggagggggggcggcgcttaataccggggggggagggcggaaaaagggcggggggg

SEQ ID NO: 58145 - protein, 110 aa, Zea mays
  misc_feature: Ceres CLONE 1510835
MDASAAGAGGKAKKGAAGRKAGGPRKKSVTRSVKAGLQFPVGRIGRNLKKGRYAQRGGNGRSRLPGAPSSSTRAARGCWKLSRHRSPRTTEKNPGSSARGSGSVVGPGIY

SEQ ID NO: 58146 - DNA, 725 bp, Zea mays
  misc_feature: Ceres CLONE 1510836
  misc_feature: Encodes the peptide sequence at SEQ ID NO. 58147
ccccgcggtggcggccgctctagaactagtggatcccccgggctgcaggaattcgtctcacccctagaaaaaagatcagatcaaacaatccgcctccgcctccgcctccctagggttttgctctcggctcgtcggatccagttcgggggatcctccatggcgtcgcgtccgtcgctgaagtcgaagcccaagggcaagggcgggaagaaggccaccgctgacgacgaggacgccaccgcggcggcgaccacggtgaggctcatgaaggagtggaccacgtggacgatgaagaaggcgaaggtggtggcgcactacggcttcatccccctcgtcatcgtcatcggcatgaactccgagcccaagccctccgtcttccagctcctctcccccgtctgatcggatcatgacaggccccggatgaggtcggtccgtaatagtttggagctggtactttcatttgcttacatatgtcccagatcgagttgaagaaggtggatcatggcttctgggccaaatttgaaggatttggtttaaaaatttggaaggggcggaaggccttctataccttcggatcaaaaattgtcttgggtttgtggatccggccacggctttattattgtatggaactattattccgttttcctcccggcttgtaacggaatttggtttgccccgtccacaaaaaaaagaataaaaaaaccggaccgcccccagggtcccccact

SEQ ID NO: 58147 - protein, 79 aa, Zea mays; identical to SEQ ID NO: 14231
  misc_feature: Ceres CLONE 1510836
  misc_feature (37)..(76): Pfam Name: Tom7 Pfam Description: TOM7 family

SEQ ID NO: 58148 - DNA, 761 bp, Zea mays
  misc_feature: Ceres CLONE 1510974
  misc_feature: Encodes the peptide sequence at SEQ ID NO. 58149
  misc_feature (761)..(761): n is a, c, t, g, unknown, or other
aaaactggagctccccgcggtggcggccgctctagaactagtggatcccccgggctgcaggaattcgtctcacccctagaaaaaaatttcctccacttcccaaaccctaccggcggcgcagcagcatcacaaccaccgcccgaagatggtgaagtttctcaagcccggcaaggccgtaatcctcctccagggcaggttcgccggccggaaggcggtgatcgtgcgcgtgttcgaggagggcacccgcgaccgtccctatgggcactgcctcgtcgccggcctggccaagtaccccaagaaggtgatcccgcaaggactccgccaagcaaaacggccaagaagtcccgcgttcaagtgtttcattcaagctctgtcaattttccactcacctgctggcccaccccgcttaacacccctcccccgcttgaattttaaagaacggtcgccttcggggccggggcccaaaaagccgccttctttccaccccggggtataaagaaaggggtcgcaaaaaccttggcaaagggtcctccaataagcccgccccttttatagggtaaaaggctccatacaaatccgtgccaagaaaccagagtgggttcctattaacaaaaggcttccccctttcctaagggcctccggggaccctcccccccacacaatgacctactttctacctttctcccagatatgcgatggtccccgcccacccccttccaagccccctctcccccttcacgccaacctcccccctgaccccn

SEQ ID NO: 58149 - protein, 116 aa, Zea mays
  misc_feature: Ceres CLONE 1510974
  misc_feature (7)..(40): Pfam Name: KOW Pfam Description: KOW motif
MVKFLKPGKAVILLQGRFAGRKAVIVRVFEEGTRDRPYGHCLVAGLAKYPKKVIPQGLRQAKRPRSPAFKCFIQALSIFHSPAGPPRLTPLPRLNFKERSPSGPGPKKPPSFHPGV

SEQ ID NO: 58150 - DNA, 670 bp, Zea mays
  misc_feature: Ceres CLONE 1510976
  misc_feature: Encodes the peptide sequence at SEQ ID NO. 58151
aaagctggagctccccgcggtggcggccgctctagaactagtggatcccccgggctgcaggaattcgtctcacccctagaaaaactttggtcattttctcagtctcgcgcgtatataaagctttctagttctagtgttgtcaacgatgatgaccacctcgagtgtttttacttaatacataccatttgtctattctgaatatggagcaacaatatctaaatattcaaatgttcatcaccagtttatatgaaaaaaaaaaaaaaaaggtatcttgcaatcacaacgaacaaaagctctcgatctcaccgacaccgaggaagaagagatcaatggcgtccgagcagggagtcgtgatcgcgtgccacaccaaggctgagtttgacgcccacatgaccaaggcccaggaagccggcaagctggtggtcatcgacttcactgccgcctggtgcggtccatgccgcgccatcgccccactgttcgtcgaacacgccaagaagttcactcaggtcgtcttcctgaaggtggacgtggaccaagtgaaggaatcaccgcgccctaccaggtcgaggcgatgccgacctttcacttcgtcaagaacgctagacgggcgcgaccatcgtgggtgccaggaaggacgagctcctggccctaatcgagaacatgccacgcc

SEQ ID NO: 58151 - protein, 113 aa, Zea mays
  misc_feature: Ceres CLONE 1510976
  misc_feature (8)..(96): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
MASEQGVVIACHTKAEFDAHMTKAQEAGKLVVIDFTAAWCGPCRAIAPLFVEHAKKFTQVVFLKVDVDQVKESPRPTRSRRCRPFTSSRTLDGRDHRGCQEGRAPGPNREHAT

SEQ ID NO: 58152 - DNA, 667 bp, Zea mays
  misc_feature: Ceres CLONE 1510978
  misc_feature: Encodes the peptide sequence at SEQ ID NO. 58153
  misc_feature (503)..(503): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (659)..(659): n is a, c, t, g, unknown, or other
aagctggagctccccgcggtggcggccgctctagaactagtggatcccccgggctgcaggaattcgtctcacccctagaaaaaacacacacacacacggcttccacagcttgctctcgctgcactcgcaagcaatacatctcgtcgttccactaagatcgaggagcaaatggcggccaccttgaagctcaggatcctcatcgtggcggcggccgtcgccgcgtccctggtcggcacggcctcagcggcagagggaccggcgcccgctccgacgtccgccgccgcgtccatggccgcgccggccgttgccgctgcgtccttcaccgcgcttgtcttcggctacctcttctgaacgccgtgaacattcacgcgtacaccgtgttgccccagccgaattgtttgcctgctcagatttttcttcttctctgtctcgctctcgtgttttggtgtgtataggtttgtaattacgtgttcattttttttattgcgtgaccatggatctcntaattagtacatgatatatgtataaactatagagaactgcagtttggttcttcattttacactgtttgagagatgctaataattggattaagactactcttggatcnnnnnnnnnnnnnnnnnnnnnnnnnnnnnnnnnnnnnnnnnnnnnnnttnaaaaaaag

SEQ ID NO: 58153 - protein, 60 aa, Zea mays
  misc_feature: Ceres CLONE 1510978
MAATLKLRILIVAAAVAASLVGTASAAEGPAPAPTSAAASMAAPAVAAASFTALVFGYLF

SEQ ID NO: 58154 - DNA, 719 bp, Zea mays
  misc_feature: Ceres CLONE 1510979
caaagctggagctccccgcggtggcggccgctctagaactagtggatcccccgggctgcaggaattcgtctcacccctagaaaaaatttcctcatccattccaatcaatcggatcgacaccggctaaccctagcttctgtttggctgttgcctggcgggtggcggctgctttggtgcgctgcgcagtgcgctccgtccgtcgaccggccggccgtcccctggcccctgctcgtcgtcttcctcgggcgctcgtcttcctccgaacgcgcgcgggccgccgacctgcttgttctcctgaagaagcgcgcccggcgggcaggcgacccagtccagcggcgggttgaggaagaaggcgagcgaccggcggatcccccccagccgccccctgctcgtcttcctcgggccgagcgctcgtcatccactctttcctccgcccccccatcggatccccgtccgaccgtccccgggctcgtccttcctggggctcgggttgctcccagggcccctggcctgcctccagggctcggcccccggctgcagtgctgcctccggtccccgtccggcacccggcctggcaaaatttgctccgacctccggcctgcttgggcttccctgtgtcccctcccggctcacaaatttccaaagttccctggaatggggcgaaaggcaaaaatccggggccccccgataccttccatccaggcgtggggtttccctgc

SEQ ID NO: 58155 - DNA, 901 bp, Zea mays
  misc_feature: Ceres CLONE 1510990
  misc_feature: Encodes the peptide sequence at SEQ ID NO. 58156
  misc_feature (1)..(1): n is a, c, t, g, unknown, or other
  misc_feature (36)..(36): n is a, c, t, g, unknown, or other
  misc_feature (811)..(811): n is a, c, t, g, unknown, or other
ntttccctccgagtattggaactccacccccccagnaaaatttctccccctttcagactggagctccccgcggtggcggccgctctagaactagtggatcccccgggctgcaggaattcgtctcacccctagaaaaaaatcgacgtctatgcccatggccctctcgagctcgctccgtggcctggtggccctgattcccccggccctccctcccgctcgcccgagcggggcagccgccggctgccccggcaccccgcgctcggggttcgacggcgattggggccgcgctcgtcggccctcgagtctgttctttcttttggactcacattttcttgcacgcctccttccgcaaaatgaacgaaccctctggaaaacctcccccgccctcgacgtgccatcgcatgcatggtcttgttcctatcctatttataaaagtggtaataccacgcatacgaaccccctacgggactgggtgttgtcgtatcaatccccccgatattcgaataatgagcggggacgctcaactgtcagaaacctgcgttcacaaaaacgcccaccacatttaaaggcttactctttacaccaaatcccgccgccccttagtcataaagtctttttggcgccgcgcgggctaccttgcaccacaggaaaatgagtctttcacgccccccctgcctcattccatctctccactcgcatggtccatcgtgcggggaacccgctcagtagttgtcggggatggaaacgggtgagccttatgatatcgcacgcttccgtccccattgggggcgttttcccattccgaatcganagattcgcgttgagtcccgcgagcgccgctgcgcgtagaaaataatagtgattacgcgcgtacccgggggcagcgttggcggtgggtccg

SEQ ID NO: 58156 - protein, 52 aa, Zea mays
  misc_feature: Ceres CLONE 1510990
  misc_feature (38)..(38): Xaa is any aa, unknown, or other
MVHRAGNPLSSCRGWKRVSLMISHASVPIGGVFPFRIXRFALSPASAAARRK

SEQ ID NO: 58157 - DNA, 685 bp, Zea mays
  misc_feature: Ceres CLONE 1510992
  misc_feature: Encodes the peptide sequence at SEQ ID NO. 58158
aaagctggagctccccgcggtggcggccgctctagaactagtggatcccccgggctgcaggaattcgtctcacccctagaaaaagtgctctctcagaggtgggctggcttctcctccccctcttaccaagtcctcctcgggttagggttccttagggttttgtggaggggcgatggcggcggctgatgtggagtaccgttgcttcgtcggcgggcttgtctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggtaaggagctcgacggccgtaacatcaccgctaaccaggcccaatccccgtggcggtggcggtggcggcggtggctacggcggcggtcgcggcggcggcggctaatggtggggggccgccgtgacggcgggtatggccggcgggggcggcctaccggcgcccccctgcaaggttggtggccggcaagctactgaaggaaagtgcgcggcttccagtcgggtctcgacctaggggcccgggggttgggcaggcataacggccggcctgacgccatggctgctttggaaaggaaacctgcattc

SEQ ID NO: 58158 - protein, 134 aa, Zea mays
  misc_feature: Ceres CLONE 1510992
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAAADVEYRCFVGGLVWATSNESLENAFASYGEILDSKVITDRETGRSRGFGFVTFSSENSMLDAIENMNGKELDGRNITANQAQSPWRWRWRRWLRRRSRRRRLMVGGRRDGGYGRRGRPTGAPLQGWWPASY

SEQ ID NO: 58159 - DNA, 606 bp, Zea mays
  misc_feature: Ceres CLONE 1510993
  misc_feature: Encodes the peptide sequence at SEQ ID NO. 58160
  misc_feature (270)..(270): n is a, c, t, g, unknown, or other
  misc_feature (277)..(277): n is a, c, t, g, unknown, or other
aaagctggagctccccgcggtggcggccgctctagaactagtggatcccccgggctgcaggaattcgtctcacccctagaaaaatttctgctaacctcatcaaacatgggccattggcaatcggcatcaatgctgcctacatgcagacatacatcggaggcgtgtcatgcccatacatctgtggcaggcaccttgaccatggtgttctccttgttggatatggtgcttctggtttcgcccccattcgccctgaaggacaagcccttactnggatcantcaagaactccgtggggggcgagaaactggggggggaagaaccgaatacctcccaaaaatatttgcggggggtttcccaaactttttcccaaaaaaaaggggccgcggggccaaatttccccggggggccctccaacggggggggttcccccaaattccccccccccccccttaaaaaaaaggaaaaaaaaaaaatttctcccgggccacccgggggggaaaaaaaaaaacaccgggggcgcccccccccaccccatatttttggggggtaaaaaaaaaaaattttccccccccccccccccgggggggcagaagaaaaaaacacccca

SEQ ID NO: 58160 - protein, 103 aa, Zea mays
  misc_feature: Ceres CLONE 1510993
  misc_feature (44)..(44): Xaa is any aa, unknown, or other
  misc_feature (46)..(46): Xaa is any aa, unknown, or other
MQTYIGGVSCPYICGRHLDHGVLLVGYGASGFAPIRPEGQALTXIXQELRGGRETGGGRTEYLPKIFAGGFPNFFPKKRGRGAKFPRGALQRGGFPQIPPPPP

SEQ ID NO: 58161 - DNA, 665 bp, Zea mays
  misc_feature: Ceres CLONE 1510994
  misc_feature: Encodes the peptide sequence at SEQ ID NO. 58162
  misc_feature (536)..(536): n is a, c, t, g, unknown, or other
  misc_feature (665)..(665): n is a, c, t, g, unknown, or other
aaagctggagctccccgcggtggcggccgctctagaactagtggatcccccgggctgcaggaattcgtctcacccctagaaaaaaaaaaatccactctcatcaccagctaagaacagggcttcgtctcaatggaaggcaaaacagggcagctcaggtgctgtttcgtcgccatcgtgctcgtcctgggtcttgtccttgagtcccaccaggctgaagctggaggcaaatggtgctgcgaaaccgccaccggaaaataccattttaatcgctgcgttgactcgggtttggtcgacaatattgggttctgtgcgggtaatgccggttgcatcattatggaagacagatgtggaggccgttggccggtgcctgctcgtgatgcgctttccctggatgtcatttgattaattataagcaagtacgtgaagaaacgagggccagacgactgtcgtccagcgattggttatttgtgaacttgtcgtttgtcttcttatttcaactttccaataagccccttcgtgaagtgtcatccccttcnaagtctgtcgactgttacgtatacaaatctatatatcaaataaagacggcgccgtacgtgtgtatatgtctctatttctagaaaactgatcttgcagtcgtttgcttaatcaattgttctgtcactatn

SEQ ID NO: 58162 - protein, 90 aa, Zea mays; identical to SEQ ID NO: 53771
  misc_feature: Ceres CLONE 1510994

SEQ ID NO: 58163 - DNA, 631 bp, Zea mays
  misc_feature: Ceres CLONE 1510995
  misc_feature: Encodes the peptide sequence at SEQ ID NO. 58164
aaagctggagctccccgcggtggcggccgctctagaactagtggatcccccgggctgcaggaattcgtctcacccctagaaaaatctaggcctagcacagctatatcctgggttacgttcctcgcacggcggaggctaacaaaccctagccgccaggcgcaggcggtcagggagcgagtaccgagcgccccagttcacacgtgagatgtcagaatacaagaacgtcgttggggggaggctaaagctgaagggtaaggcactggatgtgaaggaaggtggagtcaagaagaaaaaaaagaagcatcagcttgaagagtcgtctcagattgagcacgatgagctccacaaagggggaaactctggcttaccagctgatcacaacaatgagcttattgaagctggcaacgtgggagatgaagaaaagaatctacatccagactacgaccacctcacaccggcggagcgacgctatatagatcagaagcaagaaaatcgacatgcaaaaacttggccaaaagttcctaaccaagtcccccggggacccgtatcccgggacttcaacccagttatctgggcgaaacctccagcgaagcccttttcccctcccctaaaagtttggcccctgggccaa

SEQ ID NO: 58164 - protein, 142 aa, Zea mays
  misc_feature: Ceres CLONE 1510995
  misc_feature (3)..(124): Pfam Name: DUF1754 Pfam Description: Eukaryotic family of unknown function (DUF1754)
MSEYKNVVGGRLKLKGKALDVKEGGVKKKKKKHQLEESSQIEHDELHKGGNSGLPADHNNELIEAGNVGDEEKNLHPDYDHLTPAERRYIDQKQENRHAKTWPKVPNQVPRGPVSRDFNPVIWAKPPAKPFSPPLKVWPLGQ

SEQ ID NO: 58165 - DNA, 863 bp, Zea mays
  misc_feature: Ceres CLONE 1510999
  misc_feature (1)..(1): n is a, c, t, g, unknown, or other
  misc_feature (44)..(44): n is a, c, t, g, unknown, or other
nttttttttttttttattttttaacttattttcagagaagtgcnccccccacaaactgggactccccgcggtggcggccgctctagaatagtggatcccccgggctgcaggaattcgtctcacccctagaaaaaatacacacaaacacacaatggctaccagaaacgatgctcctcggcgtctgtgccgtgctgatggtggtcggcgtcacgaacgcggcggagggtcaggtggcgtcagtcgtcgtgagcctggcaaggtgcgccgacagcccaaagaacaacatgaacgctgaggacggtttcaagggtctttcaggaggcgatcatacgcaaaaacagcaacggccagtacgagaacaaaggccgatgagtgaagattcaaagttcccgggagcccttccagcgtccccaattcgccgtcggacctcaatggttgcccaactgcccactgctcaagcttccccaggagctccgccaaataaaaggcctcttttgcccatggggcaaggcaaccctttccaaggaattttatcgaccccatgggtaaagggcgattataccttattcactccaccccgtgcctcatgggatcaaagattgacacttaaaccgcgtacccacaaagcagtgggccactgcccccgaagttattctagcaagagttcctcccacatcttaataaatagcccctgtgtctcggaataaccttttcccacccaagggtaactccccttgccctggtggtcccggggagacaaccactcccgggttgttcttaaaatcctagacaacagttctacccgggttaccaggaaattccccccccccggggtggtccaacacaacaatactaaccgcggg

SEQ ID NO: 58166 - DNA, 645 bp, Zea mays
  misc_feature: Ceres CLONE 1511002
  misc_feature: Encodes the peptide sequence at SEQ ID NO. 58167
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
aaagctggagctccccgcggtggcggccgctctagaactagtggatcccccgggctgcaggaattcgtctcacccctagaaaaagcggtggcggcgggaggagacgaaagagaaatatgcaggcggtggcacggacggcgcgtgggctcgcggctgcggctgcggctgcgcggccgtcggcgacggaggcagggcaccgcgggcaggtgcagcaagctcggggcatcgtggtgcaggtgagggacgggaatctggagcgggcgctgtcgatcatggagcgcaggatgcggtccagcggcatggagcgcctcatccgggcgcgcacccattaccacgtcaaggactcggagaagcgcgtgctcgcgcgtaaggggcttatgcaacgcgtccgttcccaggagctcggcaagaagctccgcgagatcctcatcaagaagatcaggtcagggccaccctcccatcaccactactgtacctgttaacgcaccgcttgtgcttgccatatcttgctggctgacttgttaatcagatatttagtggattgcggtgacgaattggaatgtgttctaatgtgatcgccaagtgctcgaaaaaaannnnnnnnnnnnnnnannnnnnnnnnnnnnnnnnnnnnnaaaaataaaa

SEQ ID NO: 58167 - protein, 121 aa, Zea mays
  misc_feature: Ceres CLONE 1511002
MQAVARTARGLAAAAAAARPSATEAGHRGQVQQARGIVVQVRDGNLERALSIMERRMRSSGMERLIRARTHYHVKDSEKRVLARKGLMQRVRSQELGKKLREILIKKIRSGPPSHHHYCTC

SEQ ID NO: 58168 - DNA, 585 bp, Zea mays
  misc_feature: Ceres CLONE 1511003
  misc_feature: Encodes the peptide sequence at SEQ ID NO. 58169
  misc_feature (251)..(251): n is a, c, t, g, unknown, or other
  misc_feature (252)..(252): n is a, c, t, g, unknown, or other
  misc_feature (259)..(259): n is a, c, t, g, unknown, or other
  misc_feature (295)..(295): n is a, c, t, g, unknown, or other
  misc_feature (296)..(296): n is a, c, t, g, unknown, or other
  misc_feature (407)..(407): n is a, c, t, g, unknown, or other
  misc_feature (433)..(433): n is a, c, t, g, unknown, or other
  misc_feature (518)..(518): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
ggagctccccgcggtggcggccgctctagaactagtggatcccccgggctgcaggaattcgtctcacccctagaaaaagcgcaaacatcgaatcgtctcactcgtgtctgccctgctcatactgcttgccctcgccgtatcgtccacccgcaacgcacaggaggaattccatggccaacaacaccgggacgttggtgggcggatccggactgccggggagcgagaacaccttcacctccaggagctcgccnncgcttcncccgtcgaataaaccaccaacaaggaaagggccccnnggcctcttctgggggttcaaaaaacctttttaaagcccaaaaacaaatggtttgctgggaccaaagttttttttccccccccccaaaggagaaaagaaagggggcaaaaancttcccccaaacttataatttttggnaaaaaaccccctggcgaaaaatttttcccgggggcctttccgggaatattccaacccctcgtttaaaaaaaaaggggggtttttngnnnaatcaaaggaagtgttccccctcccccccggggcgccgccctaaaaaaccaaaaaaaaaaaag

SEQ ID NO: 58169 - protein, 52 aa, Zea mays
  misc_feature: Ceres CLONE 1511003
  misc_feature (28)..(28): Xaa is any aa, unknown, or other
  misc_feature (30)..(30): Xaa is any aa, unknown, or other
  misc_feature (42)..(42): Xaa is any aa, unknown, or other
MANNTGTLVGGSGLPGSENTFTSRSSPXLXPSNKPPTRKGPXGLFWGFKKPF

SEQ ID NO: 58170 - DNA, 671 bp, Zea mays
  misc_feature: Ceres CLONE 1511006
  misc_feature: Encodes the peptide sequence at SEQ ID NO. 58171
aaagctggagctccccgcggtggcggccgctctagaactagtggatcccccgggctgcaggaattcgtctcacccctagaaaaagaggtaccaaatcataaatttctgccatcacagctacaggcacttaaagcagccattcatgctattgaggcatctatgcctgaggcagcttttactggttcttggatgaagtctgctcacaagctgtgggttaagcggctgcgacgaacgtcatcattgccagagcttttgcaggttcttgtcgattttgtaggggcaatggatgttgattggttgtacaaaagttcatctgcgagattgagaacaaatctggatgacatcattgtcgactttcagacaatgccacaaacaacatcagcagttgcactttgggttgtccaattggatgccctcattgcgccttatttggataatgccatgacaagacagctggtgaatgctaggtagcttacgaagatggattcttttgcgtgatgcacaagcaccccgagctgacttctttttctggcaccatctgcaagtttttttcttgatgaaagcttttcatctaggtgagacagaccatggggttttgcttttaagttccagaacaagatctttgcgacttgctgtaaaacatggaataatattgttcccctcccagcaga

SEQ ID NO: 58171 - protein, 156 aa, Zea mays
  misc_feature: Ceres CLONE 1511006
KAGAPRGGGRSRTSGSPGLQEFVSPLEKEVPNHKFLPSQLQALKAAIHAIEASMPEAAFTGSWMKSAHKLWVKRLRRTSSLPELLQVLVDFVGAMDVDWLYKSSSARLRTNLDDIIVDFQTMPQTTSAVALWVVQLDALIAPYLDNAMTRQLVNAR

SEQ ID NO: 58172 - DNA, 642 bp, Zea mays
  misc_feature: Ceres CLONE 1511008
  misc_feature: Translation starting site: 152
  misc_feature: Pfam Name: PSI_PsaE Pfam Description: Photosystem I reaction centre subunit IV / PsaE
aaagctggagctccccgcggtggcggccgctctagaactagtggatcccccgggctgcaggaattcgtctcacccctagaaaaaactctctctccccatccgcgccagtccaaccaagtcagcacccgcgcgcggcaaggagttcacgcccatggcgagcaccaacatggcgtcggccacctcgcggttcatgctggccgcgggcgtgcccaccgccagtagcggcagcggccgcgtcagcttcgcctcggcgcccaaccggcttggcaggaggcttgtggtccgggccgatgaggagtccccggcagagccggcgccgacggcggaaggagagggcgccgtggccaccaagcccaaggccgagaagccgccgccgatcgggcccaagagaggcgccaaggtgaagatcctgagggcgggagtcctactggtacaacgggatcggcaacgtcgtccccgtcgatcaggatcctaacacccgttacccggtgggtggtgctgtttcaacagggtgaactacccccggcgtgtctacccaacaactacgccttgggacgagatcccccgaggtgaaaatgaggtgagcccaagtctgctccaaggaccccccatgctcctggtgtgaatttgaaatttgagaaa

SEQ ID NO: 58173 - DNA, 674 bp, Zea mays
  misc_feature: Ceres CLONE 1511009
  misc_feature: Encodes the peptide sequence at SEQ ID NO. 58174
aaagctggagctccccgcggtggcggccgctctagaactagtggatcccccgggctgcaggaattcgtctcacccctagaaaaaaaaaccctacccgactccgccgccgctccgccgccgctccgcctcagcgcatcgccctccgccacagcgtaccgcgacctcatcgatcaccttcaactttcaatcatggcggacgtcgatgtcgaaccggaggttgccgccggcgctcccaagaagaggacgttccgcaagtacagctaccgcggcgtcgacctagatgcgcttctcgacatgtccacggacgacctcgtccagctcttccccgcgcgcgccaggagaaggttccagaggggtctgaagaggaagcccatggcactcatcaagaagctgcgcaaggcgaaaaaggatgctcctgctggtgagaagccagagccagtcaagacacatctccgtaacatgatcattgtccctgagatgattgggagcattgtttggggtctacaacggcaagacattcaaccagggttgagatcaagcctggagatgaacggccactacccttgctgaagttctccatctcccaaaaagccgggcaaagcatgggcaggccccggtatcgggtgcccccccactccctcgcggttttattccctctgaaatggagcttgttc

SEQ ID NO: 58174 - protein, 126 aa, Zea mays
  misc_feature: Ceres CLONE 1511009
  misc_feature (55)..(123): Pfam Name: Ribosomal_S19 Pfam Description: Ribosomal protein S19
MADVDVEPEVAAGAPKKRTFRKYSYRGVDLDALLDMSTDDLVQLFPARARRRFQRGLKRKPMALIKKLRKAKKDAPAGEKPEPVKTHLRNMIIVPEMIGSIVWGLQRQDIQPGLRSSLEMNGHYPC

SEQ ID NO: 58175 - DNA, 708 bp, Zea mays
  misc_feature: Ceres CLONE 1511010
  misc_feature: Encodes the peptide sequence at SEQ ID NO. 58176
  misc_feature (194)..(194): n is a, c, t, g, unknown, or other
aagctggagctccccgcggtggcggccgctctagaactagtggatcccccgggctgcaggaattcgtctcacccctagaaaaagtgctttcttagaggtgggttggcttctcctccccctccggttcgggttcgggttcgtgaggttctccggggttcgggttcgtgggtgagcggatcgagatggcggcgtcngatgttgagtaccgctgcttcgtcggcggcctcgcctgggccacggacgaccactccctccacaacgccttcagcacctacggcgaggtcctcgagtccaagatcatcctcgatcgggagacccagaggtcccgcggcttcggcttcgtcaccttctccacggagtattcccccccccaacgcggggggggggggggacctacaaggacctggaccggccgcaatttcaccgttcagcaagggcccattcccgcggcgggctgtgggaggcggcccccggtcgggctaccgctggtcagccgcggcagggccggcggttcccggcgggggtccgcgtcccgctgcctggctcgcgagcacgtcccctaatggtgtctggaccagttactcgttagacgcggcgtcggttcccgcaccccacgcggcgtataccctatgctctttcggcctttcgcgatacccgttggcccggcctcccatgttgtgtatctccctcgagaaagatacctttgtg

SEQ ID NO: 58176 - protein, 126 aa, Zea mays
  misc_feature: Ceres CLONE 1511010
  misc_feature (10)..(74): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAASDVEYRCFVGGLAWATDDHSLHNAFSTYGEVLESKIILDRETQRSRGFGFVTFSTEYSPPQRGGGGGPTRTWTGRNFTVQQGPIPAAGCGRRPPVGLPLVSRGRAGGSRRGSASRCLAREHVP

SEQ ID NO: 58177 - DNA, 498 bp, Zea mays
  misc_feature: Ceres CLONE 1511011
caaactggagctccccgcggtggcggccgctctagaactagtggatcccccgggctgcaggattcgtctcaccccctagaaaaaaaaaccctactaaccgcgtctcctctcagcgcccgccgtcgccgccgccctcctcttggtcccgccgtccgtcgaggtcatcatggtgagggtcagtgtgctcaaacgatgcgctcagtcatgtacaatgcaaagagaggggcagagcaggtcatgatcaggccgtcgtccaagtgatcatcaagttcctgacggtcatgcagcgtcatggattccattggccaagttcaaagtacctggaaatgtccccacaaaactttgggaaaaaattgggggtggaaacgaaacgggagaacaaaaaaaaaagcggggggaatttaacccccccggtttttaaattttgggggaaaaaagaaaaaatcaaaaggttttgaatttgggaaaaggttttttttttccgttttttcccaaagt

SEQ ID NO: 58178 - DNA, 688 bp, Zea mays
  misc_feature: Ceres CLONE 1511016
  misc_feature: Encodes the peptide sequence at SEQ ID NO. 58179
  misc_feature (391)..(391): n is a, c, t, g, unknown, or other
  misc_feature (398)..(398): n is a, c, t, g, unknown, or other
  misc_feature (401)..(401): n is a, c, t, g, unknown, or other
  misc_feature (407)..(407): n is a, c, t, g, unknown, or other
  misc_feature (408)..(408): n is a, c, t, g, unknown, or other
accctggagctccccgcggtggcggccgctctagaactagtggatcccccgggctgcaggaattcgtctcacccctagaaaaaagaagcctccaccctcctgcgcctccaccctcctcgccgcctcactccctctgaggtcgcagatccgtccggttagacgaagccgcccgcacccatggcctccggtgagctcgcctgcacctacgccgccctcatcctcagcgacgacggcatcgccatcaccgccgagaagatcgccaccatcgtgaaggcggccaacatctatgtcgagtcctactggccggcgctcttcgctaagctcctggagaagcgcagtgttgaggatctaatcctctctttttccccccccccagggggggggggggggngctgctnccncccccnnctggaggtgcttcaacttgcttactacccccgcctgccgagggaaaagaagggaggggcccccggaggaatcctcatgacccacctggggcttcccgcttgttcccactggagaaggcccttccctactccagtccttataaaaattccccttatggctgccccaaaacctatccttacccctattgggtggtgagccctctctgttaataaccacagaatcccccgttctggcagtttttttgaactccggccttttcaccaatggcgatgatagaccg

SEQ ID NO: 58179 - protein, 141 aa, Zea mays
  misc_feature: Ceres CLONE 1511016
  misc_feature (72)..(72): Xaa is any aa, unknown, or other
  misc_feature (74)..(74): Xaa is any aa, unknown, or other
  misc_feature (75)..(75): Xaa is any aa, unknown, or other
  misc_feature (77)..(77): Xaa is any aa, unknown, or other
MASGELACTYAALILSDDGIAITAEKIATIVKAANIYVESYWPALFAKLLEKRSVEDLILSFSPPPGGGGGXCXXPXLEVLQLAYYPRLPREKKGGAPGGILMTHLGLPACSHWRRPFPTPVLIKIPLMAAPKPILTPIGW

SEQ ID NO: 58180 - DNA, 757 bp, Zea mays
  misc_feature: Ceres CLONE 1511017
  misc_feature: Encodes the peptide sequence at SEQ ID NO. 58181
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (46)..(46): n is a, c, t, g, unknown, or other
  misc_feature (47)..(47): n is a, c, t, g, unknown, or other
attagacaacgatggaggataacttcgtagggcnnnnnnnccatanncgatcaaactggagctccccgcggtggcggccgctctagaatagtggatcccccgggctgcaggaattcgtctcacccctagaaaaatcggaggaggcggaccaggtaagcagcagcaggaaccctagcaccgccgcatccgcagccatgggtatcgacctcgttgccggtgggaggaacaagaagaccaagcgcacagcgccgaagtccgacgatgtttatctcaagctccttgtcaagctctaccgtttcttggtcaggaggaccaagagcaacttcaatgctgtcattctcaagaggctcttcatgagcaaaaccaatcggccaccaatctcccatgcgccgccttgtcaagttcatggaatgaaaggagaagaacattgctcggattggtcggcataaccccatatgaacaagagggtccaagaagccccccgccaaatgaaggttactggccctgagggttcacccgagacgggcacgggcccagaattggcaaatgctggggggggaagtggccccccattttaaccaactttggttctcccgcgcttcactttggcggagaacaacagcccttttttgaagggggcccccaagaaaggcgccggggaggggggggaaggcacctttcggtacggggctcctcgggagtgggccgcgatggtccccccccaaaggccattattgtgccgctacccagcggggaa

SEQ ID NO: 58181 - protein, 84 aa, Zea mays
  misc_feature: Ceres CLONE 1511017
  misc_feature (12)..(82): Pfam Name: Ribosomal_L18e Pfam Description: Eukaryotic ribosomal protein L18
MGIDLVAGGRNKKTKRTAPKSDDVYLKLLVKLYRFLVRRTKSNFNAVILKRLFMSKTNRPPISHAPPCQVHGMKGEEHCSDWSA

SEQ ID NO: 58182 - DNA, 701 bp, Zea mays
  misc_feature: Ceres CLONE 1511018
  misc_feature: Encodes the peptide sequence at SEQ ID NO. 58183
  misc_feature (385)..(385): n is a, c, t, g, unknown, or other
ggcggccgctctagaactagtggatcccccgggctgcaggaattcgtctcacccctagaaaactctgccgtcgcctgtccactttccccgtgcttctccgccgtcgaggccgcgtcccagtgcgaagagactccgactcagatggccagccgctgggtccggcccgaggtgtacccgctgttcgcggcgacgggcgtggccgtcggcatctgcgggtttcagctcttccggaacatcactggcaacccggaagtcagggtaaacttaggccggggagggcagctgggtgtcctttcaaaaccctgatgtaggggagacccttaccccatgccttggccttaaattttttttccccccccacgggggaaaagaaggggggctcccntttccccccctcctttttctgtcccctaggttagaaaaaaataaatttgggttttgtggcccggtcggcactttgcccacccgggcctttcctcccctttttgcgtggcctatctccctgcgctttcggccctcttcccccgcttttttctcttcccccttctccgtttcccccctggcccttcccgttttttccccttccttttgttgcgcccccttcccctcttttcgtgccctgtgttcgcgtttccccctccaacccggtccttcgcccgagtaacccgcattttcccctcctccccgtcccgcccgtcccc

SEQ ID NO: 58183 - protein, 54 aa, Zea mays
  misc_feature: Ceres CLONE 1511018
  misc_feature (2)..(53): Pfam Name: B12D Pfam Description: B12D protein
MASRWVRPEVYPLFAATGVAVGICGFQLFRNITGNPEVRVNLGRGGQLGVLSKP

SEQ ID NO: 58184 - DNA, 690 bp, Zea mays
  misc_feature: Ceres CLONE 1511019
  misc_feature: Encodes the peptide sequence at SEQ ID NO. 58185
caaagctggagctccccgcggtggcggccgctctagaactagtggatcccccgggctgcaggaattcgtctcaccccagaaaaaactgcgactgtgagcttcgttcgttcagttcatccgtgttcttgtttgcgaggtcgagagagagaggatgtcgtgctgcggaggcaactgtgggtgcggctccggctgcaagtgcggcaacggctgcggagggtgcagcaagatgtacccggacatggctgagcaggtgaccaccaccacccaggctctcatcatgggtgtcgcaccatccaaggggcacgccgagggcgggttcgaggcggcccccggagctgagaacggcgggtgcaagtgcggcggcaactgccagtgcgacccctgcacctgcggcaagtgaactaggtgctccaccctgcaggcccgccggaagaagctagctaattattataagctaaataaagtatacccgccgtccctgtgggtgtttccagccaagcccgccagttaatttgcctgcccttggctgggcctgctcctgagtcttaaaataataatgaatccctgaagggcggcccccctgtcctggaaatccccccccctgcccccttcggggggctttcttgggcggcgaaccaaggggcgtttggggctgggggttcccgcggggctccccacccccgggaaacg

SEQ ID NO: 58185 - protein, 82 aa, Zea mays
  misc_feature: Ceres CLONE 1511019
  misc_feature (1)..(80): Pfam Name: Metallothio_2 Pfam Description: Metallothionein
MSCCGGNCGCGSGCKCGNGCGGCSKMYPDMAEQVTTTTQALIMGVAPSKGHAEGGFEAAPGAENGGCKCGGNCQCDPCTCGK

SEQ ID NO: 58186 - DNA, 775 bp, Zea mays
  misc_feature: Ceres CLONE 1511111
  misc_feature: Encodes the peptide sequence at SEQ ID NO. 58187
  misc_feature (405)..(405): n is a, c, t, g, unknown, or other
  misc_feature (409)..(409): n is a, c, t, g, unknown, or other
acagctggagctccccgcggtggcggccgctctagactagtggatcccccgggctgcaggaattcgtctcacccctagaaaatctcaccaccgctgcctccgcggtttcgcttccccccgtcttcccaagcctttgcttcgctcttcgcttcggattccctctgctcatggccgggagagggaaggcgatcggctcaggggccgccaagaaggccatgtccaggagctccaaggccgggctccagttcccagtgggaaggatcgccaggttcctcaaggccggcaagtccgcccgagagggtcggcgccggggccccccgtctacctcgctgccgtgcttcgagtattcttgctgctggaggttttttccccccccccgggggggggggggggggggcaaccaanaaanaccccccatttttctcgttgctcttttctcacgctcagcccgaccgccacccgacccagggagcttgttccccgcctttgccggggcccctgtcggacccattggccctagcgggcgggcggtcccatgtttccaaactccgccctcacatcctggctgtttgtctgccaaataaattctgcggtccgctttgaccccccccccattgtccttccgctgtcgcgcccgcccggtgcggccccagcgccaagatgcccggctttttgccttatctccgcccctgtgggggtggggcccactcttccggagacaaggctgctcgcgtaaaccaagcgtcgggtagacgcacgccatctgtacacgctg

SEQ ID NO: 58187 - protein, 38 aa, Zea mays
  misc_feature: Ceres CLONE 1511111
MPGFLPYLRPCGGGAHSSGDKAARVNQASGRRTPSVHA

SEQ ID NO: 58188 - DNA, 687 bp, Zea mays
  misc_feature: Ceres CLONE 1511114
  misc_feature: Encodes the peptide sequence at SEQ ID NO. 58189
aaagctggagctccccgcggtggcggccgctctagaactagtggatcccccgggctgcaggaattcgtctcacccctagaaaaaaagacgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacgcctgcggctgcggtagcagctgcaagtgcgacccctgcaactgctgatcacatcgatcgacgaccatggatatgattattatctatctagcttgtggtggtggttgaacaataataagcgaggccgagctggctgccatacataagtattgtgtggtgtgtgaaacagagaaagaaacagagttccttccgtttgctatccctctcctcggcatgtttgggcggcaagccttttgtgctcactgtaccatgtggcctacctggcaatggttggttggatccccaaatggcccctggctggtcaacccataaatttgaaatttggtccccccccattgaaaaaaaaaaaaaaaaaaaa

SEQ ID NO: 58189 - protein, 76 aa, Zea mays; identical to SEQ ID NO: 42649
  misc_feature: Ceres CLONE 1511114
  misc_feature (1)..(76): Pfam Name: Metallothio_2 Pfam Description: Metallothionein

SEQ ID NO: 58190 - DNA, 687 bp, Zea mays
  misc_feature: Ceres CLONE 1511121
  misc_feature: Encodes the peptide sequence at SEQ ID NO. 58191
aaagctggagctccccgcggtggcggccgctctagaactagtggatcccccgggctgcaggaattcgtctcacccctagaaaaaaccgagcggctactggccaaccactaaaggcaggcgcggcatatcgcgacaccgtaccagcctaaatacttggagaaaggagaagcagcgcatcgtcatgggcaccagtcccgttgtccctgcgaccatgctcgtcgtcgctctccttgtcgctagtagtactgtctgcttcggcgccaccgccaccgacaccgacaccgacggcgccattcgtctccccagcaactctggtgctgttggtctaccgtgggagtgctgagactatgtcaccacggagccgattatcacgccgccccctaggagctgcaacgacgtgctggactagtgttcctccgactgccaagagtgctaggagtctccgggcggcgacggaatcatcagcccctgactggttattcagactgttccagcccctggtcttgccaccgcggctcgtgtgactgatagcaacttccgccgtctggccaagggaactccctccccctaatgcccggtgccagtgaccttgggtggtaatcttttgcccctatgcaccttgccaagggcggcaaaagcttggtcggaagacaggaacccctccctttccttacccgaagggcctga

SEQ ID NO: 58191 - protein, 53 aa, Zea mays
  misc_feature: Ceres CLONE 1511121
MGTSPVVPATMLVVALLVASSTVCFGATATDTDTDGAIRLPSNSGAVGLPWEC

SEQ ID NO: 58192 - DNA, 662 bp, Zea mays
  misc_feature: Ceres CLONE 1511123
  misc_feature: Encodes the peptide sequence at SEQ ID NO. 58193
  misc_feature (662)..(662): n is a, c, t, g, unknown, or other
aagctggagctccccgcggtggcggccgctctagaactagtggatcccccgggctgcaggaattcgtctcacccctagaaaaaatccactctcatcaccagctaagaacagggcttcgtctcaatggaaggcaaaacagggcagctcaggtgctgtttcgtcgccatcgtgctcgtcctgggtcttgtccttgagtcccaccaggctgaagctggaggcaaatggtgctgcgaaaccgccaccggaaaataccattttaatcgctgcgttgactcgggtttggtcgacaatattgggttctgtgcgggtaatgccggttgcatcattatggaagacagatgtggaggccgttggccggtgcctgctcgtgatgcgctttccctggatgtcatttgattaattataagcaagtacgtgaagaaacgagggccagacgactgtcgtccagcgattggttatttgtgaacttgtcgtttgtcttcttatttcaactttccaataagccccttcgtgaagtgtcatccccttcaaagtctgtcgactgttacgtatacaaatctatatatcaaataaagacggcgccgtacgtgtataaaaaaaaaaaaaaaaacgagacgctcgaggtacccaattcgccctatagtgagtcgtattacgcgcgn

SEQ ID NO: 58193 - protein, 90 aa, Zea mays; identical to SEQ ID NO: 53771
  misc_feature: Ceres CLONE 1511123

SEQ ID NO: 58194 - DNA, 645 bp, Zea mays
  misc_feature: Ceres CLONE 1511126
  misc_feature (73)..(73): n is a, c, t, g, unknown, or other
  misc_feature (82)..(82): n is a, c, t, g, unknown, or other
  misc_feature (201)..(201): n is a, c, t, g, unknown, or other
tgggctccccgcggtggcggccgctctagactagtggatcccccgggctgcagggaattcgtctcacccctangaaaaagtnccatcagggcatccaagaagctcaaagcaagcagatctaagctccaggcagcgtcgcgacagagtgagtgagtagcacgacaacaacaatggcttccctgaaagccgcgaagcccagcngagtttgcggcgcagggcaaggagcgggggccccagctcagcgagacgggaacaaaacccttcgcccccaaagaacgggcgggtttaaaaaaggctaagccaaacccccggggaaaccccaaggggagggggaaaagacggcaaaaagggggggggggggcccaaaaatggccctcacgcaaccctggggggagtgttaaaggggctttcccctgcccggaggggaaacccccccccgggtgtttgaaaaacatgccccccccccctttctggggaccccccccagggggggccggggggggtgggggccccccccctcctggggggggggaagcccccccaacagatatttcctcccccaaaaaaaagcctttttttttttatacctcttcgggccaaaaaaaaaaaaaaaaaaaaaaaaatccacaggccctttttttttgt

SEQ ID NO: 58195 - DNA, 737 bp, Zea mays
  misc_feature: Ceres CLONE 1511129
  misc_feature: Encodes the peptide sequence at SEQ ID NO. 58196
  misc_feature (408)..(408): n is a, c, t, g, unknown, or other
  misc_feature (410)..(410): n is a, c, t, g, unknown, or other
  misc_feature (411)..(411): n is a, c, t, g, unknown, or other
  misc_feature (432)..(432): n is a, c, t, g, unknown, or other
  misc_feature (441)..(441): n is a, c, t, g, unknown, or other
attctggagctccccgcggtggcggccgctctagaactagtggatcccccgggctgcaggaattcgtctcacccctagaaaagttccttgcgtccatccatccgccatggcgaatggtacgttactgagctccagctacggaatgtccgccggcgttcatatggtctcctacccttattccgcatcagtgagctacctcaagtcgcatctcttcggcttctacgacttcgagagcggtgcaactccaaacgtcgacggcaatcctgctcaacaagaggtcctgttcatcctccccattggggggaaatgcatcccccctagagtgatttattacacaaaaccttggataacacggcgtgcgaattcttttttttccccccccacacaggggaaaagaaaggggggctntnnttccttttaaccttttttttnttattcccnctaaaaaaaaaaaaaaaaaactacaacattttccggggggggggtctgaaagaccaaataaaaaatgcacggatcttctcaaaaagggtcttcccaaggatggccagtctaacttttcttctataaaaaaagcggagacccaccctccatttttctttccatatactggatgtcgtggggaggcaccatacctttcgcctttgtgacccgcccccgcgctaccagaccattttgtgtcttatagtttgccgcacaccccccgtcagacttgcttaccttggctccatacggatatg

SEQ ID NO: 58196 - protein, 104 aa, Zea mays
  misc_feature: Ceres CLONE 1511129
  misc_feature (101)..(101): Xaa is any aa, unknown, or other
  misc_feature (102)..(102): Xaa is any aa, unknown, or other
MANGTLLSSSYGMSAGVHMVSYPYSASVSYLKSHLFGFYDFESGATPNVDGNPAQQEVLFILPIGGKCIPPRVIYYTKPWITRRANSFFSPPTQGKRKGGXXSF

SEQ ID NO: 58197 - DNA, 640 bp, Zea mays
  misc_feature: Ceres CLONE 1511131
  misc_feature: Encodes the peptide sequence at SEQ ID NO. 58198
aaagctggagctccccgcggtggcggccgctctagaactagtggatcccccgggctgcaggaattcgtctcacccctagaaaaaagcagtcagcagtgaccaactcgaagcttgcgttcttgtagtagaggtcggcagcaagcggtagagcgagaggtcgagaagatgaagagcagcactctgttggcgatcctagttctccaggcccttctggtctctacggccgtggccaaaggacctgcagggccgaagaagcagtgctggtgcggcgagtgcaccagctggtcgggcgtgtggacctgcgacgacctcctcaccaagtgcgccgccacctgcaagaactgcgtccccgtctccacggacaagggcgccaccaagtggagatgccgcgacttcctccccgaaaactgcggctgcaagatccactagactcatccacagcggcacagccgatggatccttccatgctcctccgtccgtccgccttgctacaagcaggcagccaccaataagctagctcttgttgttgttttgcctgcttgattgggtgtcccttcccggtcgagatgggataattgtcaggcgcacgtccacacctgttattacaatatttctccccaacaaataaaaacctccatcg

SEQ ID NO: 58198 - protein, 87 aa, Zea mays
  misc_feature: Ceres CLONE 1511131
MKSSTLLAILVLQALLVSTAVAKGPAGPKKQCWCGECTSWSGVWTCDDLLTKCAATCKNCVPVSTDKGATKWRCRDFLPENCGCKIH

SEQ ID NO: 58199 - DNA, 678 bp, Zea mays
  misc_feature: Ceres CLONE 1511132
  misc_feature: Encodes the peptide sequence at SEQ ID NO. 58200
  misc_feature (555)..(555): n is a, c, t, g, unknown, or other
aaagctggagctccccgcggtggcggccgctctagaactagtggatcccccgggctgcaggaattcgtctcacccctagaaaaagctcacaaagcagtcctcccaccgcacgcaacgcagcctcgacctcgacctcgccgtcgccatggtgagcaagcagacccgccgcctcctcgtccttgccgccgtcgccgtatgcctccacctccccgccgcctctgtcgccaccgacgtcgattactgcagtaaaaaggagtacccggtgaaggtgagcggggtgcagatcgtgcccgatccggtcgagcccggcaagcccgccactttcaagatctccgcttctactgataaaaccatcgagaaggggaagctggtgatcgacgtggagtacttcttcttctacgtgcacttggagacgcgcgaaatctgcggagagatctcctgtccggcgaccggcgacttcttgctgtccccccagcagacgttgccacgggttcactcccccgggggtcgtacccgatctacattgaaaatggtccgggaaccacgaccaagaanctcaactgccttctccgcttcggcttttcgtcacgggggtccggccgccctccccgccttaacccccccctctgatttgcgcgctcaaaaattccgcccaacattggaaggtcacattttgct

SEQ ID NO: 58200 - protein, 177 aa, Zea mays
  misc_feature: Ceres CLONE 1511132
  misc_feature (26)..(145): Pfam Name: E1_DerP2_DerF2 Pfam Description: ML domain
  misc_feature (137)..(137): Xaa is any aa, unknown, or other
MVSKQTRRLLVLAAVAVCLHLPAASVATDVDYCSKKEYPVKVSGVQIVPDPVEPGKPATFKISASTDKTIEKGKLVIDVEYFFFYVHLETREICGEISCPATGDFLLSPQQTLPRVHSPGGRTRSTLKMVREPRPRXSTAFSASAFRHGGPAALPALTPPSDLRAQKFRPTLEGHIL

SEQ ID NO: 58201 - DNA, 620 bp, Zea mays
  misc_feature: Ceres CLONE 1511134
  misc_feature (32)..(32): n is a, c, t, g, unknown, or other
  misc_feature (33)..(33): n is a, c, t, g, unknown, or other
  misc_feature (40)..(40): n is a, c, t, g, unknown, or other
ggggggttcaagtggggggcggggtgcagganntttacantaccaagagaaaaagagcaactcgcctctcagaattaaaatcatatcctgtttccccctaacctggttccaaagaaaccaagagaatccaacataccaccatggagtagaccggtccccgagtaaggagctacgggaagaagtgacccaacgggcactttaccgccccggtcctccgatccaccgcgttctcatgtccgccagggtgtctgtggagctccgcctcaggtacaacgtgcgctccttcccgatcggcaagtacgaccaggtggaggtcacgcgcggcacctactatgttttcgctgtccacgtgggggaggcggtgaggctctgtaggtcatccgtaatgatggcatcaaccacaagaagagtaacatgtttcccgggaacgtgctcatcgccatctccaacgtgatcgacattgagcagatgctcgacaaggacgacatggctctcctggagcgtgaggcccatatccacgctgctcagcatgctaaggacacgtttgctaacgactacattgctgccagcgacgatggtgactccgccaacaaggcctcctattccgcatataacgtatc

SEQ ID NO: 58202 - DNA, 660 bp, Zea mays
  misc_feature: Ceres CLONE 1511140
  misc_feature: Encodes the peptide sequence at SEQ ID NO. 58203
  misc_feature (619)..(619): n is a, c, t, g, unknown, or other
aagctggagctccccgcggtggcggccgctctagaactagtggatcccccgggctgcaggaattcgtctcacccctagaaaaaagcagcctcccgaatccccaaagcctccgacccccttcctctctccctccgccgccgctgcgcacgcagggaacaagcgacatgggcgtctacaccttcgtgtgccgcaacaacggcggcgagtggaccgccaagcagcactccggcgagatcgaggcttccgccgctaccccatacgagctgcagcgccgcctcgtcgccgctgcctccgcggccgactctgcctacggcgtccagtcgtccttctccatggtcacccccagctccgccgtgttccaggtgatcgtcggtgctgttggtggtggtgcaatgatggtgagcggaggtggcggcggtgctgctgcatctggtggtgctgctgccgaggctcccaaggaggagaagaaggaagaggagaaggaagagagcgacgacgacatgggattctccctgttcgactagagttgtgtgtgtcatctggatctcagaagtggtggtttggtcctgttgccgtagttaattttgctgtcctgtctgtgaacctgaagaactctttntaattgttaacagcgacctgttccagtttatgtgagaattg

SEQ ID NO: 58203 - protein, 119 aa, Zea mays; identical to SEQ ID NO: 5034
  misc_feature: Ceres CLONE 1511140
  misc_feature (25)..(118): Pfam Name: Ribosomal_60s Pfam Description: 60s Acidic ribosomal protein

SEQ ID NO: 58204 - DNA, 678 bp, Zea mays
  misc_feature: Ceres CLONE 1511145
  misc_feature: Encodes the peptide sequence at SEQ ID NO. 58205
aaagctggagctcccggtcggtggcggccgctctagaactagtggagcccccgggctgcaggaattcgtctcacccctagaaaaagccgccgttcgctgctcggcgctctcctctcccgacgacagctacacctcacaaccgtgagctcgcgaaggaacgctgttcgcaattccggcgccggcaccatgagtaagctgcagagtgattctctgagggacgcgattgcctcaattaccaatgattcccgtgagaagcagcgcaaatttgttgaaaccattgagctacaaattggactgaagaactatgaccctcaaaaggacaagcgcttcagcggttctgttaagctgcctcacatccctcgccctaagatgaaggtttgcatgcttggtgatgctcagcatgttgaggaggcacacagaatgggtatagacaatatggatgtggaagccctcaagaagatgaacaaaaacaagaagctagtgaagaagctggcaaagaagtaccatgctttccttgcatctgaggctatcattaagcaaattcctcgtcttcttggtcctggtcttaacagggcaggaaaattccctaccttggtgacacaccaggaaatcccttgaggtccaaggttaatgaaacaaaaggctacagtttaagttcaacctgaaagaaaggtgctt

SEQ ID NO: 58205 - protein, 143 aa, Zea mays
  misc_feature: Ceres CLONE 1511145
  misc_feature (10)..(144): Pfam Name: Ribosomal_L1 Pfam Description: Ribosomal protein L1p/L10e family
MSKLQSDSLRDAIASITNDSREKQRKFVETIELQIGLKNYDPQKDKRFSGSVKLPHIPRPKMKVCMLGDAQHVEEAHRMGIDNMDVEALKKMNKNKKLVKKLAKKYHAFLASEAIIKQIPRLLGPGLNRAGKFPTLVTHQEIP

SEQ ID NO: 58206 - DNA, 653 bp, Zea mays
  misc_feature: Ceres CLONE 1511147
  misc_feature: Encodes the peptide sequence at SEQ ID NO. 58207
aaagctggagctccccgcggtggcggccgctctagaactagtggatcccccgggctgcaggaattcgtctcacccctagaaaaaatttccgttcacgggcagagagagggaaagtagtagcacaacaaatacaaaaaaggcaggagaatatccaatttttctgatcggctgtgctacgcagcgctgtggctgcgcttccctgccttattttgaagctagcacatattttcaagctagcagcaaggccacaacagttctggctcccctccccatcggcttcgccgtgttcatggtgcacctggccaccatccccgtcaccggcaccggcatcaacccggccaggagcctgggcgccgccgtcatctacaacaaggacaagccctgggacgaccactggatcttctgggtgggccctctcgtgggcgctgccatcgcggccttctaccaccagtacatcctccgggctggcgccatcaaggccctcggctccttcaggagcaacgcgtgatgagcggggcttggctgtggagcaatggcgggcgacctacgggcgggggaagtcgtgagcgaggagaatgacatcatcgatcgacttgggtgccggtggttggttcgggtcgccttttttgtttcagcagctgctgcgttgcgcg

SEQ ID NO: 58207 - protein, 72 aa, Zea mays
  misc_feature: Ceres CLONE 1511147
MVHLATIPVTGTGINPARSLGAAVIYNKDKPWDDHWIFWVGPLVGAAIAAFYHQYILRAGAIKALGSFRSNA

SEQ ID NO: 58208 - DNA, 702 bp, Zea mays
  misc_feature: Ceres CLONE 1511148
  misc_feature: SWISSPROT Homolog: EC 5.5.1.9 Cycloeucalenol cycloisomerase
ggagctccccgcggtggcggccgctctagaactagtggatcccccgggctgcaggaattcgtctcacccctagaaaaagtagacagtcggttccgttgttgtacgcagtatactgtatcgcttgcttcccaatgttttccaggattgtccagaaagattagaagtgcagcctgtacagagtagccatcgactctctgggcgcactaatgctggtgacaataatcctggaccgtgtgtgcacatgtttctggggccaatcgtttccgtcccgaagtcaagacaccctgccctagctcggctcgtgtggatgccattgtacaacggaagattctgattcagggcagctgccacttctgcgttatcccttgaatacctcatcgtcacctagcattcaccggggcggagatctctgacctttaaccctctggcgaaatcatggactccctccgtgtgatagataactgcctcatctgtggcctgatgcaattgggcaactgcccctttcagtacccatgttgtgcctgtcatcggccttctgggggaactaggggggagttttgttttgctactttggaaagaggatcaatgcctgttcctcatttctcttaaaaattcctatcttggggagcctaaaaagtctccgggacccttgcacatttaaaaacccggagaggcccttttaaagtcaacccaaaattacac

SEQ ID NO: 58209 - DNA, 685 bp, Zea mays
  misc_feature: Ceres CLONE 1511150
  misc_feature: Encodes the peptide sequence at SEQ ID NO. 58210
ggagctccccgcggtggcggccgctctagaactagtggatcccccgggctgcaggaattcgtctcacccctagaaaaagcagccgccacctcaacccaggaacagagcgaggcgacgccgcggcacctcttctccggcgaagggaaatggcaaccgttccaggggatctgatctggcaggttgtgaggaagaacaactccttccttgtgaagcagttcggcaacggcaatgccaaggtgcagttcaccaaggagccgaacaacctctacaacatccactccttcaaacactcgggtttggcgaacaagaagactgtgacgatccagccagctgcaaaggactcggctgtggtcctctctactaccaagaccaagaagcggagcgcacctgcgaagctcagccacaagtctgtgatgcgcaaggagttccgcaagatggccaaggctgtgaaaaaccaggttagtgacaactactacaggtcctgatctgacccaagccagctcttgctaggctaagctcgggtgtaccgcagccctccagggttgcccaagtccgggtgtccagaaagaaggaaccaggccagtccctaagccgcttaaagtttgtggttcctggcccggggggggcatggttgggtggcctccgttaattccccacgcctttaaaattctatcctaaagggccc

SEQ ID NO: 58210 - protein, 112 aa, Zea mays
  misc_feature: Ceres CLONE 1511150
  misc_feature (5)..(113): Pfam Name: Ribosomal_L28e Pfam Description: Ribosomal L28e protein family
MATVPGDLIWQVVRKNNSFLVKQFGNGNAKVQFTKEPNNLYNIHSFKHSGLANKKTVTIQPAAKDSAVVLSTTKTKKRSAPAKLSHKSVMRKEFRKMAKAVKNQVSDNYYRS

SEQ ID NO: 58211 - DNA, 592 bp, Zea mays
  misc_feature: Ceres CLONE 1511152
  misc_feature: Encodes the peptide sequence at SEQ ID NO. 58212
aatactactatcacagtaggaagctaggaggaaatcaaagcaacaaagttgctggccgagagaagcaaccatgagacctcaggcgtcgttactcgtcacactggctgttatcgtcgtcgtccttgcagctctgccactcagcaaagggacggaggaggaaggaggaggaggggaggcagtcgccgccgtggacgccgccgccggaacgagctcgtggccatgctgcaacaagtgcggtttctgctacctgtctgacccgccgcagtgccaatgcctggacttctcgacggtcgggtgccacccagagtgcaagcagtgcatcaggtacaccgccgacggtggcgtcgacatcccgcccgtgcacgcctaccgctgcgccgacatcctcttcaacttctgcgagcgccgctgcactcccgccgcagttgctgctagcaccaagtagacggatgcatatgcatgccatcgttgccgccgtgtgtgccgcttcagagaagaactaaataaatgttgccgcgcgctgttgatgcgcgtgcatgcctctccttgaataaaccaatatttctataaaaaaaaaaaaaaaaaaaaaaaa

SEQ ID NO: 58212 - protein, 124 aa, Zea mays
  misc_feature: Ceres CLONE 1511152
MRPQASLLVTLAVIVVVLAALPLSKGTEEEGGGGEAVAAVDAAAGTSSWPCCNKCGFCYLSDPPQCQCLDFSTVGCHPECKQCIRYTADGGVDIPPVHAYRCADILFNFCERRCTPAAVAASTK

SEQ ID NO: 58213 - DNA, 664 bp, Zea mays
  misc_feature: Ceres CLONE 1511158
  misc_feature: Encodes the peptide sequence at SEQ ID NO. 58214
ctggagctccccgcggtggcggccgctctagaactagtggatcccccgggctgcaggaattcgtctcacccctagaaaaaagcgtcagacatctccggagcccggacggacgcttttctatcccaagcctatctatttatcggttcgcccgccgcactacgctcccaccgtgtgatagctgctgctcctggcctgctacgacctcacggccacctctgtcctgtcccactagactagctgcagctagcgcctctttccctcgccgccgccccctatccgagagcgacgagcatggcgcactccctcgccgcctccttctcgccggccgccgcgcggcgccaggtgacaaatgtgatttcaagccggagctcggtttccttccagagccacaggatgacttctgtatccatccgttcaagaccaagttctcttcggttcaagatttgctgttcggctaagaaggagacagtcgacaaggtctgtagtatagtgaaggagcagctggctcttcccgatgggactgctatcactggtgaatcaaaattcgccgaacttggtgctgattcactggatacggttgagattgtgatggggctcgaggaaggcgtcaacataaccgtcgacgaaacaagcgcacaggacatcgcgacggtgcaggacgctg

SEQ ID NO: 58214 - protein, 124 aa, Zea mays
  misc_feature: Ceres CLONE 1511158
  misc_feature (61)..(124): Pfam Name: PP-binding Pfam Description: Phosphopantetheine attachment site
MAHSLAASFSPAAARRQVTNVISSRSSVSFQSHRMTSVSIRSRPSSLRFKICCSAKKETVDKVCSIVKEQLALPDGTAITGESKFAELGADSLDTVEIVMGLEEGVNITVDETSAQDIATVQDA

SEQ ID NO: 58215 - DNA, 658 bp, Zea mays
  misc_feature: Ceres CLONE 1511162
  misc_feature: Encodes the peptide sequence at SEQ ID NO. 58216
  misc_feature (545)..(545): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (558)..(558): n is a, c, t, g, unknown, or other
  misc_feature (559)..(559): n is a, c, t, g, unknown, or other
atagctggagctccccgcggtggcggccgctctagaactagtggatcccccgggctgcaggaattcgtctcacccctagaaaagagccaacaggttctggagcaatcttcagcttactgttatcaaacaaaattttggaaaccctcaatgaaatgggtgtacagtatacacagatctgcagctcatccaacagaccaatcatcgggcatcctttgctctttggggctgtcgcttcccgcggggctgatgttggcatccaggtctccaagaccggtgaaacattagacgatttcgacgtgatcctttccatcgaccagctgaacaagatgtgccgagatgtcacccagatcaggttctccgctcgctccgaacagaacgtgcacgtcgagcatgtcgacgggcagtgggtcgccgtccagccggaggtggcaaattcccatcgcctgcatgccgaggttaccagtgtcttagactcttgcgcttctgataagctgtgtgtcatggagattgttgagccataaaaagtttctggcctgggtcctggncnnnnnnnnaatnnaaatgtacaagacattggttttactcttagggaacacacaaaaaaaccggggccctccggggcccccatatcccccctaaaggaggccgtattcacccc

SEQ ID NO: 58216 - protein, 122 aa, Zea mays
  misc_feature: Ceres CLONE 1511162
MGVQYTQICSSSNRPIIGHPLLFGAVASRGADVGIQVSKTGETLDDFDVILSIDQLNKMCRDVTQIRFSARSEQNVHVEHVDGQWVAVQPEVANSHRLHAEVTSVLDSCASDKLCVMEIVEP

SEQ ID NO: 58217 - DNA, 811 bp, Zea mays
  misc_feature: Ceres CLONE 1511166
  misc_feature: Encodes the peptide sequence at SEQ ID NO. 58218
  misc_feature (47)..(47): n is a, c, t, g, unknown, or other
  misc_feature (811)..(811): n is a, c, t, g, unknown, or other
ttcctttctttaggattccttcccctcctaagacccacccacctccncccccacaccgcaactcaccgtggtgggggacgctcttttactagtggatcccccgggctgcaggaattcgtctcacccctagaaaaagaagattttgtaggacaacttgagacaggagatctgaaacttagggtcagagtactggagtcagaacgtgctgcacgtaaagctactgttcttcagatggccaccatgtatacagccttgggtggtactctcttgaatgttggggtcacactgaatagtcaagggaaccagataattgcaaacggctctttcattggtgcaggaatatttttggcattgctggtcagatctatgcaaagagtgaagaagctcgaccaatttgagaccatgatataattatctcacctccgcaagacggggggtccgccggaattacatgcgagctgcgccgtccccttcaaaggctggacagcccttattgcttagtggatattagtcaaatggatatttcctttttcgggaaaacaacccttaaccgtcgcgtgcccccttgcccaaaccttttacacaaacctcatttttatttccttttaagccccagtctaggcggccaatcgtatccaccccgagggagcccggacctcaaaccctttgggaaatttcaaccaccccatttggacccgcttcgccccttacctgcgaatacctttttatatttttacggggctgcgcccggctgggcaaataataaaactcacatcatcatatccccccccgtgtgtttggcgggcccacn

SEQ ID NO: 58218 - protein, 136 aa, Zea mays
  misc_feature: Ceres CLONE 1511166
  misc_feature (16)..(16): Xaa is any aa, unknown, or other
FLSLGFLPLLRPTHLXPHTATHRGGGRSFTSGSPGLQEFVSPLEKEDFVGQLETGDLKLRVRVLESERAARKATVLQMATMYTALGGTLLNVGVTLNSQGNQIIANGSFIGAGIFLALLVRSMQRVKKLDQFETMI

SEQ ID NO: 58219 - DNA, 730 bp, Zea mays
  misc_feature: Ceres CLONE 1511170
  misc_feature: Translation starting site: 173
  misc_feature (337)..(337): n is a, c, t, g, unknown, or other
ggagctccccgcggtggcggccgctctagaactagtggatcccccgggctgcaggaattcgtctcacccctagaaaaacgagactgcgccgccgttgccgtctcctcctccgtcccatcactctctgctcgcgcactctcacctgcccgcgccgtcttcgaccgccaccaagatgaacaaggagaggctcatgaagatggccggcgccgtccgcaccggcggcaagggcaccatgcgccggaagaagaaggctgtacacaagacggtcaccacggacgacaatatgctgcagggcactctcaagagaataggggttaacatcctccctgcaccccangacgtggggttaaccccaggaattatccccccccccagggcggggggggcgcccatttcaacctccccccccaacctaagtccgtgggggcgccattgccacatttcccccaccccacgaggctccccggacgtccctccccttgggagccattcccacatcctcggcgcccttcaacaccgcaacgataacctttcaaacagaacaccccccaagccccttggacacacccgtagtgggctggtctcttagttacgcgcgccccccaccccgcgctcaccggaccataacaacccccacgcttccccccctcactgtgcttcgccccctccgtccacgtcgtcccactcccgcatacaagacccccctctcggagccccaccagccccccgg

SEQ ID NO: 58220 - DNA, 686 bp, Zea mays
  misc_feature: Ceres CLONE 1511171
  misc_feature: Encodes the peptide sequence at SEQ ID NO. 58221
  misc_feature (369)..(369): n is a, c, t, g, unknown, or other
  misc_feature (370)..(370): n is a, c, t, g, unknown, or other
  misc_feature (371)..(371): n is a, c, t, g, unknown, or other
  misc_feature (381)..(381): n is a, c, t, g, unknown, or other
  misc_feature (383)..(383): n is a, c, t, g, unknown, or other
tctgaactagtggatcccccgggctgcaggaattcgtctcacccctagaatccaccatcacacagcaatccacacaagcacttcgacgtcacacgggcgctgcgcacagacacaccaagcgtcggcaccaatggcttactaccaggaggtggactactgctcggaggaggtgaggtcggtggccccggccggcttcggccgccacggcggcggcgtccagcaccacgtcgtcaaggagaagttcgaggaggtcgacacggtctcacgcgccggcgccaaccaccacccccactatggtcaccccggcggccacgggcttcggggtgcgcttttttttcccccccccccgagggcaagaaacgggggggnnnaatttcctcnancttcttttatactttcctccaaaaaaactaactgaccctcccgggcggcccggggttcccgccccttttcgtgctttgccccccgccccttaaagcaccctctggtggcttccctgtacgttccatcggtcatcgttcctttcgctatctttccgcgccccctccccgccgcctcctgtaaccaatttccatccaataaatccctctggcaccgtaataccgccctcacccctcctaagcaacaccccctctttctccggtcccctcctcgcctcccctaatcctctcccggcccgtggtctg

SEQ ID NO: 58221 - protein, 95 aa, Zea mays
  misc_feature: Ceres CLONE 1511171
  misc_feature (80)..(80): Xaa is any aa, unknown, or other
  misc_feature (81)..(81): Xaa is any aa, unknown, or other
  misc_feature (84)..(84): Xaa is any aa, unknown, or other
  misc_feature (85)..(85): Xaa is any aa, unknown, or other
MAYYQEVDYCSEEVRSVAPAGFGRHGGGVQHHVVKEKFEEVDTVSRAGANHHPHYGHPGGHGLRGALFFPPPPRARNGGXXFPXXSFILSSKKTN

SEQ ID NO: 58222 - DNA, 652 bp, Zea mays
  misc_feature: Ceres CLONE 1511177
  misc_feature: Encodes the peptide sequence at SEQ ID NO. 58223
aaagctggagctccccgcggtggcggccgctctagaactagtggatcccccgggctgcaggaattcgtctcacccctagaaaaaatgcctcctcgcccgttccgaatcagctcgaggtagcagctccccccgcaaaaaccctagctttacctccccacaagcgcctccaagatgaagctcgtcaggttcttgatgaagctgaacaacgaaacggtgaccatcgagcttaagaacggcaccgtcgtacacggaaccattaccggtgttgacatcagcatgaatactcatctgaagactgtgaagctgacactaaaagggaaaaatcctgttacccttgatcaccttagtgtgaggggaaacaacatccgctattatatccttcctgacagcctaaacctggagactttgctggttgaggaaacaccaagggtcaagcctaagaagcctacttctgggaagcccttgggccgtgggcgtggccgtggtcgtgggcgcggtcggggtcggggacgttgagcatgctagctgcttttggaaattgcattgcgtgcatctgcagtgtaatctacattcctatcaattgtacgaaatatgccttttgataatgcaaccatgtatccattgtttttttttgccgtggatttatgttgat

SEQ ID NO: 58223 - protein, 114 aa, Zea mays; identical to SEQ ID NO: 37056
  misc_feature: Ceres CLONE 1511177
  misc_feature (5)..(70): Pfam Name: LSM Pfam Description: LSM domain

SEQ ID NO: 58224 - DNA, 673 bp, Zea mays
  misc_feature: Ceres CLONE 1511180
  misc_feature: Encodes the peptide sequence at SEQ ID NO. 58225
aaagctggagctccccgcggtggcggccgctctagaactagtggatcccccgggctgcaggaattcgtctcacccctagaaaaagtcgagaccagaccaccgtatactggagagaaagaatcctccctcgcctccccaccccgccccacccatggcctccgccgccagcactgccgccgccgccggggccccgctgcgcctcctctcatcctcttccaaccgtatctccaagcccttccttccccgcccccaccgcctcaccctctcctcccccatctccttccagcgcctcacagcccggtccgcggcctccccttccccatccaccgccacctcgtccccgtccggctctgtcgacccggcgcaactgccccccgcgctacgcgacatcgtcggcctcttccagtccgtcccggacgcgcgcacccggtacaagcagctcctcgcctatgccgcgcgcctgccgcccatggacccggcgcacaagactgacgcccaccgcgtgcggggttgcgtctcacaggtttgggttcaccgccgagcccgacgagggcgacggcggcggccgcccccagcgtcaggttccacgcccgactccgaagcgcaactcaccaaggggcctccccccccctgctccagggctggggttctctggggcccgcccccgccgaag

SEQ ID NO: 58225 - protein, 174 aa, Zea mays
  misc_feature: Ceres CLONE 1511180
MASAASTAAAAGAPLRLLSSSSNRISKPFLPRPHRLTLSSPISFQRLTARSAASPSPSTATSSPSGSVDPAQLPPALRDIVGLFQSVPDARTRYKQLLAYAARLPPMDPAHKTDAHRVRGCVSQVWVHRRARRGRRRRPPPASGSTPDSEAQLTKGPPPPCSRAGVLWGPPPPK

SEQ ID NO: 58226 - DNA, 632 bp, Zea mays
  misc_feature: Ceres CLONE 1511181
  misc_feature: Encodes the peptide sequence at SEQ ID NO. 58227
aaagctggagctccccgcggtggcggccgctctagaactagtggatcccccgggctgcaggaattcgtctcacccctagaaaaaacccacagtcctacgagcagtctcacgcaagtgtcgacagaccaaacggtccatatgggtcgtgcgcaatctgccgtagcggtcaccgtgtgggccgcggtgctgctgctggtgacggtcgcaactacctcagagggcgccatcacctgcgggcaggtgagctccgccatcgcgccctgcctctcctacgcccgcggcacggagtccggcccctccgcgtcctgctgtagcggcgtcaggaacctcaagagcgccgccagctccgccgacgacaggcgcgccgcctgcaactgcctcaagaacgccgccaggggcgtcagcggcctctacgcctgttacgccgccagcatcccctccaagtgcggcgtcagcatcctctacaccatcagtacctccaccgactgctcctgggtgaactaaaacctataccacacgcgaccacagccgcctgatcgatcgaccaaccattccgccgtcgccgccagccggatcatcggtcgtcgtcgtgatgatatctatcaatctacgcgtgatgatcgatggctact

SEQ ID NO: 58227 - protein, 121 aa, Zea mays
  misc_feature: Ceres CLONE 1511181
  misc_feature (32)..(117): Pfam Name: Tryp_alpha_amyl Pfam Description: Protease inhibitor/seed storage/LTP family
MGRAQSAVAVTVWAAVLLLVTVATTSEGAITCGQVSSAIAPCLSYARGTESGPSASCCSGVRNLKSAASSADDRRAACNCLKNAARGVSGLYACYAASIPSKCGVSILYTISTSTDCSWVN

SEQ ID NO: 58228 - DNA, 663 bp, Zea mays
  misc_feature: Ceres CLONE 1511183
  misc_feature: Encodes the peptide sequence at SEQ ID NO. 58229
tccccgcggtggcggccgctctagaactagtggatcccccgggctgcaggaattcgtctcacccctagaaaaaacacacaggtcttccgagaagcaagcacaagcactgcaccgaatgagcagcgagcgtgttgaggcaggcagtcagtggcagtgggagtaggagacaaggctaccgatatgaagggcctcttgttgctcgtcctcgccctggtcgcgtccgctgcatgcctcgtgaccgtccgcggcgcgtgcgagtgcggggcgacgccgccggacaggatggcgctgaagctggcgccgtgcgcgtccgcggcgcagaaccccagctcggcgccgtccaacggctgctgcacggcggtgcacaccatcgggaagcagagcccccagtgcctctgcgccgtcatgctgtccaagacggccaagaaagtcctggatcaagcccgaggtggcccatcaccatccccaagcgctgcaacctcgtcgaccgccccgtcggctacaagtgcggagattacactctgccatgagctgcacaagagctgctttgacacatgtgcatgatccgtccgaggttacaccaacgtccccatgaaagtgaccgtgacgttgtcattgtatttgtggctttgggaataaacctccgccgccacttgtttgtga

SEQ ID NO: 58229 - protein, 127 aa, Zea mays
  misc_feature: Ceres CLONE 1511183
MKGLLLLVLALVASAACLVTVRGACECGATPPDRMALKLAPCASAAQNPSSAPSNGCCTAVHTIGKQSPQCLCAVMLSKTAKKVLDQARGGPSPSPSAATSSTAPSATSAEITLCHELHKSCFDTCA

SEQ ID NO: 58230 - DNA, 671 bp, Zea mays
  misc_feature: Ceres CLONE 1511184
  misc_feature: Translation starting site: 184
  misc_feature (671)..(671): n is a, c, t, g, unknown, or other
ccccgcggtggcggccgctctagaactagtggatcccccgggctgcaggaattcgtctcacccctagaaaaagcggccacgtcaagtacatccgctgctccaactgcgccaagtgctgccccaaggataaggctatcaagcggttcttggtgaggaacattgttgagcaggctgccgtgagagatgtgcaggaggcctgtgtacatgatggatatgttctacccaaattgtatgcaaaggttcatcactgtgtctcatgtgcaatccatgcgcacattgtccgggtccgctctcgtgagaacaggaggaaccgtgagcccccgcagcgcttcagacgccgggatgatggcccaaggcctggtcagggcccgccgcgcccaggcggtgcagctcctgcagctgcagctgctgctgctcctcgtacctaagttctggaattagtttcggggctttattttgtgaaacattacctgttttgagaaaccattgttaccgtatccccttgaatgtcaacttttttagcacacttttggggttcctaaaaagggttggttcgaattgttgcccccctaaatggtttgaatggtacctataaaaaaaaaaaaaaaaaaaaccaagaaccccccccaagggttacccccaattccccccccctaataagaggggagtcn

SEQ ID NO: 58231 - DNA, 649 bp, Zea mays
  misc_feature: Ceres CLONE 1511187
  misc_feature: Encodes the peptide sequence at SEQ ID NO. 58232
ggagctccccgcggtggcggccgctctagaactagtggatcccccgggctgcaggaattcgtctcacccctagaaaaaatcctccaccacaccacacgcgccgcaaagcagagcacgggggcctgagagcagagcgccatcagccatcctttgcctgcccaagcagcaagcagcagcagcaacggcggctggcccgatggctctgtctctctccggcacctccgcccgcttcgccctcgcgtcgctggtcccccgggccagggcctacgcggcgtcggcggcgtccggggccatgaggcgcgcggcggagggcgcggccgcgggcgaggccaaggaggccgggcgcgccgccgccgccgctgccgagggctcgtgggtgcccgaccccgtcacgggccactaccgccccgccaactgggccgccgccgtcgaccccgccgacctccgcgccgctcacctcgcccgcacctacgcccgggcctgagcggccccggctcccttcaccctgctccgcctcgtctcgtatgacatacgcgcaccgtacgtaccagggtgagacgaagtgaggggtcggggttcgtgtggcgaaacgcgtgttgagccacgcgcgcgtgcgcccgcgctctgtgacgcccggaacgttcttggg

SEQ ID NO: 58232 - protein, 95 aa, Zea mays
  misc_feature: Ceres CLONE 1511187
  misc_feature (1)..(89): Pfam Name: LEA_3 Pfam Description: Late embryogenesis abundant protein
MALSLSGTSARFALASLVPRARAYAASAASGAMRRAAEGAAAGEAKEAGRAAAAAAEGSWVPDPVTGHYRPANWAAAVDPADLRAAHLARTYARA

SEQ ID NO: 58233 - DNA, 664 bp, Zea mays
  misc_feature: Ceres CLONE 1511192
  misc_feature: Encodes the peptide sequence at SEQ ID NO. 58234
aaagctggagctccccgcggtggcggccgctctagaactagtggatcccccgggctgcaggaattcgtctcacccctagaaaaaactcgtcagcccatatcagatcgactgctaagagagtcgtcccagactatcccgccgggtagctaaccttatcttcccatggagccagcgaagctcgcagctttccttgccgtcgctgccgtcgcctacgctgttgccctcgcaccggctgccgcggaatactccggcggcgcgaccgccccagaaagctgccagacgcaaatcatgtacttcaccaactgcctggcccgtgatgagatccgcgggcagtgctgtagcgtggtcgagagccgcgagtgcctctgccagctgaagcgtgaggtggcgctgccctgcagcctgcatcgccaccatcaacgcagatgctccaaggaagggtcgcctccacggtcggtgaagctggccgagctgcagcgcctcccatgcttcaagacactcaagtgctaggagtcgttgcgagttcgtatttttgttttgtgtacgtgtgctcttgtttgtatcacaattgttccttgctactgtttagttccattcggcttgctatggatgtaggtaccctgtgcttgaccgttgaaaactccttgcgtgctcctaaagaaag

SEQ ID NO: 58234 - protein, 115 aa, Zea mays
  misc_feature: Ceres CLONE 1511192
MEPAKLAAFLAVAAVAYAVALAPAAAEYSGGATAPESCQTQIMYFTNCLARDEIRGQCCSVVESRECLCQLKREVALPCSLHRHHQRRCSKEGSPPRSVKLAELQRLPCFKTLKC

SEQ ID NO: 58235 - DNA, 656 bp, Zea mays
  misc_feature: Ceres CLONE 1511193
  misc_feature: SWISSPROT Homolog: EC 2.4.1.12 Cellulose synthase (UDP-forming)
aaagctggagctccccgcggtggcggccgctctagaactagtggatcccccgggctgcaggaattcgtctcacccctagaaaaatttccttggtcaaagtggtggccatgatgtggaaggaaatgagctgcctcgattggtttatgtttcaagagaaaaacggccaggctacaaccatcacaagaaggctggtgctatgaatgcattggtccgagtctctgctgtactaactaatgctccttatttgctgaacttggattgtgatcactatatcaataatagtaaggctataaaggaagcaatgtgttttatgatggatcctttgcttggaaagaaagtttgctatgtgcagtttcctcaaagatttgatgggattgatcgccatgatcgatatgctaacagaaatgttgtctttttcgatatcaacatgaaaggtttggatggtatccagtgccccatttatgtgggtactggatgtgtcttcagaaggcaggcattatatggctactatgctcccaaaacaaagaagccaccatcaagaactagcaactgctggccaaaagtgagcatttgctgttgctgttttggtaacaggaagaccaagaagaaaacaagacctctaaacttaatttgaaaagataaagaactttttaaga

SEQ ID NO: 58236 - DNA, 655 bp, Zea mays
  misc_feature: Ceres CLONE 1511195
  misc_feature: Encodes the peptide sequence at SEQ ID NO. 58237
  misc_feature (614)..(614): n is a, c, t, g, unknown, or other
  misc_feature (655)..(655): n is a, c, t, g, unknown, or other
ctggagctccccgcggtggcggccgctctagaactagtggatcccccgggctgcaggaattcgtctcacccctagaaaaaaaaagaaaaaggaaattttcttgggcgttcttcggcttcgttgtcacaaggttcgagttcgtcaccgtctagtacgactgtgcgagggaggaagaggcgaggagaagatgcagatcttcgtgaagaccctgacggggaagaccatcaccctcgaggtggagagcagcgacaccgtcgacaacgtcaaagccaaaatccaggacaaggaagggattcccccagatcaacagcgactgatattcgctggcaagcagctggaggatggacgcacgctggctgactacaacatccaaaaggagtcaactcttcatttggtcctcaggcttaggggtggaaccatgatcaaggtcaaaactctcactgggaaagagatcgagatcgacattgaacccactgactcgattgacaggatcaaggagcgtgttgaagagaaagaggcattcctcccgtgcagcaaaggctcatctatgctggtaagcagcttgctgatgactagaccgcacatgactactacatcgaggggtgatctgtccntccatcttgtccttgctctggagggtgggtactagtctaan

SEQ ID NO: 58237 - protein, 153 aa, Zea mays
  misc_feature: Ceres CLONE 1511195
  misc_feature (6)..(74): Pfam Name: ubiquitin Pfam Description: Ubiquitin family
  misc_feature (143)..(143): Xaa is any aa, unknown, or other
MQIFVKTLTGKTITLEVESSDTVDNVKAKIQDKEGIPPDQQRLIFAGKQLEDGRTLADYNIQKESTLHLVLRLRGGTMIKVKTLTGKEIEIDIEPTDSIDRIKERVEEKEAFLPCSKGSSMLVSSLLMTRPHMTTTSRGDLSXHLVLALEGGY

SEQ ID NO: 58238 - DNA, 669 bp, Zea mays
  misc_feature: Ceres CLONE 1511196
  misc_feature: Encodes the peptide sequence at SEQ ID NO. 58239
ggcggccgctctagaactagtggatcccccgggctgcaggaattcgtctcacccctagaaaaaaggccacttacctgcagtcaccactcccaagccagtacccacagtcctacgagcagtcgcacgcaagtgtcaagagacaaaacggtcgacatggctcgcacgcaatctgccgtagcggtcgccgtggtggccgcggtgctgctgctggcagcggcggcgacgacctcggaggccgccatcacctgcgggcaggtgagctccgccatcgcgccctgcctctcctacgcccgcggcacggggtccggcccctccgcgtcctgctgtagcggcgtcaggaacctcaagagcgccgccagcaccgccgccgaccggcgcgccgcctgcaactgcctcaagaacgccgccaggggcgtcagcggcctcaacgccggcaacgcccgccgcatccccctccaagtgcggcggcagcatcccctacactatcagcaccttccaccgacctgctccaggggttgaactaaaaccctaaacccactcctcgaccaacggccgccctgaaccgaatcgaacccaaccattccggccgttcctccgcctgggccgggatcaaacccatttggttcgttcatgcaagtaatatttcctctccatttttaccgcccggga

SEQ ID NO: 58239 - protein, 121 aa, Zea mays
  misc_feature: Ceres CLONE 1511196
  misc_feature (32)..(118): Pfam Name: Tryp_alpha_amyl Pfam Description: Protease inhibitor/seed storage/LTP family
MARTQSAVAVAVVAAVLLLAAAATTSEAAITCGQVSSAIAPCLSYARGTGSGPSASCCSGVRNLKSAASTAADRRAACNCLKNAARGVSGLNAGNARRIPLQVRRQHPLHYQHLPPTCSRG

SEQ ID NO: 58240 - DNA, 709 bp, Zea mays
  misc_feature: Ceres CLONE 1511197
  misc_feature: Encodes the peptide sequence at SEQ ID NO. 58241
  misc_feature (219)..(219): n is a, c, t, g, unknown, or other
  misc_feature (220)..(220): n is a, c, t, g, unknown, or other
  misc_feature (221)..(221): n is a, c, t, g, unknown, or other
  misc_feature (224)..(224): n is a, c, t, g, unknown, or other
  misc_feature (227)..(227): n is a, c, t, g, unknown, or other
  misc_feature (228)..(228): n is a, c, t, g, unknown, or other
  misc_feature (506)..(506): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (709)..(709): n is a, c, t, g, unknown, or other
aaagctggagctccccgcggtggcggccgctctagaactagtggatcccccgggctgcaggaattcgtctcacccctagaaaaagtccactgcggctgtgcgcttcgttcagttcagttcatccgtgttcttgtttgcgaggtcgagagagactgagagaggatgtcgtgctgcggaggcaactgcgggtgcggctccggctgcaagtgcggcaacggnnntgncgnngaagggggtggccagccaaagatgtaccccggacatggccgagcaggtgaccaccccaccacccaggctctcatcatgggtggtcccaccatccaaggggcccccccccaggggccggtttcccaaggcccgccccccccggacaccctcaaaaacccgcgcctgtgattttgccaaaattatatttgagttgcgcgaggggggggggggggcccccccgggaaaattgcggggtaaaagggggaacctatagggggtcccctcccccccttttcttntccccccccccccnnnnnnagagcccagtgccaggaacttnnnnnnnnnnnnaaatgagagggttaaacactggatcgccctcttcgccgtccacattcaccacaaaccccagccctacccccaaatctcctttttcccgccccccgggaggcccctaccccccccccgcggctcccgcgcacccgccaatccaccccccccn

SEQ ID NO: 58241 - protein, 77 aa, Zea mays
  misc_feature: Ceres CLONE 1511197
  misc_feature (1)..(75): Pfam Name: Metallothio_2 Pfam Description: Metallothionein
  misc_feature (20)..(20): Xaa is any aa, unknown, or other
  misc_feature (21)..(21): Xaa is any aa, unknown, or other
  misc_feature (22)..(22): Xaa is any aa, unknown, or other
MSCCGGNCGCGSGCKCGNGXXXEGGGQPKMYPGHGRAGDHPTTQALIMGGPTIQGAPPQGPVSQGPPPPDTLKNPRL

SEQ ID NO: 58242 - DNA, 671 bp, Zea mays
  misc_feature: Ceres CLONE 1511199
  misc_feature: Translation starting site: 237
agctccccgcggtggcggccgctctagaactagtggatcccccgggctgcaggaattcgtctcacccctagaaaaaataggggccattagatccaagaagagggaagagcaccaaggaccttcggcgcccgttcaggatccacatcttcccgagcgagttcttggttgacctcttcctcttcggaccacctccaaggctcttggtgtagcttgccactctcaccaatcaagttttcatgtctgatctcgacattcccatcccaactgccttcgatcccttcgctgaggacaatgctggggacactggtgcggaagcatggttcaaggactacctacaccttgcgcatcctgcaacgtaatggtcccgagagcctgacttccctccagggatttgaataaggagttcagtttcatgaagatccctcatagattttcaataaagagttctgctgcattggtacagaggaccagggacctcaaactttgaacgggtcatttcgcctccccgggggactctgaggaaaaagcgtttcggaatttcctctcgcccaggcccaggcatttttgaaacaagggagccacttccccgaattcatggggtttttggaaccaaaccctcccggggttccaaaaaggaaaaacaaaacccttggccagtcctagggccctgg

SEQ ID NO: 58243 - DNA, 691 bp, Zea mays
  misc_feature: Ceres CLONE 1511203
  misc_feature: Encodes the peptide sequence at SEQ ID NO. 58244
acagctggagctccccgcggtggcggccgctctagaactagtggatcccccgggctgcaggaattcgtctcacccctagaaaaaaaccgtcgaattttctgggacgcgaagccaagtatttttcgaaatgcctcgtcccggccactcagcatcatcatgtcaagtggcaccatgggcacagcagaggttgctttggatgttgtgctaagccaactccaataatagcagtagacgagccttccaagcggttgaggatccaggggcgatcagtaaggaaggctagcctctcgcaggacttttggagcacgagtgcccatgagatggagaacagcgggatccaatcgcagaggagcatgtcttctatcagcaccttggctcagtggcggggggcagcatgcctcaggaaattgccccccccccccaatgagtttatgaatcaaggtcttatggtcctggaaccagaccagacaacagtggcgttggaagcaaaaaacgccactcctaaatttcaacagcctctaaaaccaaacctgaacttggaaccaaaccgtataaaagtctggcaagcaagtcaataccccatttccccccacccaatacttctggtccgaaatggtaaatcttccttggggaccctcttggatacaaaaattgcctttatctattaacccctcgggaaattcatttattt

SEQ ID NO: 58244 - protein, 115 aa, Zea mays
  misc_feature: Ceres CLONE 1511203
MENSGIQSQRSMSSISTLAQWRGAACLRKLPPPPNEFMNQGLMVLEPDQTTVALEAKNATPKFQQPLKPNLNLEPNRIKVWQASQYPISPHPILLVRNGKSSLGTLLDTKIAFIY

SEQ ID NO: 58245 - DNA, 735 bp, Zea mays
  misc_feature: Ceres CLONE 1511204
  misc_feature: Encodes the peptide sequence at SEQ ID NO. 58246
  misc_feature (70)..(70): n is a, c, t, g, unknown, or other
  misc_feature (81)..(81): n is a, c, t, g, unknown, or other
aaagctggagctccaccgcggtggcggccgctctagaactagtggatccccctgggctgcaggaattcgntctcacccctnagaaaaaaaaaaaaaaacctttcgctgtccatcgtcacccttccttccttccccagcctctcatcctatgcaagaacccataatccagacccacgaactcgcagcagccattagcgtgcgctagccggccgcagccatggccgcccccgcaacgacctctctactgagcaccctgctgaatctgccgctcgccccgttgtcggggaagagctcgcccccgtccgtggtgcatgtggcccggcgggggccgatggtgggggggtgcccccaagggggacagatgggtatatccccgcccccccaggagggggggggagggggcccatccttccgggggttcccggcgggaaggtaaatggcggcccggccgtacctgccaggaaatccaagcggccgcctcggagctatctaagaacgaagaccggccgtaaaagagagcctcaaggcccccgcgaaggcccccgcccccctcacaccccgcccgtcgggggcgtaggagcgggatgggccgggacgggtgcctccccaatgaagaaccgccccgagctctcggccccaaaaggcgcctcgtagacctaggcaacggaacccccacaccgggcgaacactcggatggggccatttgcctggacgccgggtaaaattccccccggc

SEQ ID NO: 58246 - protein, 72 aa, Zea mays
  misc_feature: Ceres CLONE 1511204
MAAPATTSLLSTLLNLPLAPLSGKSSPPSVVHVARRGPMVGGCPQGGQMGISPPPQEGGGGGPSFRGFPAGR

SEQ ID NO: 58247 - DNA, 651 bp, Zea mays
  misc_feature: Ceres CLONE 1511206
  misc_feature: Encodes the peptide sequence at SEQ ID NO. 58248
  misc_feature (406)..(406): n is a, c, t, g, unknown, or other
  misc_feature (482)..(482): n is a, c, t, g, unknown, or other
  misc_feature (590)..(590): n is a, c, t, g, unknown, or other
  misc_feature (591)..(591): n is a, c, t, g, unknown, or other
  misc_feature (596)..(596): n is a, c, t, g, unknown, or other
ctggagctccccgcggtggcggccgctctagaactagtggatcccccgggctgcaggaattcgtctcacccctagaaaaagcaaacattgaatcgtctcactcgtgtctgccctgctcatactgcttgccctcgccgtatcgtccacccgcaacgcacaggaggattccatggccaacaacaccgggacgttggtgggcggcatccaggacgtgccggggagcgagaacgaccttcacctccaggagctcgcccgcttcgccgtcgatgagcacaacaagaaggccaatgctcttctggggttcgagaagcttgtgaaggccaagacacaagtggttgctggcacgatgtactatctcactattgaagtgaaggatggcgaagtcaagaagctctacgaagctaangtatgggagaagccatgggagaagttcaaggagctgcaggaattcaaacctgttgaagagggtgctagcgcctaangatgtctccttctccatgtgcgagcctgaagctcaaagcaaagttgcagaataaggagccatgctccccttgtgtaatttcataagactaccaccctattagggcttnngttgntgtgtctgtatcgaagggaattgagggtgattaattttccctctattctaatagg

SEQ ID NO: 58248 - protein, 103 aa, Zea mays
  misc_feature: Ceres CLONE 1511206
  misc_feature (10)..(98): Pfam Name: Cystatin Pfam Description: Cystatin domain
  misc_feature (79)..(79): Xaa is any aa, unknown, or other
MANNTGTLVGGIQDVPGSENDLHLQELARFAVDEHNKKANALLGFEKLVKAKTQVVAGTMYYLTIEVKDGEVKKLYEAXVWEKPWEKFKELQEFKPVEEGASA

SEQ ID NO: 58249 - DNA, 644 bp, Zea mays
  misc_feature: Ceres CLONE 1511208
  misc_feature: Encodes the peptide sequence at SEQ ID NO. 58250
  misc_feature (383)..(383): n is a, c, t, g, unknown, or other
  misc_feature (419)..(419): n is a, c, t, g, unknown, or other
  misc_feature (420)..(420): n is a, c, t, g, unknown, or other
aaagctggagctccccgcggtggcggccgctctagaactagtggatcccccgggctgcaggaattcgtctcacccctagaaaaagtggacgcacaccagcacctgccctcctcgccgtcgctgcctccctccgcgcgaccgatctaccctccgccgccaccatgtcgctgatcgccggggaggacttccagcatatcctgcgtttgctgaacaccaacgtggatgggaagcagaagatcatgttcgccatgacctcaatcaagggtgtcgggcgccgcttctccaacatcgtctgcaagaaggccgacatcgacatgaacaagagggccggcgagctgacgcctgatgagctggagcgcctgatgacggtcgtggccaacccntagcagtttcagggtgcccggactggtccctcacanngaagaaagatttacaggaccggcaggttcttcgcaggttcgtcttccaacgcccctttgatattgaacctcaaggggaccacccttgagaaggcttcaagaaggatcagggaacccccccggggggcttggcgtcactacctgggggcctcccgggtccctgggcccgcccacccaaaaataattggcagggctggaaaaacccctttggggtcttccaaaaag

SEQ ID NO: 58250 - protein, 74 aa, Zea mays
  misc_feature: Ceres CLONE 1511208
  misc_feature (14)..(74): Pfam Name: Ribosomal_S13 Pfam Description: Ribosomal protein S13/S18
MSLIAGEDFQHILRLLNTNVDGKQKIMFAMTSIKGVGRRFSNIVCKKADIDMNKRAGELTPDELERLMTVVANP

SEQ ID NO: 58251 - DNA, 652 bp, Zea mays
  misc_feature: Ceres CLONE 1511209
  misc_feature: Translation starting site: 148
  misc_feature (629)..(629): n is a, c, t, g, unknown, or other
aaagctggagctccccgcggtggcggccgctctagaactagtggatcccccgggctgcaggaattcgtctcacccctagaaaaatcggctatctagcacatgcttatggcacggacttgcctcctaagtaaggcccgcctgagagccatggtttccaacgacgacctcttcttggttgtcaacctcctgttcttgacagtggccaacgcctgcggtaacatgatccgacaccggcgcccctggtcgagacatcgccgccgccatttgctgctacgacatccccttcgtccattgataagggaccgctgaagcttctcgatttgggcgtgtgcacctaagtgctcgatctcgccaaacgccatggtatccaggttcctgcagagctatgctgcaccgtcatcgaaggccttgctgacttcgaggacatcgtctgcctctgcactgccatcaagacctgcataaatcgcgaagtcatcgatgttcgcatcaaactcaatctcatcgtacaatacagggacgcgtgcgtgtctctgggcttgttgtgctgctcagcatctttcgatgatgtctctctcctaattgttctcggaccatattccatatgtacgacccctgcattgaaaaaagcntcctgtgagagccgactgaatct

SEQ ID NO: 58252 - DNA, 661 bp, Zea mays
  misc_feature: Ceres CLONE 1511212
  misc_feature: Encodes the peptide sequence at SEQ ID NO. 58253
  misc_feature (272)..(272): n is a, c, t, g, unknown, or other
  misc_feature (393)..(393): n is a, c, t, g, unknown, or other
  misc_feature (529)..(529): n is a, c, t, g, unknown, or other
  misc_feature (530)..(530): n is a, c, t, g, unknown, or other
  misc_feature (547)..(547): n is a, c, t, g, unknown, or other
caccgcggtggcggccgctctagaactagtggatcccccgggctgcaggaattcgtctcacccctagaaaaatgctgatacccaccgcaggtacatctatggtggccatgttgctgactacatgaagaaccttgctgaagaggagccagaaaagtaccagagccacttcagtgcgtacattaagaagggagttgaggctgatgaaatagaagcgctgtacaagaaggtccatgctgccatccgtgccgatccttccattgttaagtcaaccnaagcagccaccaaaggagcataagaggtacaaccccaagaagctgatatatgagcagaggaaggccagcctcattgaaaggctcaaccaactcaactcctccggtggtgctgatgacgacnatgaggacgacgagtaaagttaattgccatcgaagtagtgctatctcaatccagcgatcagcaattgtgtactgtcttatgcggggacctgtagtactggcataggcatttttggtttagttttgcgaggtgacannactgtttctggtagttncgagcttgagctctcaatgtttactctttacatcaaaaaaaaaaaaaaacgagacgctcggagtacccaatccgccctattgtgagtcgtaatacgcgcgttcacgtgcccgtc

SEQ ID NO: 58253 - protein, 57 aa, Zea mays
  misc_feature: Ceres CLONE 1511212
  misc_feature (51)..(51): Xaa is any aa, unknown, or other
MKNLAEEEPEKYQSHFSAYIKKGVEADEIEALYKKVHAAIRADPSIVKSTXAATKGA

SEQ ID NO: 58254 - DNA, 658 bp, Zea mays
  misc_feature: Ceres CLONE 1511214
  misc_feature: Encodes the peptide sequence at SEQ ID NO. 58255
  misc_feature (526)..(526): n is a, c, t, g, unknown, or other
  misc_feature (532)..(532): n is a, c, t, g, unknown, or other
tggagctccccgcggtggcggccgctctagaactagtggatcccccgggctgcaggaattcgtctcacccctagaaaaagtctccgtctccgcccgccacaacaatatcgcattgacagatcgttcatcgtagcctcctccagtcgtctcccgggatcttctccggctataaatttccgccccaattccccaatccagatgcgcaaacatcgaatcgtctcactcgtgtctgccctgctcatactgcttgccctcgccgtatcgtccacccgcaacgcacaggaggattccatggccaacaacaccgggacgttggtgggcggcatccaggacgtgccggggagcgagaacgaccttcacctccaggagctcgcccgcttcgccgtcgatgagcacaacaagaaggccaatgctcttctggggttcgagaagcttgtgaaggccaagacacaagtggttgctggcacgatgtactatctcactattgaagtgaaggatgggcgaatccagaagctctacgaagctnaggtangggagaagccatggggagaagttcaaggagctgcaggaattctaaccctggttgaggagggtgctaaccgctaaagatgtctccttctccctggtgcgaacctgaagctcaaaagcaaattgcaga

SEQ ID NO: 58255 - protein, 135 aa, Zea mays
  misc_feature: Ceres CLONE 1511214
  misc_feature (41)..(128): Pfam Name: Cystatin Pfam Description: Cystatin domain
  misc_feature (110)..(110): Xaa is any aa, unknown, or other
  misc_feature (112)..(112): Xaa is any aa, unknown, or other
MRKHRIVSLVSALLILLALAVSSTRNAQEDSMANNTGTLVGGIQDVPGSENDLHLQELARFAVDEHNKKANALLGFEKLVKAKTQVVAGTMYYLTIEVKDGRIQKLYEAXVXEKPWGEVQGAAGILTLVEEGANR

SEQ ID NO: 58256 - DNA, 579 bp, Zea mays
  misc_feature: Ceres CLONE 1511215
  misc_feature (178)..(178): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
acccgcggtggcggccgctctataactagtggatcccccgggctgcaggaattcgtctcacccctagaaaaaagtattctgctcaagcacaccgccacaaaaagaaaaagaaaaggcaaaggcaaaggaatcccaatcaggcaagcaaaaaggaagaaccaggtgctgcggccggaanaatgtcgtcgcaaccttgatcggagggagtcaaccgggtttccgggggggcggaaggggccccttttggccccaaaatttggggaaaaccaaattccccggagttttttgtggaaactgggccctccccaaaaggttttcccccccccttggccaattttctcaaaaaaagggggggttttaaacacccggggaaaaaaaggggggtttttttttgggggtgtttttggaggaaccccccccctccctcttnnnnaaacaaccccccccttttggggggccccctctccaaaaacccccgcggggtgaaaaaaaagagggggggggggggcgggcgtttttttgggaaaaggggggggggggaaaaaaaaaccctccccccccccgggggagaaaagaaag

SEQ ID NO: 58257 - DNA, 722 bp, Zea mays
  misc_feature: Ceres CLONE 1511217
  misc_feature: Encodes the peptide sequence at SEQ ID NO. 58258
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (21)..(21): n is a, c, t, g, unknown, or other
tttttttnnnaannnnccccnaatttattccctcgtattacaggtatagattgtcaaagctggggctccccgcgggggcggccgctcttttctaatggatcccccgggcatgaagagttcgtctcacccctagaaaagcctctctccttcccgagcaggaggcggacaaggtaagcagcaatcgcaggaaccctagcgccgccgcacccgcaggaatgggtatcgacctcgtcgccggtgggaggaataagaagaccaagcgcactgcgcccaagtctgacgatgtctacctcaagctcctcgtcaagctctaccgtttcttggtcaggaggaccaagagcaatttcaacgctgtcattctcaagaggcttttcatgagtaaaaccaaccgaccaccaatctccatgcgccgccttgtcaagtttatggaaggaaaggagaagaacattgctgtcattgttggcacagtcacagatgacaaaaggatccaggaggttccagcaatgaaggttactgccctgaggttcacggagacagcaagggccaggattgtcaatgctggttggcgagtgcctcacatttgaccagcttgctcttcgtgctcaactttggcgagaacacggttcttcttgaggggctctaaagaatggccggtgaaggcagtggaggcatcttgggcaaaggcttcttgtgagtggcggcacaggcaaccactgagggcg

SEQ ID NO: 58258 - protein, 122 aa, Zea mays
  misc_feature: Ceres CLONE 1511217
  misc_feature (12)..(121): Pfam Name: Ribosomal_L18e Pfam Description: Eukaryotic ribosomal protein L18
MGIDLVAGGRNKKTKRTAPKSDDVYLKLLVKLYRFLVRRTKSNFNAVILKRLFMSKTNRPPISMRRLVKFMEGKEKNIAVIVGTVTDDKRIQEVPAMKVTALRFTETARARIVNAGWRVPHI

SEQ ID NO: 58259 - DNA, 662 bp, Zea mays
  misc_feature: Ceres CLONE 1511218
  misc_feature: Encodes the peptide sequence at SEQ ID NO. 58260
  misc_feature (581)..(581): n is a, c, t, g, unknown, or other
ggagctccccgcggtggcggccgctctagaactagtggatcccccgggctgcaggaattcgtctcacccctagaaaaatcatacactctcatcactggctaagaacagggcttcttttctctggaacggaaaacagggtggcttaagtgctgattcgtcatcatcgagcacatgctgcgttttgtccttgatgctcagcaggctgaacctggacgcaaatggtgctgcgaaaccgccaaaggacaaaaacatttaaatcactgctgtgactcagcttaggtccacaatattggattctgatgcggataatgactgtttgcatcattatggagacagatggtggagaccgttggacgatgcctgctcgtgatgcgctttccctggatgtgatttgattaattataatcaagtacgtgaagaatcgaggtgcataggactgtcgtccagcgataggatatttgtgaacttgtcgtttgtgttcttatttcgacttaccaataagctgcttcgtgaagtgtcatccgcttcgcagtctgtcgactgttacttatacgactctatatcttgcataaagacggcantcgtacgagtgcatatgtctcgtacaccgaaatgattaccttagaggctcgaggtactcatttctcttatagtgagacaaa

SEQ ID NO: 58260 - protein, 35 aa, Zea mays
  misc_feature: Ceres CLONE 1511218
MLRFVLDAQQAEPGRKWCCETAKGQKHLNHCCDSA

SEQ ID NO: 58261 - DNA, 660 bp, Zea mays
  misc_feature: Ceres CLONE 1511220
  misc_feature (515)..(515): n is a, c, t, g, unknown, or other
ggagctccccgcggtggcggccgctctagaactagtggatcccccgggctgcaggaattcgtctcacccctagaaaaaaaacatcgaatcgtcgcactcgtgtctgccctgctcatactgcttgccctcgccgtatcgtccacccgcaacgcacaggaggattccatggccaacaacaccgggcacgttggagggcggcatccaagacgtgccggggagcgagaacgaccttcacctccaggagctcgcccgcttcgccgtcgatgagcacaacaagaacgccaatgctcttctggggttctagaagcttgtgaaggccaagccacaagtggttgctggcacgatgtactatctcactattgaactgaaggatggcgaagacaacaagctctactaagctaatgtctgggagaagccatgggagaacctcaaggggctgcaggaattcaagcctgttgaagagggtgctagcgcctaaggatgtctccttctccatgtgcgagcctgaaactcanagcgaagttgcagaataaagaggcatgctcgcttgtgtaatttcataagactacaaccctattacggcttagtttgattgtgtctgtatcaaatggaattgaaggtgattgacttctcttcgatctaaaagagaggttgtaatct

SEQ ID NO: 58262 - DNA, 662 bp, Zea mays
  misc_feature: Ceres CLONE 1511221
  misc_feature: Encodes the peptide sequence at SEQ ID NO. 58263
tggagctccccgcggtggcggccgctctagaactagtggatcccccgggctgcaggaattcgtctcacccctagaaaaaagcccagatagatctttcccccgtcctccctcgccttcgcctcgccggcaggagatttccaccaccaccgccggaccaccccgaccctccttccctctcgcgctatggcccagactgttgtgctcaaggttggcatgtcctgtgagggctgtgttggagctgtcaagcgggtcctgcgcaagatggaaggcgtcgagtcctacgacgtagacatcatggaacagaaagtcaccgtgaagggcaatgtgacacctgacgccgtcctgcaaactgtttccaagactggcaagaagacttcgttctgggaggctgaggccatgacaagtgaatccgccacacctgccggcgccaccgcctgacaggttcgatgatctggaagtgcccagcaaaaaaatgtgaatgtatttagcttggatctgttacaaataattgcaaactgctagctcggtctgtacattttacagttgctatttgtatactgtgatgttctcgtatgtttgtggaagcgataaaccaatatctgtatgatatatgtgtcgtgttcctaaacaaaaaaaaaaacgagacgctcgaggtacccatt

SEQ ID NO: 58263 - protein, 84 aa, Zea mays
  misc_feature: Ceres CLONE 1511221
  misc_feature (5)..(66): Pfam Name: HMA Pfam Description: Heavy-metal-associated domain
  misc_feature: SWISSPROT Homolog: EC 3.6.3.4 Copper-exporting ATPase
MAQTVVLKVGMSCEGCVGAVKRVLRKMEGVESYDVDIMEQKVTVKGNVTPDAVLQTVSKTGKKTSFWEAEAMTSESATPAGATA

SEQ ID NO: 58264 - DNA, 646 bp, Zea mays
  misc_feature: Ceres CLONE 1511223
  misc_feature: Encodes the peptide sequence at SEQ ID NO. 58265
tccccgcggtggcggccgctctagaactagtggatcccccgggctgcaggaattcgtctcacccctagaaaaactctccccgcgtgctctccctctctctcgcgcgcgcggcgacgactcggctagtcggctaccgccgccgcccctacgccagcttcccagctcttcgtcaggcccttctccgtcaacgagcacccagcacagatcctgagcctccacacctcaacgatggcgggattcagcagccttgcacccaagaccaggaacctggtggtggctgggggcctgtcggccttcgtgctcggggtctactactacaccatgagagccgtgggaggcacggacgagctgcaggtggcgatcgacaagtttgaggagatgaagaagaaggacgctgccagaaactccagcacaggaggatcataaacacggcgcccttcccgtctctgtactgaactgaacctggatctgcaggctgacatgatacggtagtcaagtcgcccagtagaccaagaacatgcgtgcctctactgtgcaataagtaatgtgtggtactctttatcagatagagcttggcagcttgtgttttaaggagagatgtacactttgagtgtttttgtcctatataatagtggtcgcaatgtct

SEQ ID NO: 58265 - protein, 65 aa, Zea mays
  misc_feature: Ceres CLONE 1511223
MAGFSSLAPKTRNLVVAGGLSAFVLGVYYYTMRAVGGTDELQVAIDKFEEMKKKDAARNSSTGGS

SEQ ID NO: 58266 - DNA, 653 bp, Zea mays
  misc_feature: Ceres CLONE 1511224
  misc_feature: Encodes the peptide sequence at SEQ ID NO. 58267
  misc_feature (653)..(653): n is a, c, t, g, unknown, or other
ccccgcggtggcggccgctctagaatagtggatcccccgggctgcaggaattcgtctcacccctagaaaaaaaccggcccaaccccgtctcagattccacggcgccggcacccctcgcctaggcatccgaccgccgcagcgtccccgccacgaccacgagcgaaaggaggtcgccggaagagggggcgcggagatgagcgggagcgcgttcaacgcgttcaagtcgcgggtgccggtggcgtggagtccccggctgtacatcacgctggtgcggggcctccccgggacgcggcgcctccaccgccgcacgctcgaggccatgcgcctccgccgctgccaccgcaccgtcgagcaccgcaccacgccgtcgctcctcgggatgctcacccaggtgaagcgcctcgtcgccgtcgagaccgaggagatgtacaacgcgcggaagcaggccgaggcggagaggcgcgcgcccagacccccgctcgtcgtctcccaccagccacagccgccggctccgaagccggcagccgccgcccgcagtgggtgccgctaccactgcgcagtagcctctgggcatcagaagcctttcatcacagttcagcggcataataactgacttggcttgtgtttggggtctgctagtttccagacgaccn

SEQ ID NO: 58267 - protein, 139 aa, Zea mays
  misc_feature: Ceres CLONE 1511224
  misc_feature (20)..(71): Pfam Name: Ribosomal_L30 Pfam Description: Ribosomal protein L30p/L7e
MSGSAFNAFKSRVPVAWSPRLYITLVRGLPGTRRLHRRTLEAMRLRRCHRTVEHRTTPSLLGMLTQVKRLVAVETEEMYNARKQAEAERRAPRPPLVVSHQPQPPAPKPAAAARSGCRYHCAVASGHQKPFITVQRHNN

SEQ ID NO: 58268 - DNA, 684 bp, Zea mays
  misc_feature: Ceres CLONE 1511225
  misc_feature: Encodes the peptide sequence at SEQ ID NO. 58269
tggagctccccgcggtggcggccgctctagaactagtggatcccccgggctgcaggaattcgtctcacccctagaaaaaatcacttatcatccccatccgcacctctctccatctccctgctcctccgcctccttcttgatccagccaagccagggatcgccatgtcggactcggaggagcaccacttcgaatcgaaggccgacgccggagcgtccaagacctacccgcagcaggctggcaccgtccgtaagaacggcttcatcgtcatcaagaaccgcccctgcaaggttgtggaggtttctacctcaaagactggtaagcatggccatgccaaatgccactttgttgccatagacatattcaacggcaaaaagcttgaagatattgttccttcatcacacaactgtgatattccgcatgtgaaccgtactgagtaccagctgattgatatttcaaaggatggattggtgagccttccttacttcaaatgggaacccctaaggatgatcttaaactccccactgatgaaactcttgggggcccaaatcaaggaaaggttttgaaagcggccagggatctttgtgtgaccggtcacttccgctatgggggagggaccaaatttccccgctgaaagaaggttggcccccaataaaattaccgggcctgggaaaaagggaacccaa

SEQ ID NO: 58269 - protein, 133 aa, Zea mays
  misc_feature: Ceres CLONE 1511225
  misc_feature (30)..(64): Pfam Name: KOW Pfam Description: KOW motif
MSDSEEHHFESKADAGASKTYPQQAGTVRKNGFIVIKNRPCKVVEVSTSKTGKHGHAKCHFVAIDIFNGKKLEDIVPSSHNCDIPHVNRTEYQLIDISKDGLVSLPYFKWEPLRMILNSPLMKLLGAQIKERF

SEQ ID NO: 58270 - DNA, 659 bp, Zea mays
  misc_feature: Ceres CLONE 1511228
  misc_feature: Encodes the peptide sequence at SEQ ID NO. 58271
tcaccgcggtggcggccgctctagaactagtggatcccccgggctgcaggaattcgtctcacccctagaaaaaggtgctgctgctgtgggcggccggactgcgtcacggcacgacaactgcagccaggcattcttgccgccgccaccaccgtgaccggggtctgcgtcgccgttaccgttctgcccggcgtgaccgcctggagagtcatcggagcgattaccttgatcgccttcgccgtggtcggagctcagattcccgcacgagccggcgttcttgccgtccttggcgtgaccctcctgcttgccagcggcagtgccgtgactgctgacgatgctctctgtgcacgctactgatgggttgtcttcgaactgactctgtctattgctgaggctggcatagacttcatgatatgagaccgaccccagactttcaattcaagccgagatcaacatttacttatttgtttgaaaggaatctacgccacagagattcttccgtaggagcacttcttgcgattcgttcagttctaatgcgtagccatcaacgtgcgctaccttcatcgctagcagagcgaacggatatcttcatgaacaacggtgggcttcattaaatgcaatcgaggctgcgtgtcattccatgcatctcgatctgaatgtac

SEQ ID NO: 58271 - protein, 50 aa, Zea mays
  misc_feature: Ceres CLONE 1511228
HRGGGRSRTSGSPGLQEFVSPLEKGAAAVGGRTASRHDNCSQAFLPPPPP

SEQ ID NO: 58272 - DNA, 643 bp, Zea mays
  misc_feature: Ceres CLONE 1511229
  misc_feature: Encodes the peptide sequence at SEQ ID NO. 58273
  misc_feature (413)..(413): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (479)..(479): n is a, c, t, g, unknown, or other
  misc_feature (618)..(618): n is a, c, t, g, unknown, or other
ccgctctagaactagtggatcccccgggctgcaggaattcgtctcacccctagaaaaagactgccgaggccctcaccggcggcgaagagcgcccgccagcaatggcagcaaggtgtagtagcctttcctcgccatccttgtcggtccatggacccctccgccgcaataaacccagcaagagactcgctccatgcctgccatcgtcgccaagaccaggagccgctgctctgagagcgcgtgctgcgaaacttcctccaggggttgaagcgcccagggtgcaaccgaagctgagcgagcccttcttggggttcacccagaccgcggagatttggaactccagggcctgcatgatcggcctcatcggcaccttcattgtggagctggtgctgaacaaggggattcttcagatgatngnnngtggaggtggggcaagggtctggaccttcctctttgaagggtgaccaaacagtaacattatncgtttgctggtgtattatgctggccgaaaaacatgaggggtttcacttgctttttgacttggtggctacatatgcatgttcatcatgcatgtctttggaatatccggatgtacaacacccactgtgttaatgacctggntggctggccgccttgacaaggttaa

SEQ ID NO: 58273 - protein, 119 aa, Zea mays
  misc_feature: Ceres CLONE 1511229
  misc_feature: SWISSPROT Homolog: EC 4.99.1.1 Ferrochelatase
  misc_feature (104)..(104): Xaa is any aa, unknown, or other
  misc_feature (105)..(105): Xaa is any aa, unknown, or other
  misc_feature (106)..(106): Xaa is any aa, unknown, or other
MAARCSSLSSPSLSVHGPLRRNKPSKRLAPCLPSSPRPGAAALRARAAKLPPGVEAPRVQPKLSEPFLGFTQTAEIWNSRACMIGLIGTFIVELVLNKGILQMXXXGGGARVWTFLFEG

SEQ ID NO: 58274 - DNA, 621 bp, Zea mays
  misc_feature: Ceres CLONE 1511234
tggagctccccgcggtggcggccgctctagaactagtggatcccccgggctgcaggaattcgtctcacccctagaaaaaatccactctcagcatcaccagctaagaacaggtcttcgtctcaataatggaaggcaaaacagggcagctcaggtgccgtttacgtcgccatcgtgctcgtcctgggtcttgtccttgagcagtcccagcaagctgaagctagaggcaaatggtgctgcgaaacctgccacctggaaaaaataccaatttttttaatttccgcttgccggtttgaacttccggggtttgggggttccaacaaaaatttggggtcctgtgccaaaaaaatggccggttggcattatttttgaaagaaaccaattgggaaggttttttggcccaagggccctgggccgggggagggcctttttttctcggaagaaggtcccctttttggaataaaaaaaatttagaaaacccccccttgtctccctctgggggaaagtttataaaaaaaaacacaaaagggggcgccaaaaaaaaaaaaaaaaagggttcttcccctcccaaaaaaaaaaaaaaggggggtggcaaaaaatatatttgggggggaggaacaaaat

SEQ ID NO: 58275 - DNA, 684 bp, Zea mays
  misc_feature: Ceres CLONE 1511236
  misc_feature: Encodes the peptide sequence at SEQ ID NO. 58276
  misc_feature (471)..(471): n is a, c, t, g, unknown, or other
  misc_feature (521)..(521): n is a, c, t, g, unknown, or other
  misc_feature (638)..(638): n is a, c, t, g, unknown, or other
ggagctccccgcggtggcggccgctctagaactagtggatcccccgggctgcaggaattcgtctcacccctagaaaaagcgcaaacatcgaatcgtctcactcgtgtctgccctgctcatactgcttgccctcgccgtatcgtccacccgcaacgcacaggaggattccatggccaacaacaccgggacgttggtgggcggcatccaggacgtgccggggagcgagaacgaccttcacctccaggagctcgcccgcttcgccgtcgatgagcacaacaagaaggccaatgctcttctggggttcgagaagcttgtgaaggccaagacacaagtggttgctggcacgatgtactatctcactattgaagtgaaggatggcgaagtcaagaagctctacgaagctaaggtctgggagaagccatgggagaacctcaaggggctgcaggaattcaagcctggttgaagagggtngctagcgcctaaggatgtctcctttctccatgtgcgagcctgaagctcanagcaaagttgcagaataaggagccatggctccctttgtgtaatttcataagactacaaccctattaaggctttggtttgggttgtgtcctgtatccgaagggattggaaaggggttnaattttccttctatctaaaaaaaaagggggtttttaatcctcctcc

SEQ ID NO: 58276 - protein, 97 aa, Zea mays
  misc_feature: Ceres CLONE 1511236
  misc_feature (10)..(98): Pfam Name: Cystatin Pfam Description: Cystatin domain
MANNTGTLVGGIQDVPGSENDLHLQELARFAVDEHNKKANALLGFEKLVKAKTQVVAGTMYYLTIEVKDGEVKKLYEAKVWEKPWENLKGLQEFKPG

SEQ ID NO: 58277 - DNA, 658 bp, Zea mays
  misc_feature: Ceres CLONE 1511241
  misc_feature: Encodes the peptide sequence at SEQ ID NO. 58278
tccccgcggtggcggccgctctataactagtggatcccccgggctgcaggaattcgtctcacccctagaaaagtgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggatgaggcgatgcgcaacgccgtcgagggcatgaacggcaaggagctggacggccgcaacatcaccgtcaacgaggcccagtcccccgggcggccgtggaaagcggcggcggtgagtaccggtggtggcccgtgaaggcgccgcctacggcgggggccggccgcccctgatgtgcggcgccgggttcgggcggtgggcggcggcaacctacgggtggaggcggcgggctacgggggggggggtgcgggcggcctacgggtgttgggccacggtggcgggcgcgctacggggtacctcccaaccggaaactggg

SEQ ID NO: 58278 - protein, 102 aa, Zea mays
  misc_feature: Ceres CLONE 1511241
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAASDVEYRCFVGGLAWATDDHSLHNAFSTYGEVLESKIILDRETQRSRGFGFVTFSTDEAMRNAVEGMNGKELDGRNITVNEAQSPGRPWKAAAVSTGGGP

SEQ ID NO: 58279 - DNA, 643 bp, Zea mays
  misc_feature: Ceres CLONE 1511243
  misc_feature: Encodes the peptide sequence at SEQ ID NO. 58280
  misc_feature (515)..(515): n is a, c, t, g, unknown, or other
  misc_feature (599)..(599): n is a, c, t, g, unknown, or other
  misc_feature (608)..(608): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (642)..(642): n is a, c, t, g, unknown, or other
  misc_feature (643)..(643): n is a, c, t, g, unknown, or other
tccccgcggtggcggccgctctagaactagtggatcccccgggctgcaggaattcgtctcacccctagaaaaatccaccatcacacagcaatccacacaagcacttcgacgtcacacgggcgctgcgcacagacacaccaagcgtcggcaccaatggcttactaccaggaggtggactactgctcggaggaggtgaggtcggtggccccggccggcttcagccgccacggcggcggcgtccatcatcacgtcgtcgaggagaagttcgaggaggtcgacacggtctcacgcgccggcgccaaccaccaccaccaccatggtcaccacggcggccacggcttcgtggtgcgcgagaccagagtcgaagaagacatcaacacctgcaccggctagttccacgagcgcatggagagcttcctcgccagggctaactgagccgcccggcggccggcatctacgcccgttcgtgcttgcctgcgtgccatatgtatgtctgtggtcgactggttgtgcanggtcatcgtacttggctatcgtacgtgcacgcactcagctcctgtacgaattacgacaataagctcgtgaccctgataaacttncttcgtatnctnnnnnnnnannnnnnnnnnnnnnnnnnnngann

SEQ ID NO: 58280 - protein, 79 aa, Zea mays
  misc_feature: Ceres CLONE 1511243
MAYYQEVDYCSEEVRSVAPAGFSRHGGGVHHHVVEEKFEEVDTVSRAGANHHHHHGHHGGHGFVVRETRVEEDINTCTG

SEQ ID NO: 58281 - DNA, 675 bp, Zea mays
  misc_feature: Ceres CLONE 1511244
  misc_feature: Encodes the peptide sequence at SEQ ID NO. 58282
ggagctccccgcggtggcggccgctctagaactagtggatcccccgggctgcaggaattcgtctcacccctagaaaaagtccctcatccggtcatcccctttccgcgatcccaaccgagctagggttttaggtggggctcacaggtggaggcactcaccttccgctcccgtgggatctccccagatgctatggtacgtttcggacgacctcacaaggcgatgatgatggacatgtctgcctcgctaatcatcgtgagctgctacaactggatctctaccgctcccgggagctcgttctcttcctgggaatcttcctgcctgaccaatggctcccagactcttctctatatgaccgtgacgattgccgcacgctttatctatgaagagtcggcgtcaactccaatatctggaccctactcagacaccctgatatgtttatccctttgatttgagctgccttcggcagttcgaaagattcaggacagttaagtgcactgtccatattgcatgctctgcctcgctgatgcacgagtagtattgtgattttggtactgatgagcatgcgatatgtacgctttctgtcctgatgttaacgacgtttcccccgtgtgccgtaaagaagtctaaatgcactgctcttggtccccctccaccgtaaatggatgggatcacgcc

SEQ ID NO: 58282 - protein, 75 aa, Zea mays
  misc_feature: Ceres CLONE 1511244
MMMDMSASLIIVSCYNWISTAPGSSFSSWESSCLTNGSQTLLYMTVTIAARFIYEESASTPISGPYSDTLICLSL

SEQ ID NO: 58283 - DNA, 648 bp, Zea mays
  misc_feature: Ceres CLONE 1511245
  misc_feature: Encodes the peptide sequence at SEQ ID NO. 58284
tggcggccgctctagaactagtggatcccccgggctgcaggaattcgtctcacccctagaaaaatctcacggctagctagcacaagcatagtgcaggggcttgccacctaagtaaggcccgcctgagagccatggcatccaaggccgtcctcttcttggctctcaacctcctgttcttcacggtggccaacgcctgcggcaactgcccgaccccaacgcccccggtcgagccaccgccgccgcctcctgctgctaccccacccccttcgtccagcggcaagtgcccgctgaacgcgctcaagttcggcgtgtgcgccgatgtgctcggcctcatcaaaggcgaggctggcaaggtgcctgccgagccatgctgtaccctcatcagaggccttgcggacttcgaggccgccgtctgcctctgcacggccatcatggccaacgtgctcggcgtcgtcatcaatgtccccatcaagctcaacgccctcgtcaactactgtggacaagtgcgtgcccaagggctacttgtgcgcgtaaacagcataccggcggtcacacgctcgtaaactgttcacgtacgaaaattacatatgcacggcaccctgctgggccacgaatgcgagcatttggtgtctgctgaatatatctcct

SEQ ID NO: 58284 - protein, 143 aa, Zea mays
  misc_feature: Ceres CLONE 1511245
  misc_feature (51)..(128): Pfam Name: Tryp_alpha_amyl Pfam Description: Protease inhibitor/seed storage/LTP family
MASKAVLFLALNLLFFTVANACGNCPTPTPPVEPPPPPPAATPPPSSSGKCPLNALKFGVCADVLGLIKGEAGKVPAEPCCTLIRGLADFEAAVCLCTAIMANVLGVVINVPIKLNALVNYCGQVRAQGLLVRVNSIPAVTRS

SEQ ID NO: 58285 - DNA, 650 bp, Zea mays
  misc_feature: Ceres CLONE 1511246
  misc_feature: Encodes the peptide sequence at SEQ ID NO. 58286
  misc_feature (406)..(406): n is a, c, t, g, unknown, or other
  misc_feature (453)..(453): n is a, c, t, g, unknown, or other
  misc_feature (454)..(454): n is a, c, t, g, unknown, or other
  misc_feature (470)..(470): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (503)..(503): n is a, c, t, g, unknown, or other
  misc_feature (537)..(537): n is a, c, t, g, unknown, or other
  misc_feature (550)..(550): n is a, c, t, g, unknown, or other
  misc_feature (553)..(553): n is a, c, t, g, unknown, or other
  misc_feature (554)..(554): n is a, c, t, g, unknown, or other
  misc_feature (576)..(576): n is a, c, t, g, unknown, or other
  misc_feature (582)..(582): n is a, c, t, g, unknown, or other
  misc_feature (602)..(602): n is a, c, t, g, unknown, or other
ggagggcgctctattcctcatggatcccccgggctgcaggaattcctctcacccctagaaaaaactttgggaagccagccatgacagcggcagacagcacaaacccatggtggacgttgcttgaagaagctgtgaagagcgctgacggcaaactcggcaagccggagatattcccagcctctactgacgctcgctacttccggaaaatcggattaccagcatttggcttttcacctatggcgaacaccccgatactgctccatgaccataacgagtttctgagcaaagacgagtacctcaagggaatcgggatatacgagtccatcatcagggcacttttttctcccccccccggggggggggggggggggaattcccccggcccaacctttcgaacccggggggngggggggaaaccgtgggaccttgactcccgtttgggcggggaaccanngggggcaacggaaagncaaggtttgggagcttggccnnnnggcctgggntttcttgttgggggccccgggggcgcgggggggnccgggagaggggntcnnttcttgcgtattctccccccanaggggngaacaggccctcctacaccngcgggcggggggttgacataccgcgcactttccccgccgccgcgccag

SEQ ID NO: 58286 - protein, 216 aa, Zea mays
  misc_feature: Ceres CLONE 1511246
  misc_feature: SWISSPROT Homolog: EC 3.5.1.14 Aminoacylase
  misc_feature (135)..(135): Xaa is any aa, unknown, or other
  misc_feature (151)..(151): Xaa is any aa, unknown, or other
  misc_feature (156)..(156): Xaa is any aa, unknown, or other
  misc_feature (164)..(164): Xaa is any aa, unknown, or other
  misc_feature (179)..(179): Xaa is any aa, unknown, or other
  misc_feature (183)..(183): Xaa is any aa, unknown, or other
  misc_feature (184)..(184): Xaa is any aa, unknown, or other
  misc_feature (192)..(192): Xaa is any aa, unknown, or other
  misc_feature (194)..(194): Xaa is any aa, unknown, or other
RALYSSWIPRAAGIPLTPRKNFGKPAMTAADSTNPWWTLLEEAVKSADGKLGKPEIFPASTDARYFRKIGLPAFGFSPMANTPILLHDHNEFLSKDEYLKGIGIYESIIRALFSPPPGGGGGGNSPGPTFRTRGXGGKPWDLDSRLGGEPXGATEXQGLGAWPXGLGFLVGGPGGAGGXGRGXXFLRILPPXGXTGPPTPAGGGLTYRALSPPPRQ

SEQ ID NO: 58287 - DNA, 609 bp, Zea mays
  misc_feature: Ceres CLONE 1511252
  misc_feature: Encodes the peptide sequence at SEQ ID NO. 58288
  misc_feature (226)..(226): n is a, c, t, g, unknown, or other
  misc_feature (271)..(271): n is a, c, t, g, unknown, or other
  misc_feature (284)..(284): n is a, c, t, g, unknown, or other
  misc_feature (287)..(287): n is a, c, t, g, unknown, or other
  misc_feature (289)..(289): n is a, c, t, g, unknown, or other
  misc_feature (304)..(304): n is a, c, t, g, unknown, or other
  misc_feature (330)..(330): n is a, c, t, g, unknown, or other
  misc_feature (371)..(371): n is a, c, t, g, unknown, or other
  misc_feature (373)..(373): n is a, c, t, g, unknown, or other
acccgcggtggcggccgctctagaactagtggatcccccgggctgcaggaattcgtctcacccctagaaaaatccccactcctgcagtccttctccacctagctcccccgcgccaagaacacgccagctagcaagcgcgctcgatcgaataccgttaccgtgtcgccatggccgccaccgcgtctctatcagccgtcggggcgccgctgtcggtgcccgggctcangaaagcgctcggcgtgtcgtcgcttcggccccctgcagcgaaggncgcgaagatgacnacnangccgtgcgggcgtcngcgtccccttcggtcaccgtcatcanggaaaaagcttgcggcgggctgaacccggggggccctggcngncgcgcttgtgcttcccgaattctcggaagccccgcaatcccgcgggggtcaccccctccctctaaaacttcctctcaacatcttgtccggggggggcccgctcctttggaatggttgggggccctcttttccgccttccaatttttaaccccgaaaaaggggccggaaccggaaaccccccattccatatcctcccccgtggtccgggcccggggcccggggtgtctgtttcaaca

SEQ ID NO: 58288 - protein, 61 aa, Zea mays
  misc_feature: Ceres CLONE 1511252
  misc_feature (20)..(20): Xaa is any aa, unknown, or other
  misc_feature (35)..(35): Xaa is any aa, unknown, or other
  misc_feature (41)..(41): Xaa is any aa, unknown, or other
  misc_feature (46)..(46): Xaa is any aa, unknown, or other
  misc_feature (55)..(55): Xaa is any aa, unknown, or other
MAATASLSAVGAPLSVPGLXKALGVSSLRPPAAKXAKMTTXPCGRXRPLRSPSSXKKLAAG

SEQ ID NO: 58289 - DNA, 597 bp, Zea mays
  misc_feature: Ceres CLONE 1511254
  misc_feature: Encodes the peptide sequence at SEQ ID NO. 58290
  misc_feature (365)..(365): n is a, c, t, g, unknown, or other
gcggtggcggccgctctagaactagtggatcccccgggctgcaggaattcgtctcacccctagaaaaaaagccgccgccactccttctccctccccctttctctctcttctctctctaccgccccaggccccccgatctcctcctcccactccgatcgcccgaccgatcgccgagcttccctgttccctccccgcccccgcgacgccatggagccgccgcacgccgagcaggccgtcgccgtcgcacgctgagcaggccgtcgccgtcgcacgctgagcaggccgtcgccgctgtagcagcaggaggagagggtggcactgcaagcccgggcaccggcctcgaaggtgctgtctgcttaacgttntttgtttcgttcagatctatggccggacgaggcggactgtggctactacctccgcacgacgctgcgacgggcgctcctcagatcggcagagacctctttcgaaacgcagtagccgggagattcggaatcccgcgcgcgagttgggcctgccagcagaatatcgaattgctttgccgtggaaacaggagaaaggctgcattgagtatattcattctttatcaagggcacagcc

SEQ ID NO: 58290 - protein, 71 aa, Zea mays
  misc_feature: Ceres CLONE 1511254
MAGRGGLWLLPPHDAATGAPQIGRDLFRNAVAGRFGIPRASWACQQNIELLCRGNRRKAALSIFILYQGHS

SEQ ID NO: 58291 - DNA, 907 bp, Zea mays
  misc_feature: Ceres CLONE 1511256-R
ctcgagcgtctcgttttttttttttttttacggtccttggttttttttattttttttttttttttaagcaaacggctttgtgccagtgctttttcattttaaccatcaaaaatcccacctttttagagaaagcaaccaaatctgctcatattattccactgcacatgcctgatggggccgtttccagtttttacaacctccatatgttgatatcatcctacccgctggcctttttccagatatgcttaaaaaggggggcccatggtggtgggccttttcccttatttttctcccttcttcaacagggcaggtaaaccccccccccaattgaactttatagacatctgttggatccccaccttcgaagcctctgcgaaccctgaggccgacgccgaacccctaaggggccgccgctgaggcaggtgaatgcaccaaacggcggctgcttccgccatgggggagaaaccctggcgctgcttgagcttggcgttcgccgggccttggaggaaggatattcaccggggcttccccaccttgcaaaaccgggacaggagcttctcagccgcacggacctttagcttatttcatggatcccccggttcgcccctggggccctcctctgcctcccttccgtcccgggggttagaacaaaatctctcgagccccgggggggttcccttttttcatagagacgtgcccccctcccaggtggggagcccccagcctttgcgttcccctttcgcccagggggggataatccaccacttgtgtagtacttccgggaggtttagctgtgtttttccttaaggtgcaacgtcttcttctcgtgtgaataatacccgcctctttctataactcgctgccgggatgggagatattttatattaatcatgcgtggggcggctag

SEQ ID NO: 58292 - DNA, 638 bp, Zea mays
  misc_feature: Ceres CLONE 1511259
tccccgcggtggcggccgctctagaactagtggatcccccgggctgcaggaattcgtctcacccctagaaaaatttctatcagaaagtaaaagggtttcagaagacttctatgctactcctccaacaccgaggcaagattttcctcatacttaaacttgactattcactacatattattggtgcttaataatctgcttgaggaacatctgtttctatgaattgtaaaaataaccactgagactgaattccatacctgtaactttgcaggagtcccaatccattcggaacagcaaaatatctgtttgacaagatcccaagaaatgcttccagcaaggttcgaatcaaccacgacctgtatactcaaaaaaagtaataacttaagaatgctcacaacaaacatactggaatcatgaacctcaggaactgatgtgtacgtattttgggaaattcgcacggtcattggagcgacacccccattaccagattttgcattggcgctaacacctgaagaatatgatcttcctccactagatccactttggaacaacaagaacaagccattaagtgtaatgcagcagaatggttgcttctggcacaatattggcgtctgacagaaagcaggaccaagatctgcatt

SEQ ID NO: 58293 - DNA, 600 bp, Zea mays
  misc_feature: Ceres CLONE 1511262
  misc_feature: Encodes the peptide sequence at SEQ ID NO. 58294
  misc_feature (434)..(434): n is a, c, t, g, unknown, or other
  misc_feature (435)..(435): n is a, c, t, g, unknown, or other
gcggtggcggccgctctagaactagtggatcccccgggctgcaggaattcgtctcacccctagaaaaaaagaaccactttcacctgaactcctgaagcaatggccatgagagctctcccgctgaccccttccaggagctcctcgtttggagctcaccaaaccaggccgagcggcggcggccccagatcagtgagagcttatgcgaagggagacgaggagggcgacaagcagtccctgttcggaagcatcaccgaggcgctggacttctcgcaggtccggtcggagaaggacgccgagctgctgtacgaggccagggagtccaccaaaggtggagggaggatgaccgagggagcagtacggagcacttaggcgggaagattggtggcacctaccaggatttcttcaagtcatatgttgaagtcgacgggcatacnntggaggaaaagggtggggtccacaagaccctgcaagatctggcagaaggacacaagggggggagcccaaagcaggttgacaagctaggaagataccttccacgttgcgtggcctggagaaccccaaaccgacgaacttttttcgcaaaatcttcgccagatgact

SEQ ID NO: 58294 - protein, 89 aa, Zea mays
  misc_feature: Ceres CLONE 1511262
MAMRALPLTPSRSSSFGAHQTRPSGGGPRSVRAYAKGDEEGDKQSLFGSITEALDFSQVRSEKDAELLYEARESTKGGGRMTEGAVRST

SEQ ID NO: 58295 - DNA, 651 bp, Zea mays
  misc_feature: Ceres CLONE 1511263
  misc_feature: Encodes the peptide sequence at SEQ ID NO. 58296
  misc_feature (429)..(429): n is a, c, t, g, unknown, or other
tggcggccgctctagaactagtggatcccccgggctgcaggaattcgtctcacccctagaaaaactcttctctccccagattcactcaccgtccgtccgtccagggagccatggcagcagcagcagcagcctgcatctgtctgcagctctctctcccaagcaaccattcttcctctgcatgtcctccagcatacaggaagcgtgtcgcgctagccccagggagaggaaaccgtcttctctgcactgcatctggcgcctcttcttcttcttctgtggtggtgaccaaggagcaggaggaaggatctcctgagcccgaaatctttagctacaaagacgaccccaacttcaggggctgcaagggctgcggcagggacgagcttcaaaggggctgcaatggacaaggccggatccagggcggcatagccgccngtcccgggcttcgagctggtggcccattcaggcgtaccggcccgtgccccgagcttcgtccgcgcccggggggccgcctaacgggcgccaggggccaaaacatggaacgaacgttgcatcccggccagggggaaaaagaaaaccctcttcccgcaaaaaaaaaaacttaaacccccctaagctagttttaatggtcctccagggggaaattcagaaaactcg

SEQ ID NO: 58296 - protein, 162 aa, Zea mays
  misc_feature: Ceres CLONE 1511263
  misc_feature (107)..(107): Xaa is any aa, unknown, or other
MAAAAAACICLQLSLPSNHSSSACPPAYRKRVALAPGRGNRLLCTASGASSSSSVVVTKEQEEGSPEPEIFSYKDDPNFRGCKGCGRDELQRGCNGQGRIQGGIAAXPGLRAGGPFRRTGPCPELRPRPGGRLTGARGQNMERTLHPGQGEKENPLPAKKKT

SEQ ID NO: 58297 - DNA, 659 bp, Zea mays
  misc_feature: Ceres CLONE 1511264
ggagctccccgcggtggcggccgctctagaactagtggatcccccgggctgcaggaattcgtctcacccctagaaaaattactctagggataacaggctgatcttccccaagagtccacatcgacgggaaggtttggcacctcgatgtcggctcttcgccacctggagctgtaggtggttccaagggttgggctgttcgcccattaatgcggtacgtgagctgggttcagaacgtcgtgagacagttcggtccatatccggtgtgggcgttagagaattgagaggacctttccctagtacgagaggaccgggaaggacgcacctctggagtaccagttatcgtgcctacggtaaacgctgggtaaccaagtgtggagaggataactgctgacagcatataagtagtaagcccaccccaagatgagtgctctctcctccgacttcgctagagcctccggtagcacagccgagacagcgacgggttctccacccatacgggtgatggagcgacagaagtatggacataggataacgtagcggctagacgagccgttgtaataggtgtcaagtgggagtgcaatgatgtatgcagctgaagcatcctgacgaacgaacgatttgaaccttgttcctacacgaactgatcaaatcgatgaggc

SEQ ID NO: 58298 - DNA, 712 bp, Zea mays
  misc_feature: Ceres CLONE 1511377
  misc_feature: Encodes the peptide sequence at SEQ ID NO. 58299
ggagctccccgcggtggcggccgctctagaactagtggatcccccgggctgcaggaattcgtctcacccctagaaaaaattattcgttgcagtagtcgcagctgacggacgactgaaccaccgacagacaacatggccgcctccgcctccaccgtctccggcctcgccggcgcctccctggccagccgcccggcgttctccaccagcttcacgcggggcagccgggtgtcggcgaggaaccccctgatgagcatgaacctggagaggaatggcaggatcacctgcatgacgtttccccgggactggctgccgagggacctgaagcgcatcggcttcgggctcatcggctggaaggggcagtccagtgtcttgattgacaaccgcgcacgcccctcaccgagatcttttttttaaagaaaccggccaacaacagggccaactttctcccagaacaccccccggtcagcctccccagattctcggtttgtgcgctaattgaacctgtaccccctggtcccaggttcaatccggggtacacctcttatgcacacaatcactaattataagggttcagaaccctaggaacagacttctaaacaattgaagcccggataaaaaaacaaaaggcaaagaaacccagggacgaccctacctttaatttccgatataccaggatatcggttcccccccataaatagaaccttattgagtt

SEQ ID NO: 58299 - protein, 93 aa, Zea mays
  misc_feature: Ceres CLONE 1511377
MAASASTVSGLAGASLASRPAFSTSFTRGSRVSARNPLMSMNLERNGRITCMTFPRDWLPRDLKRIGFGLIGWKGQSSVLIDNRARPSPRSFF

SEQ ID NO: 58300 - DNA, 747 bp, Zea mays
  misc_feature: Ceres CLONE 1511381
  misc_feature (45)..(45): n is a, c, t, g, unknown, or other
  misc_feature (47)..(47): n is a, c, t, g, unknown, or other
  misc_feature (48)..(48): n is a, c, t, g, unknown, or other
cttagtggaagctcacgcgggggcggcgctctagactagtggatncnngggctgcaggattcgtctcacccctagaaaaaacgccaccaccaaacgcctctctctctctctctctctctctctctctctctctctctctctctctctctctgtcacggtggatgtgggggtgggggggacaaggggggagggggggggggagggggggagggggggaaggggggggaaagggggggggaaaaaaaggggggagtatgggaaaaaaaagagagaagaggaaagggggagggggagggagaagaaaaaagaggagggaaaggaaggggggggagagggaggggggaggaagggaaaaaaaagggggggagaaaaaaaaaataggggggcagaggggaaaggggaggggagagggtggagaaaaagagggagagaaaaatgagagaggggagaaaagaagaatgagagggagggaagagaggggaggaaagaagaagagggggggagggtgggaggagggggagaggagaggggaggggggagagaagagaatagaaggaggggggggggggggggggggggagaaagagaaagaagaaagaaaaggaaggagaggaggaaaggaggagagagagagggaaagagggggaggaggaaacagcagggagaaagaggggaagagaatgaggaggaaggaggggggagggagaggggaaaaagacaaaaagaagaggaaaaaaacaagaaaga

SEQ ID NO: 58301 - DNA, 647 bp, Zea mays
  misc_feature: Ceres CLONE 1511385
  misc_feature: Encodes the peptide sequence at SEQ ID NO. 58302
tccccgcggtggcggccgctctagaactagtggatcccccgggctgcaggaattcgtctcacccctagaaaaagtgacgaactcgaagcttgcgttcttgtagtagaggtcggcagcaagcggtagagcgagaggtcgagaagatgaagaacagcactctgttggcgatcctagttctccaggcccttctggtctctgcggccgtggccaaaggacctgcagggccgacgacgaagaagcagtgctggtgcggcgagtgcaccagctggtcgggcgtgtggacctgcgacgacctcctcaccaagtgcgccgccacctgcaagaactgcgtccccgtgtccacggacaagggcaccaccaagtacaggtgccgcgacttcctccccgaaaactgcggctgcaagatccactagactcatccacagcggcacagccgatggatccttccatgctcctccgtccgtccgccttgctataagcaggcaggcagccaccaataagctagctcttgctgttgttttgcatgtttgattgggtgtcccttcccagtcgagatggaataaaataaatgtcaggcgcaaaaaaaaaaaaaaaaacgagacgctcgaggtacccaattcgccctatagtgagtcgtattacgcgcg

SEQ ID NO: 58302 - protein, 89 aa, Zea mays
  misc_feature: Ceres CLONE 1511385
MKNSTLLAILVLQALLVSAAVAKGPAGPTTKKQCWCGECTSWSGVWTCDDLLTKCAATCKNCVPVSTDKGTTKYRCRDFLPENCGCKIH

SEQ ID NO: 58303 - DNA, 672 bp, Zea mays
  misc_feature: Ceres CLONE 1511386
  misc_feature: Encodes the peptide sequence at SEQ ID NO. 58304
  misc_feature (394)..(394): n is a, c, t, g, unknown, or other
ggagctcaccgcggtggcggccgctctagaactagtggatcccccgggctgcaggaattcgtctcacccctagaaaaaactctcctccttcctccaccgccgccaacgtcgcctggcggccgtctgcagctccgcgcctctgctcggaagttgttggtgaaggtttcttgaagctgagaagatggtgctgaagacagaactctgccgcttcagcggccagaagatttatcctgggaaaggcatccgatttatccgtgctgattctcaggttttcctttttgccaactcaaaatgcaagcgctacttccacaaccgcctgaagcctgcaaagcttacctggacagcaatgtacaggaagcagcaccacaaggatatccgtggtgaggctgtcaanaagaggcgccgcgccaacaagaagccatactcgaggtccattgtgggtgcttccctagagggggtccagaagaagagggctgaaaaccccgagggcccccgatgcttctagagaagctgctcttcccgaggatcaaggggccgcatcttgaagaactcagggtgaaaaaaaagggtaaaaaaggtggagggggaccaattcccacaaaggggcaaaagaaagggggcgggtccccaaaggggttcctaggggcccccaaattggggggggggggggtg

SEQ ID NO: 58304 - protein, 107 aa, Zea mays
  misc_feature: Ceres CLONE 1511386
  misc_feature (3)..(73): Pfam Name: Ribosomal_L24e Pfam Description: Ribosomal protein L24e
  misc_feature (71)..(71): Xaa is any aa, unknown, or other
MVLKTELCRFSGQKIYPGKGIRFIRADSQVFLFANSKCKRYFHNRLKPAKLTWTAMYRKQHHKDIRGEAVXKRRRANKKPYSRSIVGASLEGVQKKRAENPEGPRCF

SEQ ID NO: 58305 - DNA, 533 bp, Zea mays
  misc_feature: Ceres CLONE 1511388
  misc_feature: Encodes the peptide sequence at SEQ ID NO. 58306
  misc_feature (225)..(225): n is a, c, t, g, unknown, or other
  misc_feature (248)..(248): n is a, c, t, g, unknown, or other
  misc_feature (345)..(345): n is a, c, t, g, unknown, or other
  misc_feature (355)..(355): n is a, c, t, g, unknown, or other
ctccaccggctggtggggcggccgctctagaactagtggatcccccgggctgcaggaattcgtctcacccctagaaaaaaaagcaaataagacgacttgtttcattgattcttgaagagatcgagcttcttttgcaccacaaggatcgaggaatgtcttgcaactgcggatcaagctgcggctgcggctcaagctgcaagtgcggcaagaagtaccctgacctgnaggagacgagcaccgccgcgcangccaccgtcgtcctcggcgtggcccccggagaagaaggcgcgcccgagttcgtcgaggcctgcgcgagtcggcgaggccgccacggctgcagctgcngtgcaactgncagtgcgacccctgcaactgctgatcacatcgatcgacgaccatggataatgataattatctatctagcttgggggtggtgggttgaacaataataaagcgagggccgaacttgctggcctaaaataagggattgggggggggggtgggtgaaaaaaaaaaaaaaaaaaaattttttt

SEQ ID NO: 58306 - protein, 98 aa, Zea mays
  misc_feature: Ceres CLONE 1511388
  misc_feature (1)..(64): Pfam Name: Metallothio_2 Pfam Description: Metallothionein
  misc_feature (25)..(25): Xaa is any aa, unknown, or other
  misc_feature (32)..(32): Xaa is any aa, unknown, or other
  misc_feature (65)..(65): Xaa is any aa, unknown, or other
  misc_feature (68)..(68): Xaa is any aa, unknown, or other
MSCNCGSSCGCGSSCKCGKKYPDLXETSTAAXATVVLGVAPGEEGAPEFVEACASRRGRHGCSCXATXSATPATADHIDRRPWIMIIIYLAWGWWVEQ

SEQ ID NO: 58307 - DNA, 675 bp, Zea mays
  misc_feature: Ceres CLONE 1511389
  misc_feature: Translation starting site: 100
ctccccgcggtggcggccgctctagaactagtggatcccccgggctgcaggaattcgtctcacccctagaaaatcttggtcgattcgtcgcggtctcccatgtccttccttcatgcgctcgaccgacagagaatcccactggctttgagaggtcggttgatctcgctctcctttctgggtgctatttcctgtctaattttttcacctaggaagacctcgaaaacaccgtcctgtccccaggctagtgatcgtctgtcaccccttgacctgctgatgtggacattggtggcaatccatcctccgagcgtggtgaggaccagcgcgttgatcacacagctctatcggaaggtgatattgttaaccccttccccctggaggaacaatctccttttaataacacatggtttgagtcttacatcagacaatacttccgagtctgcactgctgtgttctagcctgataatgcagatgagttacccaacggtgtcaagagtgcacacatttttctccttacctagatgaacgacctactattgcttgttggtgattccatgatgaataatgcatctgaaggctacccctactacacgtatgtgccacgtatccgacaatactcgatttctcttatgccctcaatgacacaagtgctatgcgtgctgatgattaatctactcg

SEQ ID NO: 58308 - DNA, 835 bp, Zea mays
  misc_feature: Ceres CLONE 1511394
  misc_feature: Encodes the peptide sequence at SEQ ID NO. 58309
  misc_feature (24)..(24): n is a, c, t, g, unknown, or other
  misc_feature (25)..(25): n is a, c, t, g, unknown, or other
  misc_feature (27)..(27): n is a, c, t, g, unknown, or other
  misc_feature (28)..(28): n is a, c, t, g, unknown, or other
  misc_feature (31)..(31): n is a, c, t, g, unknown, or other
  misc_feature (42)..(42): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (52)..(52): n is a, c, t, g, unknown, or other
tttttttttttttttttttttttnnannaanattttattttnannntctttncaaagctgtgactccaccgcggtggcggccgctctagaactagtggatcccccgggctgcaggaattcgtctcacccctagaaaaaacaatagcaaaaaccaccatccgtcgtcgccaaccgtagcaagaacatcacctccgcccagcaataatggcgcaaagcatgaggattgtggcgctggccctggtggccctgctggtggtggcggcggcggcgcccgtggccaccgcgtacggctgctacgacgactgctacgagcgctgcgccaacggaaagaaagaccccgcctgctccaagatgtgcaaccaggcgctgcggctccacggatcagggcgccggtgccgcccggcgcagcgccggcttgatcgcccagcgcattcattcgcttcagctaagataaataaaccgctgcctccgattccaacaagcccaccatatggatgtcgatcaaattttgtccctcccgctaaattttctacgaacacccccgtccccaaagtttgttttttccctttcctaagtactgtccgacgaccaactaacttaaatattcttgttttttgtccaccgccttacctcctccccccctcccaatccttcccgttccggagggaatcgaacctccatccgctttagagtactgttacccgcaccaatatcgaaaaaagaaaaaaggacccagaaaaaagaaaccacaaacaactccccctcacaacaaacaacaaacaacaaaaaaaaaaaaagaaaggacatggaggggacaaaccacattttccccccc

SEQ ID NO: 58309 - protein, 161 aa, Zea mays
  misc_feature: Ceres CLONE 1511394
MAQSMRIVALALVALLVVAAAAPVATAYGCYDDCYERCANGKKDPACSKMCNQALRLHGSGRRCRPAQRRLDRPAHSFASAKINKPLPPIPTSPPYGCRSNFVPPAKFSTNTPVPKVCFFPFLSTVRRPTNLNILVFCPPPYLLPPSQSFPFRRESNLHPL

SEQ ID NO: 58310 - DNA, 636 bp, Zea mays
  misc_feature: Ceres CLONE 1511396
  misc_feature: Encodes the peptide sequence at SEQ ID NO. 58311
tggagctccccgcggtggcggccgctctagaactagtggatcccccgggctgcaggaattcgtctcacccctagaaaaaaaaaagctggactgctccatcacactcgcctcctccgccgctatctgtttgttgagttagagtttcatctcgtgtataacgagttcggagctcagaaatcctttcctctctcccgttcgaggctaggtaaccgtcaccatgagcctctcggggcagcctccggatctcgagaagaagatggacaacaagcttcatataaaaatgaatgcaaaacgctggttgtctaacggcacacttcgagggttcgaccagttcatgaatctggtggaggacaacactgcgaaggtcaatggaaatgacaaaacagatattataatgatggttatcacgtaaaacaacgttgtaatgatcgacgcactggagccagatgcgatgctcagtgaatcattgttctttagcactagcaccgtgaaaactgatgtaaaagatatccttggaccctgttgtatttgactaatgcttttgcacagcaacgtaacttcggaggcggaatgtctatcccttgttctatggtatgcttgaagctatacaatcatctagctcttaaattacatgat

SEQ ID NO: 58311 - protein, 64 aa, Zea mays
  misc_feature: Ceres CLONE 1511396
  misc_feature (8)..(64): Pfam Name: LSM Pfam Description: LSM domain
MSLSGQPPDLEKKMDNKLHIKMNAKRWLSNGTLRGFDQFMNLVEDNTAKVNGNDKTDIIMMVIT

SEQ ID NO: 58312 - DNA, 508 bp, Zea mays
  misc_feature: Ceres CLONE 1511397
  misc_feature (314)..(314): n is a, c, t, g, unknown, or other
ctggagctccccgcggtggcggccgctctagaactagtggatcccccgggctgcaggaattcgtctcacccctagaaaaaatcttcctctgcgcttcgcccacacgctccagccgcttcaccgcgccgccaccgccaccagcgaggatttgccgttcaagaggttcgtggaatcgggcgcgtgccctggtgactacggaagacttggccgtctcgcgtctcgtaatgtggcgacagacaggcacttgtgatgccctgatttggcagtgccagtgaacttcaagcgttctccctcctgaactcagattgacttcnaacgggcccccaaaaaaaaacccttgttcaagggcattggagaaaacctttttttaaaaccaatgggggaaaaaaacccctcgggggcaaaaaaacctttttttccccaaaaaaaagaaagaaccccccccccaaaagcttttttaaagggcaaaaaaccccccttccccaaaaaataaaaaagggggggggct

SEQ ID NO: 58313 - DNA, 657 bp, Zea mays
  misc_feature: Ceres CLONE 1511400
  misc_feature: Encodes the peptide sequence at SEQ ID NO. 58314
  misc_feature (456)..(456): n is a, c, t, g, unknown, or other
  misc_feature (649)..(649): n is a, c, t, g, unknown, or other
  misc_feature (657)..(657): n is a, c, t, g, unknown, or other
ggagctccccgcggtggcggccgctctagaactagtggatcccccgggctgcaggaattcgtctcacccctagaaaaaaactctcctcattcttcgcaggctgagcagcaaccgccccaatctgcagttcaagaaccgcccacgcagaacccctccgccctccgctccttccaacttgctctctacctgcaccagcctcgcccacccttcgctcgccgccgccatggggaggggaaagttcaagggaaagcccaccggccgccacagcgtctccacaccagaggagatcgctgctggtacttcaggtcgccctcgcacctttatgaagacatgcaattgaaaaagagaattgatcttttttatgggcgaagtgtcgaagatggctttggtgaaggaaatgtcttgttagcatcgagtaaatggcgacatcacaacccctacaagcttgtgccttanaacaagaggatacaagaagttggagtgcttttgtgaaggcttttgcgaatcacttgaagcgttagtacttttgtgaatgattttgtaaagtgtttgcaaatatgtgcaaaacataataacatgtgtaggttttgcgaatgattttgttgtgatgctttgtgatggtttatgtgatgtggatctatcattgtgncatactan

SEQ ID NO: 58314 - protein, 38 aa, Zea mays; identical to SEQ ID NO: 6853
  misc_feature: Ceres CLONE 1511400

SEQ ID NO: 58315 - DNA, 778 bp, Zea mays
  misc_feature: Ceres CLONE 1511402
  misc_feature: Encodes the peptide sequence at SEQ ID NO. 58316
  misc_feature (10)..(10): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (20)..(20): n is a, c, t, g, unknown, or other
  misc_feature (41)..(41): n is a, c, t, g, unknown, or other
  misc_feature (42)..(42): n is a, c, t, g, unknown, or other
  misc_feature (50)..(50): n is a, c, t, g, unknown, or other
  misc_feature (51)..(51): n is a, c, t, g, unknown, or other
  misc_feature (778)..(778): n is a, c, t, g, unknown, or other
aataatattntannnnnntnaataattttaatttttttgtnnccgtaccnngggcaagctggagctccaccgcggtggcggccgctctagaactagtggatcccccgggctgcaggaattcgtctcacccctagaaaaaagggtccacttcgctcgcaaccttccccagccccagccatggcgaccgcgacgcggaggctgctccccgcgctcctcaagaccctagctccagccggcgcgcgcggcctctccaccgagaaggctgttggtgcagccgccgtcgtcggtagccacaccgctaagtggatgcaggacacgagcaagaagtcgccaatggaactgatcaacgaggtacctccgatcaaggttgatggtcgcattgctgtctgtgaaggggcttctgaaggtgttggacttggccacccaatcgagtacatctgccttgatctggaggcacctaatgtgtgcaaatattgtggtctccgttatgttcaagttcaccatctctaaattgaggaagatactgcctgtctaccagctgcagaagctgactttgaggagctttatatgcaccccccctttggttcccaccatgttactgtaagagtaccctcgccactaaagacttggcgggacaaaagtaattaaccttttggatagaatcatccccaccttctcccagcgccgaacctttttccattaactccctgtacttgtaatgatacggggtttcactgtctttatcctcacactgatccgaaactttagtggattccgn

SEQ ID NO: 58316 - protein, 110 aa, Zea mays
  misc_feature: Ceres CLONE 1511402
MATATRRLLPALLKTLAPAGARGLSTEKAVGAAAVVGSHTAKWMQDTSKKSPMELINEVPPIKVDGRIAVCEGASEGVGLGHPIEYICLDLEAPNVCKYCGLRYVQVHHL

SEQ ID NO: 58317 - DNA, 652 bp, Zea mays
  misc_feature: Ceres CLONE 1511408
  misc_feature: Encodes the peptide sequence at SEQ ID NO. 58318
catagctggagctccccgcggtggcggccgctctagaactagtggatcccccgggctgcaggaattcgtctcacccctagaaaaagacaccagcaacccccaacagcgccactgtcacagtgcgcgcgtcaagcttgcttaactagccgccatggcctccctcgccgccgtctccgtgaaacccgtggccatcaagggtctcgccggcagctctatctccggaaggaagatcgccgtcgccaggccgtcggcccgctccatccgcaagccccgcgcagccgccgtggtggccaagtacggcgacaagagcgtctacttcgacctcgacgacatcagcaacaccaccggacagtgggacctctacggctctgacgcgccctctccctacaacccgctacagagcaagttcttccagacgttcgcggctccattcaccaagagacgtctgctgctcaagttcctgctgctaggcggcggctcacttctggcctacgtcagcgcgtcagcgtcaccggacctcctgccgatcaagaagggacctcaggagccgccacagccgggcccgcgcggcaagatctaagctcagctactccatttgcatggtctagtactagcttgctttgtactgctagcgccggtcgatccatcacaa

SEQ ID NO: 58318 - protein, 142 aa, Zea mays
  misc_feature: Ceres CLONE 1511408
  misc_feature (5)..(142): Pfam Name: PSI_PsaH Pfam Description: Photosystem I reaction centre subunit VI
MASLAAVSVKPVAIKGLAGSSISGRKIAVARPSARSIRKPRAAAVVAKYGDKSVYFDLDDISNTTGQWDLYGSDAPSPYNPLQSKFFQTFAAPFTKRRLLLKFLLLGGGSLLAYVSASASPDLLPIKKGPQEPPQPGPRGKI

SEQ ID NO: 58319 - DNA, 838 bp, Zea mays
  misc_feature: Ceres CLONE 1511422
  misc_feature (19)..(19): n is a, c, t, g, unknown, or other
  misc_feature (21)..(21): n is a, c, t, g, unknown, or other
  misc_feature (22)..(22): n is a, c, t, g, unknown, or other
  misc_feature (43)..(43): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (838)..(838): n is a, c, t, g, unknown, or other
ttttttttttttttttttntnnttatggggggggccccccccnaactgatnnnnnngcacagctgggggctccccgcggtggcggccgctctagaactagtggatcccccgggctgcaggaattcgtctcacccctagaaaaaactagtcttccctgcgcttgctcgctccttcttgcccccatggcgctgctcgccttccagggcatggccatgtcgaccgccgccgcggcgctcccatctcacatccacggggccgtttcatcctacttcctccccctcctccttccgcgtctgcgcggcccctcggtacgtccttgaccccggggtgaacggaaaacctgtgggtcgggccggggtgggtgtgcgcgccccccctctctcgcgaggcctgctggtagactttcccaaaattattttcggctatcagccgcgtccgggcaggggcgggagaacaatttacccccccaaaaggtgttttttaattaacccgccccacacgggggggggcgggggggggggggggggctctcccttccaaggcttgacgtctcctcacctcacaccacacaccgccgcccccccgaggtgtggtgggcgttggagaggagcggagcacctgacaacaccgccttcctccccgtcggccatagcagcggcatcctacaataaaagcctcctcactctcccccctcaatcctacgcgtcccacaatatacctgcccccctcccccccccccccccgccccccccccccccctcccctctccccccccgccccccccctcgcgccgttctccccccgcgtgcgcccccctgcgtcccgagaccacgtccgn

SEQ ID NO: 58320 - DNA, 787 bp, Zea mays
  misc_feature: Ceres CLONE 1511425
  misc_feature: Encodes the peptide sequence at SEQ ID NO. 58321
  misc_feature (10)..(10): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (33)..(33): n is a, c, t, g, unknown, or other
  misc_feature (34)..(34): n is a, c, t, g, unknown, or other
tttttttttntttttnnnnnnnnntcttttttnnttttttttttccttcgccaccttttgaaagctggagctccccgcggtggcggccgctctagaactagtggatcccccgggctgcaggaattcgtctcacccctagaaaaagctttcaccccccgcatcgaacctcacccccgatctgatcgaatcgaaggctgcggcggcgatgggcggtgaccatggcggtgggcacgccggcggcgacttccgccagaaggtagggagcatgacgggcggcccctactgccgccccgtccactggcgccgtaacaccgccatcgccatgttcggcgtcttcctaatctgcatccccatcgctatgaagtccgcaaagctccgagcaacgcccgcatcacccagtccggccaatccaatctcaactgtggcatgaaaaactttgggtaagaaggaatatctgaaggaccctcccaactagcaagaaagtggagggcaaacattgatttttgccttccttttttgtgggaaaccttgttgccctagcccataaaggcgtggggtttaagtggttaaagaggcaatcctcctgggaaatgcatttcgcggtaagtatctatttcgatttctttcttttccctttccacggttcacaaggtggaaatggccctggagtaaccttcaaatataaggcaccgggtgggttcaaaaaagcattgttggttggaacttttactccaaaaggacttttggaaccaaggccaacttgctaaaacatgaggcaatgttccct

SEQ ID NO: 58321 - protein, 74 aa, Zea mays
  misc_feature: Ceres CLONE 1511425
MGGDHGGGHAGGDFRQKVGSMTGGPYCRPVHWRRNTAIAMFGVFLICIPIAMKSAKLRATPASPSPANPISTVA

SEQ ID NO: 58322 - DNA, 649 bp, Zea mays
  misc_feature: Ceres CLONE 1511427
  misc_feature: Encodes the peptide sequence at SEQ ID NO. 58323
ggagctccccgcggtggcggccgctctagaactagtggatcccccgggctgcaggaattcgtctcacccctagaaaaaacaacacctcgctttttgtactcttccgtctttgccctcgcgttaacgcgctcgtctcgcctggcctagctagctgcctgccttggcttgcttgctacgtcgtgtactatacacagcgagaggaaggaggagcaagaaaagaaagaaaagagagagagtcgcttcctttcctccaacttattccatggagacctcttctcacaagcgggcgcgggaggcggtcgacctcgccgccgccgccggagaggccgtgtggccggaggccgacgccaagaggctgcggccgcaggacctgctcgacatgctcgacgacgacaccgaagcggcggccgccggcgacctggcgtccgtcatgcggagcctggaggaggagatagccagcttcgacgaggccgcggaggcggcgccgtcgcagcagccggagctggggttcctgctcgaggcctcggacgacgagctggggctgccgccggcgggatccgccgccgccgcctcttcggaggaggccggcctcgccggcccgccggagcccgccgccgcgctctacggccagatctggggcttcgacgac

SEQ ID NO: 58323 - protein, 129 aa, Zea mays
  misc_feature: Ceres CLONE 1511427
METSSHKRAREAVDLAAAAGEAVWPEADAKRLRPQDLLDMLDDDTEAAAAGDLASVMRSLEEEIASFDEAAEAAPSQQPELGFLLEASDDELGLPPAGSAAAASSEEAGLAGPPEPAAALYGQIWGFDD

SEQ ID NO: 58324 - DNA, 645 bp, Zea mays
  misc_feature: Ceres CLONE 1511434
  misc_feature: Encodes the peptide sequence at SEQ ID NO. 58325
ctggagctccccgcggtggcggccgctctagaactagtggatcccccgggctgcaggaattcgtctcacccctagaaaaaattcctccgagagggagaagccgccgccgcagcaatcacagcagcccggacaaagcccaggtccgacaagatgcagatcttcgtgaagacgctgacagggaagaccatcaccctcgaggtcgagagcagcgacgccatcgacaatgtcaaggccaagatccaggacaaggaaaggatcccgccggaccatcagcggctgatctttgccgggaagcagctggaggatggccgcacccttgcggactataacatccaaaaggagtctacgcttcacctcgtgcttaggctccccggtggcatcattgagccctcgctgcaggggctggctcccccccacaaccaagaacaagatgatctgccgctaatgctatgcacgactgccccctatggctggtctctgccgcacgaagaagtgtggtctcaacaaccagctggagggccaagaagaagatcaagaaactgaggtgctgctccgtagccaggttcatggaccaaggtcgggcccgttttgcctgtgtggctgcttgacccgggttttggttacccccacaccttggggcctctc

SEQ ID NO: 58325 - protein, 130 aa, Zea mays
  misc_feature: Ceres CLONE 1511434
  misc_feature (6)..(74): Pfam Name: ubiquitin Pfam Description: Ubiquitin family
MQIFVKTLTGKTITLEVESSDAIDNVKAKIQDKERIPPDHQRLIFAGKQLEDGRTLADYNIQKESTLHLVLRLPGGIIEPSLQGLAPPHNQEQDDLPLMLCTTAPYGWSLPHEEVWSQQPAGGPRRRSRN

SEQ ID NO: 58326 - DNA, 667 bp, Zea mays
  misc_feature: Ceres CLONE 1511437
  misc_feature: Encodes the peptide sequence at SEQ ID NO. 58327
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
tccccgcggtggcggccgctctagaactagtggatcccccgggctgcaggaattcgtctcacccctagaaaaaatctcagcagtgacgaactcgaagcttgcgttcttgtagtagaggtcggcagcaagcggtggtagagcgagaggtcgagaagatgaagagcagcactctgttggcgatcctagttctccaggcccttctggtctctgcggccgtggccaaaggacctgcagggccgacgacgaagaagcagtgctggtgcggcgagtgcaccagctggtcgggcgtgtggacctgcgacgacctcctcaccaagtgcgccgccacctgcaagaactgcgtccccgtgtccacggacaagggggccatcaagtacaggtgccgcgacttcctccccgaaaactgcggctgcaagatccactagagactcatccaattccaccatggccgcgcgccacagcggcacagccgatggatccttccatgttcctccgtccgtccgccttgctacaagcaggcagccacaccaataagctagctcttgttgttgttttgtatgtttgattgggtgtcccttcccagtcgagatggaataaaataatcatcaggcgcccaatagcaaaaaannnnnnnnnnannnaannnnnnnnnnnnnnnnnnnnnnnn

SEQ ID NO: 58327 - protein, 89 aa, Zea mays
  misc_feature: Ceres CLONE 1511437
MKSSTLLAILVLQALLVSAAVAKGPAGPTTKKQCWCGECTSWSGVWTCDDLLTKCAATCKNCVPVSTDKGAIKYRCRDFLPENCGCKIH

SEQ ID NO: 58328 - DNA, 549 bp, Zea mays
  misc_feature: Ceres CLONE 1511442
  misc_feature: Encodes the peptide sequence at SEQ ID NO. 58329
atagctggagctccccgcggtggcggccgctctagaactagtggatcccccgggctgcaggaattcgtctcacccctagaaaaacacccacccacccaccgagctgcctgctacacccctgccaagatccatctttccggttccgccgcctgatcgaagtgaacaagcaaggaagagccatggcgagcgagcacgcggcggggggcgatgctaagcatcaccagaagcagagcctgatggacaggcgaaggggttcgtcgcggagaagatcgcgcacatccccaagcccgaggccacgctggacggcgtgacgttcaacggcctgagccgggagtgcatcacgctgcacagcagcgtgaacgtgtccaacccctacgaccaccgcctccccatctgcgaggtgacctacacgctccggtgccgccgcaaagaaggtggggcccggaacatgcccgacccccggttggatcgcccccgggggttccaccgggctgaaaatccccgccaaggggccctagaatttccccgctcccccgggaggggaagggg

SEQ ID NO: 58329 - protein, 33 aa, Zea mays
  misc_feature: Ceres CLONE 1511442
MPDPRLDRPRGFHRAENPRQGALEFPRSPGRGR

SEQ ID NO: 58330 - DNA, 724 bp, Zea mays
  misc_feature: Ceres CLONE 1511446
  misc_feature: Encodes the peptide sequence at SEQ ID NO. 58331
  misc_feature (562)..(562): n is a, c, t, g, unknown, or other
  misc_feature (613)..(613): n is a, c, t, g, unknown, or other
aaagctggagctcaccgcggtggcggccgctctatactagtggatcccccgggctgcaggaattcgtctcacccctagaaaaatttggggaagaagggcgctgtgaccaactcgtgggggaaatatggcatcatccgtgagctcgatatgtggagcaagcggccagagttcactgcatggctatcagaagtcaagcaggttaatttggaggcattgtcaaattgggaagagaagccaatgttcaaggaattcatggaggatcacaatacagccacgtttccctcataaaaatattataatttagatgcgctaccatcaccaaccaatcggggatagacgaaaaagaaggggttaaaatatgattttgtcacgcaccccctgccctcttatggtacaagaaacctccagcctcacaggaattccctaaagaaccccagaaatcccccctaacattagaagataccgtgacccctcgcaataagccccgtcgcgcaattcacccacgggaggcctagccttataaagaggatagaagtccgccaacctcccaaaataaaacctnagaagcacagcaaaaagctctctgctcatattacctcctccccaacaagangattcacacacgggggcgggagaggtggccccactctcctatataaaatataacaccccgcccccctcgacacataccatataccaccccttctccgtcagcccctctatg

SEQ ID NO: 58331 - protein, 46 aa, Zea mays
  misc_feature: Ceres CLONE 1511446
MWSKRPEFTAWLSEVKQVNLEALSNWEEKPMFKEFMEDHNTATFPS

SEQ ID NO: 58332 - DNA, 581 bp, Zea mays
  misc_feature: Ceres CLONE 1511447
ccccgcggtggcggccgctctagaactagtggatcccccgggctgcaggaattcgtctcacccctagaaaaaacgcgccactctttctggcagccgccgccaggatgcctccactctttctccctcttctctcctccccttgctcttctctggccgccgccacttgccaggacttcctgcagcagagcgcccctgcagctccttgcacctgcatcctacgcgcgctccagccgaccacgcccaggaaccagtgcagcgctccatcatcagtaggtgactgacggcacatgcgccaccatgccaatcatccatatgatccgtctcccacatgacctgcccggcgtaggctgcaaacggggcaggggccctttgggagctaagctagaggctggggaaaccaaccgcgtccggattggacaatgggaaagaaaagaaccccgtccggccccgagaaaaaaaatgttcccgttggaacgaaatttttcggcaaaaaatcccatttttgcccccggggggtccaaaaccccaaggttaaaggcgcgggcaaaaggttcccacaaaccctccaaaattctcaataa

SEQ ID NO: 58333 - DNA, 631 bp, Zea mays
  misc_feature: Ceres CLONE 1511448
  misc_feature: Encodes the peptide sequence at SEQ ID NO. 58334
  misc_feature (631)..(631): n is a, c, t, g, unknown, or other
aagctggagctccccgcggtggcggccgctctagaactagtggatcccccgggctgcaggaattcgtctcacccctagaaaaaagccatccccaaatcggcctacgcccacggttccacctcctcgtccacgaggtgaggaaaccctagcgaccgaccatggcgttgctcccgcgcaccgcgcggatggccctcctttccaccccgcgggcgtactccgctgccgctgctgcgggcgcctccccgacgtccccagcgccatacgggggcgcccccccaccggcgatgtccaagacggccgagttcgaggtctctaacgtggacgacctgatgaactgggcgcgtaaaggctcgatctggcccatgaccttcgggctcgcctgctgcgcggtggagatgatgcacgccggcgcgtcccgctacgacttcgaccggttcggcgtcatcttccgtccgtcgccgcgcctgtccgattgcatgatcgtcgccagaacgctcaccaacaagatggctccagccctccgcaaggtttatgaccaaatgcctgagcccaggtgggttatctcaatgggcagctgtgccaacggcggtggatactaccattactcctactctgctgtacgtggatgcgn

SEQ ID NO: 58334 - protein, 157 aa, Zea mays
  misc_feature: Ceres CLONE 1511448
  misc_feature (78)..(157): Pfam Name: Oxidored_q6 Pfam Description: NADH ubiquinone oxidoreductase, 20 Kd subunit
  misc_feature: SWISSPROT Homolog: EC 1.6.5.3 NADH dehydrogenase (ubiquinone)
MALLPRTARMALLSTPRAYSAAAAAGASPTSPAPYGGAPPPAMSKTAEFEVSNVDDLMNWARKGSIWPMTFGLACCAVEMMHAGASRYDFDRFGVIFRPSPRLSDCMIVARTLTNKMAPALRKVYDQMPEPRWVISMGSCANGGGYYHYSYSAVRGC

SEQ ID NO: 58335 - DNA, 644 bp, Zea mays
  misc_feature: Ceres CLONE 1511462
  misc_feature: Encodes the peptide sequence at SEQ ID NO. 58336
ccccgcggtggcggccgctctagaactagtggatcccccgggctgcaggaattcgtctcacccctagaaaaaacctcccatccatttctcaccagaagcgaaggcgaaggcggaggcggaggagcggaggtaggagatctcgagcaagccggaggcggagtagatgaagacgttcgacccgtggccggtctttttccgccgggagtggaagcgcaactggcccttcctcacgggtttcgccatcaccggattcatcatcacgaagatgacgtccaacttcaccgaggaggacctcaagaactccaagttcgtccaggaacacaagaagaagcactgacgaaccaggtgaaggagaaacgcatgtttggccagccagttctgttatgcttttgaatgaaaaatttagacccctctttctcgtttccttaatcgaaatgcttgaactctatgttccatttgtaatgtaataagaggcaaatgaattgaaccaacagcaatcaacttctgattgaaaaatatcgatgtgtcaaaaacccaaacacacttcacaccaatcccaagaaaaaaaattgacttgtcgagacgctcgaggtaccccattcccccctattggggagtcttatttctcccccctccctggccct

SEQ ID NO: 58336 - protein, 57 aa, Zea mays; identical to SEQ ID NO: 544
  misc_feature: Ceres CLONE 1511462

SEQ ID NO: 58337 - DNA, 873 bp, Zea mays
  misc_feature: Ceres CLONE 1511464
  misc_feature: Encodes the peptide sequence at SEQ ID NO. 58338
  misc_feature (1)..(1): n is a, c, t, g, unknown, or other
  misc_feature (2)..(2): n is a, c, t, g, unknown, or other
  misc_feature (12)..(12): n is a, c, t, g, unknown, or other
  misc_feature (13)..(13): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (19)..(19): n is a, c, t, g, unknown, or other
  misc_feature (21)..(21): n is a, c, t, g, unknown, or other
  misc_feature (23)..(23): n is a, c, t, g, unknown, or other
  misc_feature (36)..(36): n is a, c, t, g, unknown, or other
  misc_feature (37)..(37): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
nngggcgggggnngnnngngntnatttatatgagtnnccccgggtnnnnnngggagaggctggagctccaccgcggtggcggccgctctagaactagtggatcccccgggctgcaggaattcgtctcacccctagaaaaatccaactcacacacaggctcaccccaccaacagcaagcgaaaatctcccgatcccctctggtctccgcggcgaagatgtcggggcgcggcaagggcgggaagggcctgggcgggggcggcgcgaaacgccaccggaaggtgctccccgataacatccatgggatcacgaatcacggcgatccggctgactggcgctccaggggtatgccgaaaaaggcatctcccgggccccaatcccctaggtagaccccccggccgtcctccgagatcattccctgggaaaaacgtggttcttccgcccccccggccaggggggagggggggggcgcccagcgcccggaagagacgtcgtccccccccccccccacctttgtgatctatttatgctctcagtctcgcctagggggctgctggctccttgcttccgcccctccccccaagtctcagcgcgaagggtgtggggaccgcccccccccatcttgccccaccccgccccggcttctttcctcccttgttcttttcctactctcctccttctccccccccgccgcgccctccaaagcggcccacaaaccccaacccctcccctacatagactgcccccaccccaccacccagaggaccgacccgcctaccaaaactctcgtcaaaacaaaacaccccaactcctcccccccttccatatcccctctccccctcctccccctccctccctcctatctcttccccaccc

SEQ ID NO: 58338 - protein, 56 aa, Zea mays
  misc_feature: Ceres CLONE 1511464
MSGRGKGGKGLGGGGAKRHRKVLPDNIHGITNHGDPADWRSRGMPKKASPGPQSPR

SEQ ID NO: 58339 - DNA, 644 bp, Zea mays
  misc_feature: Ceres CLONE 1511466
  misc_feature: Encodes the peptide sequence at SEQ ID NO. 58340
tggagctccccgcggtggcggccgctctagaactagtggatcccccgggctgcaggaattcgtctcacccctagaaaaagcgaccccaggtcagtcgggactacccgctgagtttaagcatataaataagcggaggagaagaaacttacgaggattcccctagtaacggcgagcgaaccgggagcagcccagcttgagaatcgggcggcctcgccgcccgaattgtagtctggagaggcgtcctcagcgacggaccgggcccaagttctctggaaagggacgcctgggagggtgagagccccgtccggcccggaccctgtcgcaccacgaggcgccgtcaacgagtcgggttgtttgggaatgcagcccaaatcgggcggtaaactccgtccaaggctaaatacaggcgagagaccgatagcgaacaagtaccgcgaggaaaagaagaaggctgaatatgcagagaagatgaagaacaaggttgcaatgatacacaaggaagccgaagagaagcgagcgatggtggaggcaaaacgcggtgaggaggtcctgaaggccgaggagatggctgccaagtaccgggccaccggccacgctcctaagaagctcatcggttgcttcggagcctaagaagccttccaagt

SEQ ID NO: 58340 - protein, 89 aa, Zea mays
  misc_feature: Ceres CLONE 1511466
  misc_feature (1)..(84): Pfam Name: Remorin_C Pfam Description: Remorin, C-terminal region
MQPKSGGKLRPRLNTGERPIANKYREEKKKAEYAEKMKNKVAMIHKEAEEKRAMVEAKRGEEVLKAEEMAAKYRATGHAPKKLIGCFGA

SEQ ID NO: 58341 - DNA, 669 bp, Zea mays
  misc_feature: Ceres CLONE 1511471
  misc_feature: Encodes the peptide sequence at SEQ ID NO. 58342
aagctggagctccccgcggtggcggccgctctagaactagtggatcccccgggctgcaggaattcgtctcacccctagaaaaaatccactctcagcatcaccagctaagaacaggtcttcgtctcaataatggaaggcaaaacagggcagctcaggtgctgtttcgtcgccatcgtgctcgtcctgggtcttgtccttgagcagtcccagcaggctgaagctagaggcaaatggtgctgcaaaaccgccaccggaaaataccattttaatcgctgcgttgactcgggttgggtcgacaatattgggttctgtgcgagtaatgccggttgcatcattatggaggacagatgtggaggtcgttggccagtgcctgctcgtgatgcgctttctctggatgtcatttgattaattataagcaagtacgtgaaattaagaaacgagggccagacgactgtcgtccagcgattggttatttgtgaacttgacatttgtcttcttatttcaactttccaaaaggccccttcgtggaaacgtgtccctccccttcaaagtttggcgacctgttgcgaaatcaaatccatttaggcaaataaagaccgcgcccgtacctggtattaaaaaaaaaaaaaaaaaccgaagcccttcggaggttccccaattctcccctag

SEQ ID NO: 58342 - protein, 91 aa, Zea mays
  misc_feature: Ceres CLONE 1511471
MEGKTGQLRCCFVAIVLVLGLVLEQSQQAEARGKWCCKTATGKYHFNRCVDSGWVDNIGFCASNAGCIIMEDRCGGRWPVPARDALSLDVI

SEQ ID NO: 58343 - DNA, 657 bp, Zea mays
  misc_feature: Ceres CLONE 1511472
  misc_feature: Encodes the peptide sequence at SEQ ID NO. 58344
tggagctccccgcggtggcggccgctctagactagtggatcccccgggctgcaggaattcgtctcacccctagaaaaagtgctttcttagaggtgggttggcttctcctccccctccggttcgggttcgggttcgtgaggttctccggggttcggtttcgtgggtgagcggatccagatggcggcgtcggatgttgagtaccgctgcttcgtcggcggcctcccctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgaggggatgaacggcaaggagctggacggccgcaacatcaccgtcaacgaggcccagtcccgctgcggccgtggaggcggccgcggtgggtacagtggtggccgtggacgctgcggctacggcccgtgcaggcgccctgatggcggcggcggttaccgcagtggcaggtggtggctacggtggcggcggcggctatcgtggtggttggcggcggctaccgccggggcaaaccgtggcgggggcttcggcaatttccaagtggaacttggaggaaactgaccg

SEQ ID NO: 58344 - protein, 158 aa, Zea mays
  misc_feature: Ceres CLONE 1511472
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAASDVEYRCFVGGLPWATDDHSLHNAFSTYGEVLESKIILDRETQRSRGFGFVTFSTEEAMRNAIEGMNGKELDGRNITVNEAQSRCGRGGGRGGYSGGRGRCGYGPCRRPDGGGGYRSGRWWLRWRRRLSWWLAAATAGANRGGGFGNFQVELGGN

SEQ ID NO: 58345 - DNA, 672 bp, Zea mays
  misc_feature: Ceres CLONE 1511477
  misc_feature: Pfam Name: DUF786 Pfam Description: Protein of unknown function (DUF786)
  misc_feature (419)..(419): n is a, c, t, g, unknown, or other
tggagctccccgcggtggcggccgctctagaactagtggatcccccgggctgcaggaattcgtctcacccctagaaaaaaacactgtccggaaggaccttttctcgtttttttctctcgctagcaccttgcctccttgcgatttgcgagcgccgcatcgacccccaccgccgacgaacgccgcgccgccgacgtcctgccttctcctcgacggcgagcgccgttccactgtaccctccgtgattccgccccagcctctgcgtccgaatctcccgcgaaacattcacggcgatggcggcggccggtggcgtttcacctgaccatgtcccgatcctgcacgcatagaacctcaccagcaacgtcaagtccgtctactacagtcgaacattcttgtcaatcattggtggagctgctgctggnatctggtgactcacaggcgtgatggcgtttgtcctcgacttctgataatgatggttgcatctatagcgcatctagcgaagtcaaggttttcagtccggggctacttcgattgctggacaaccatttccagtggaaggagtttctgggcgccctgagggcattccggctggttttggacatttgctttagacctgggtgcaatccttccggcgaacttaaaaaaaccttcctcccgggaggaaaaccggaatct

SEQ ID NO: 58346 - DNA, 764 bp, Zea mays
  misc_feature: Ceres CLONE 1511482
  misc_feature: Encodes the peptide sequence at SEQ ID NO. 58347
acccctggagctccccgcggtggcggccgctctagaactagtggatcccccgggctgcaggaattcgtctcacccctagaaaaatttcttgtgcctgcttaatgctgggctatccgccggtctcttgctctgatagcttgctccaggacgtacgtacgtacgtagatcgatccatcgatcgctagctagctgacgaccatggcgtccctctcctctgccgccatcaccgccccttccttcacggccgcgcccgctcgcgcagtggtcagcaggaggtccttcaccgtgcgtgcctctctccgcaaggccactgccaccgccgccgtgggcgttgccgccagcgtcctgcttgccggttttggccccccgccccgggggggggggggtgggctcaggcaacggctggctccccttccagccccgcccagttacccgtcaagggccggggacaccctccacctttaagaaaaaactcccggttccccccaaaaacgtctgtgtttcacaaaaaaaaaaggggccccaaggggcgttccaacgcccccccaaaatttctcccgggggggaagtaccccctaagcccgcccgagggggagacacaaatccccgctctccccccacacgggggggcgcgggacccctcgcgggggttatatttagtgtgcgggccccgtaccccccgaggaggtaggggtaaaggggctcgcgcgccaataaccgaggtgttctcgaccgctaataaaggatccatagattgccgaaga

SEQ ID NO: 58347 - protein, 88 aa, Zea mays
  misc_feature: Ceres CLONE 1511482
MASLSSAAITAPSFTAAPARAVVSRRSFTVRASLRKATATAAVGVAASVLLAGFGPPPRGGGGGLRQRLAPLPAPPSYPSRAGDTLHL

SEQ ID NO: 58348 - DNA, 626 bp, Zea mays
  misc_feature: Ceres CLONE 1511490
  misc_feature: Encodes the peptide sequence at SEQ ID NO. 58349
ggagctccccgcggtggcggccgctctagaactagtggatcccccgggctgcaggaattcgtctcacccctagaaaaaatccatcgattgtactacctaaaatagctgggccgtccgcaccaatctcgtagtgttctaaagtttccagacccccagaaggcgtagcggggatcatctccttgggaggcggggacaacttgaaggtgatgcctgcgaccaaatgggagtcgcggtcgctccaaggctgagcttcagttcgccgtaaggtcaatgtagcggtatctgcaagccgggaaatatgacgagctcttcaaactccaggacacccgtgtgcctctccgctattctctagcttctcaccgactaggaggtcatgctggcctctaacggtgctcaggtccccgataataaccgtatcgtgccactccacatccagctggttctgctgaaccacgaggagctcaccgagctgctgaggactgcgaggatcgcttccggtggcctgatgcctaacatgcataagacggtgctggccacgattgctggtcagaacgggacatctgctctgcctccgactatttctaatcgtctcagatgatgacgatagtgaacctcccctgtttctg

SEQ ID NO: 58349 - protein, 74 aa, Zea mays
  misc_feature: Ceres CLONE 1511490
MLASNGAQVPDNNRIVPLHIQLVLLNHEELTELLRTARIASGGLMPNMHKTVLATIAGQNGTSALPPTISNRLR

SEQ ID NO: 58350 - DNA, 642 bp, Zea mays
  misc_feature: Ceres CLONE 1511493
  misc_feature: Encodes the peptide sequence at SEQ ID NO. 58351
aaagctggagctcaccgcggtggcggccgctctagaactagtggatcccccgggctgcaggaattcgtctcacccctagaaaaagcagtccttctccacctagctcccccgcgccaagaacacgccagctagcaagcgcgctcgatcgaataccgttaccgtgtcgccatggccgccaccgcgtctctatcagccgtcggggcgccgctgtcggtgcccgggctcaggaagccgctcggcgtgtcgtcgctccggcccctgcagccgagggcggccaggatgacgacgacggccgtgcgggcgtcggcgtcgacctcgctccacgtccatcaaggagaaggctgcggtcgggctgaccgcggcggccctggcagccgcgctggtgctgccggacgtctcgtaggccgcacagtccggcgggctcacgccgtcgctcatgaacttcctcctcagcatcgtgtccggaggagtcgtgctcgttggtattgacggcgccgacgtcgccgtctacaacttcgaccacgtcaagagggcctgatcggaatccatcgtatcaatcgtctcgcctgtgccctgacctgtgcctgtgctgtctgtatcgactggtggtgctctatcccctgtgtgttaattgcattagga

SEQ ID NO: 58351 - protein, 33 aa, Zea mays
  misc_feature: Ceres CLONE 1511493
MNFLLSIVSGGVVLVGIDGADVAVYNFDHVKRA

SEQ ID NO: 58352 - DNA, 649 bp, Zea mays
  misc_feature: Ceres CLONE 1511498
ccccgcggtggcggccgctctagaactagtggatcccccgggctgcaggaattcgtctcacccctagaaaaaaccgctccctctgcccgcaccgttcaaacctcctcgagcatggacgcaccttattgcacccttggcgctgctcgccttccggggcatgggcatgtcgaccgccgcatcaggccctcccatgtcatgaccaccgtgccgtctcgtcataggtaaccaccgccacctacacccccacctcctccgccgccatcacccgcaacggaacggtctgcatgctctgcaactgtctccgctgccgccgcacgtcaatgctcctgacctctgctgacctacaggagacaatgctacgataacgcgcactgggatcagactgacacatggcaatggagcgccctgccctgctctgaaggcactgcggctgcgcggatcatagctcctccagcgtccgtccgtgaatgctcctctctatgaagaggagagcagttagtgcgaaattgacgaggactctctagcattacggggaccgaaatctgacgtgccttatatgtgaccagagctgagatgttcaactatgtaccggctcaaatactacatatttcaagtcactctttccacccctatcaccctctcaagaaag

SEQ ID NO: 58353 - DNA, 660 bp, Zea mays
  misc_feature: Ceres CLONE 1511499
  misc_feature: Encodes the peptide sequence at SEQ ID NO. 58354
ggagctccccgcggtggcggccgctctagaactagtggatcccccgggctgcaggaattcgtctcacccctagaaaaatagaggcgtctaaagcatccaaggggctagccatagcggccgttcaagcgatgcacgacagcaatgacgcacgaagcgctggtgcttctcctcgaggagtaacgcttcctataagcgagtaccatgctcttagcaagagggttcacgaagccgaggaacttgcgagcgagagggtggcagccgcgtttgcacaaatagagttggcaaaagagtccgaatcaaggaacctagagaggctgcaagaagcatccaaggagatggatgaaaagaagagtgatctccaaatcgcgctggagagggctgagagtgcaaacgaggggaagctcggtgctgagcaggagctgagaagatggagagctgaacatgtgcagcgccggaaagcccacgaggctacacaacatccagtcagtcctgtgagaactccaccgaggatgcttgtcgagcagaagggctcttaccgggaagaaaatgaacttcccacaaatccgaagttgcacaagtcaaatggtagtatgaatcaagttggttccagtgagaaatcgcggaaaaaagagtcgttcttccccccgaagtccacacttt

SEQ ID NO: 58354 - protein, 177 aa, Zea mays
  misc_feature: Ceres CLONE 1511499
MHDSNDARSAGASPRGVTLPISEYHALSKRVHEAEELASERVAAAFAQIELAKESESRNLERLQEASKEMDEKKSDLQIALERAESANEGKLGAEQELRRWRAEHVQRRKAHEATQHPVSPVRTPPRMLVEQKGSYREENELPTNPKLHKSNGSMNQVGSSEKSRKKESFFPPKSTL

SEQ ID NO: 58355 - DNA, 679 bp, Zea mays
  misc_feature: Ceres CLONE 1511500
  misc_feature (209)..(209): n is a, c, t, g, unknown, or other
  misc_feature (213)..(213): n is a, c, t, g, unknown, or other
  misc_feature (221)..(221): n is a, c, t, g, unknown, or other
  misc_feature (222)..(222): n is a, c, t, g, unknown, or other
  misc_feature (237)..(237): n is a, c, t, g, unknown, or other
  misc_feature (238)..(238): n is a, c, t, g, unknown, or other
  misc_feature (395)..(395): n is a, c, t, g, unknown, or other
  misc_feature (396)..(396): n is a, c, t, g, unknown, or other
  misc_feature (489)..(489): n is a, c, t, g, unknown, or other
  misc_feature (492)..(492): n is a, c, t, g, unknown, or other
  misc_feature (538)..(538): n is a, c, t, g, unknown, or other
  misc_feature (596)..(596): n is a, c, t, g, unknown, or other
  misc_feature (679)..(679): n is a, c, t, g, unknown, or other
atagctggagctccccgcggtggcggccgctctagaactagtggatcccccgggctgcaggaattcgtctcacccctagaaaaaggtttcttcggaggctttatttatcgtttatccacggaacttccggtgccggcggcgaccacttgtggcgatccatccctcaccatgtcgtcggagaaggaggcggcgctcgccgccgtgctcgnatgntacagccnncaaccatatttgacnnaagatcatcaaaaaggaaataccttctactgtggttttttaaagaacaaaaaggtctgggttttttggggaataaaaacccccaagttcccaaaaacaattttttttttttttccccccaaaaatggagggggtgagtataatatcccccccgcccnngggggggaaaaggcccccccaaaaaaaaggggggccccccccccctcggtgtttaaaagggtgtgtgtgaaacccccagagaggggagaacantanaaaaggagggggtttgcccccccccctctaaaaataaacccccccntgtggggagaggaaaatttttttttttttataaaaccccctctttcttcttttcttcnggggcgcccggaggaataaaaaaaatccccccctgcgccctaaaaaacaaaaaaaaataatttggttgttttttctccccccn

SEQ ID NO: 58356 - DNA, 635 bp, Zea mays
  misc_feature: Ceres CLONE 1511502
  misc_feature: Encodes the peptide sequence at SEQ ID NO. 58357
tggagctccccgcggtggcggccgctctagaactagtggatcccccgggctgcaggaattcgtctcacccctagaaaaaaccgcttacctccgcgcactgcacacgttcgacgaaatgccgccgcgagccctcttcgtcgtcaactgagatttgcctcacatcatctccgattccttcccctacttccgtccccatcagtggacccagccgagatcgactggatctcctggctcgggcggctttgatggttcctggggtcggcccggggaggagttcgaggcgatgagcaggcttgcgtcggggctccagcgcccgcggaggtcgttgtcgccgtgcgaggtgctgtggtgcgcgctcgcgtcatgcggcctagtgcttttctcgcagctcgccgtggcgatggttccccgcctcttcccttccctctatctcctcgccatgctccccatcgcggggctggtgttactcgcggctatcgtgctcggccgcctgtggaggaggttcatcggagtgacggcgtcggcgccgctcttcgtgctcttcaacatcctcctatcgtggggcgtttacatcttcgtaatccgtagaagtgagctcttgtggtaatgcttgcggacttgcactgtattggtag

SEQ ID NO: 58357 - protein, 107 aa, Zea mays
  misc_feature: Ceres CLONE 1511502
MSRLASGLQRPRRSLSPCEVLWCALASCGLVLFSQLAVAMVPRLFPSLYLLAMLPIAGLVLLAAIVLGRLWRRFIGVTASAPLFVLFNILLSWGVYIFVIRRSELLW

SEQ ID NO: 58358 - DNA, 626 bp, Zea mays
  misc_feature: Ceres CLONE 1511506
  misc_feature: Encodes the peptide sequence at SEQ ID NO. 58359
agtggatcccccgggctgcaggaattcgtctcacccctagaaaaagtgctttcttagaggtgggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgccacatcgccgtcaacgaggcccagtcccgcggcggccgtggaggcggcggcggtgggtactgtggtggccgtggaggcggcggctacggcggtggcgggcgccgtgatggcggtggcggctacggcggtggcggcggctacagtggctgctgcagctaccgttggtggtggcggcggcctacggccgtggcaaccgtggcggcgggctacggcaactccctacggggaccttggaggaacttgagcggggg

SEQ ID NO: 58359 - protein, 160 aa, Zea mays
  misc_feature: Ceres CLONE 1511506
  misc_feature (10)..(81): Pfam Name: RRM_1 Pfam Description: RNA recognition motif. (a.k.a. RRM, RBD, or RNP domain)
  misc_feature (48)..(128): Pfam Name: GRP Pfam Description: Glycine rich protein family
  misc_feature: SWISSPROT Homolog: EC 5.2.1.8 Peptidylprolyl isomerase
MAASDVEYRCFVGGLAWATDDHSLHNAFSTYGEVLESKIILDRETQRSRGFGFVTFSTEEAMRNAIEGMNGKELDGRHIAVNEAQSRGGRGGGGGGYCGGRGGGGYGGGGRRDGGGGYGGGGGYSGCCSYRWWWRRPTAVATVAAGYGNSLRGPWRNLSG

SEQ ID NO: 58360 - DNA, 652 bp, Zea mays
  misc_feature: Ceres CLONE 1511508
  misc_feature: Encodes the peptide sequence at SEQ ID NO. 58361
  misc_feature (652)..(652): n is a, c, t, g, unknown, or other
agctccccgcggtggcggccgctctagaactagtggatcccccgggctgcaggaattcgtctcacccctagaaaaaaccaacaacccccaacagcgccactgtccagtgcgcgcgtcaagcttgcttagctagccgccatggcctccctcgccgccgtctccgtgaagcccgtgaccatcaagggtctcaccggcagctccatctccggaaggaagctcgccgtcgccaggccgtcggcccgctccatccgcaggccccgcgcagccgccgtggtggccaagtacggcgacaagagcgtctactttgacctctacgacatcggcaacaccaccggacagtgggacctctacggctctgacacgccctcgacctacaacccgctacagagcaagttcttcgagacgttcgcggctccgatcaccaagagaggtctgctgctcaagttcctgctgctgggaggcggctcacttctggcctacatcagcgcgtcggcgtcaccggacctcctgacgatcaagaagggacctcaggagccgacgtcaccggtcccgcgcggcaagatctaagctcagcttctccatttgcatggtctagtagcttgctttgtactgctagcgccggtcgatccgtcgcaatcgtcatggatcatcn

SEQ ID NO: 58361 - protein, 142 aa, Zea mays
  misc_feature: Ceres CLONE 1511508
  misc_feature (5)..(142): Pfam Name: PSI_PsaH Pfam Description: Photosystem I reaction centre subunit VI
MASLAAVSVKPVTIKGLTGSSISGRKLAVARPSARSIRRPRAAAVVAKYGDKSVYFDLYDIGNTTGQWDLYGSDTPSTYNPLQSKFFETFAAPITKRGLLLKFLLLGGGSLLAYISASASPDLLTIKKGPQEPTSPVPRGKI

SEQ ID NO: 58362 - DNA, 529 bp, Zea mays
  misc_feature: Ceres CLONE 1511511
  misc_feature: Encodes the peptide sequence at SEQ ID NO. 58363
atagctggagctccccgcggtggcggccgctctagaactagtggatcccccgggctgcaggaattcgtctcacccctagaaaaaaggccaccaaaggtatcttgcaatcacaacgaacaaaagctctcgatctcaccgacaccgaggaagaagagatcaatggcgtccgagcagggagtcgtgatcgcgtgccacagcaaggctgagtttgacgcccacatgaccaaggcccaggaagccggcaagctggtggtcatcgacttcactgccgcctggtgcggtccatgccgcgccatcgccccactgttcgtcgaacacgcccaagaagtcactcaggtcgtcttctgaaagtgacgtgacgagtgaagagtcacgcgcctacgagtcgagcatgcgaacttcacctcgcagaaggcagacggtccgacatccgggtgccagaaagaaaacccctggcccgatcaaaaaaatgccggcctggcccgggaaagggttggccaaaaagaaacaaaaaagccgcccccccaaa

SEQ ID NO: 58363 - protein, 62 aa, Zea mays
  misc_feature: Ceres CLONE 1511511
  misc_feature: SWISSPROT Homolog: EC 1.8.1.8 Protein-disulfide reductase
MASEQGVVIACHSKAEFDAHMTKAQEAGKLVVIDFTAAWCGPCRAIAPLFVEHAQEVTQVVF

SEQ ID NO: 58364 - DNA, 664 bp, Zea mays
  misc_feature: Ceres CLONE 1511521
  misc_feature: Encodes the peptide sequence at SEQ ID NO. 58365
  misc_feature (344)..(344): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (432)..(432): n is a, c, t, g, unknown, or other
  misc_feature (433)..(433): n is a, c, t, g, unknown, or other
  misc_feature (442)..(442): n is a, c, t, g, unknown, or other
  misc_feature (444)..(444): n is a, c, t, g, unknown, or other
  misc_feature (445)..(445): n is a, c, t, g, unknown, or other
  misc_feature (462)..(462): n is a, c, t, g, unknown, or other
  misc_feature (488)..(488): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (522)..(522): n is a, c, t, g, unknown, or other
  misc_feature (523)..(523): n is a, c, t, g, unknown, or other
  misc_feature (535)..(535): n is a, c, t, g, unknown, or other
  misc_feature (537)..(537): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (594)..(594): n is a, c, t, g, unknown, or other
  misc_feature (595)..(595): n is a, c, t, g, unknown, or other
  misc_feature (605)..(605): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (655)..(655): n is a, c, t, g, unknown, or other
aaagctggagctccccgcggtggcggccgctctagaactagtggatcccccgggctgcaggaattcgtctcacccctagaaaaaaacagcctcccgaatccccaaagcctccgacccccttactctctccctccgccgccgctgcgcacgtcagggaacaagcaacatgggcgtctacaccatcatgtgccgcaacaacggcggcgagtggaccgccaagcagcactccggcgagatcgaggcttccgccgctgccccatatgagctgcagcgccgtctcgtcgccgcttcctccgcgaccgactctgcctacggcatccagtcgaggttctcctgggccaccnccagctccgccgcgtcccatgcgaccgcccgcgctgatcgagcaggtacaatggtgataagccgnnntgacaacagagcgtctaggtnnggtgaatcngnnccccacgcatccacggnccacactaacgcaaaactaaaggggngnnngcaactactacttagaatcctcccctatcnncaacaaattctngntctcctcccagaacccacccaagtggcatgacggggggccggnnngccataatcctnntaacgaaggnacccggctccctatacacattcaattaannnnngggnnnnnngtgtttgnaaaacccag

SEQ ID NO: 58365 - protein, 133 aa, Zea mays
  misc_feature: Ceres CLONE 1511521
  misc_feature (60)..(60): Xaa is any aa, unknown, or other
  misc_feature (82)..(82): Xaa is any aa, unknown, or other
  misc_feature (89)..(89): Xaa is any aa, unknown, or other
  misc_feature (93)..(93): Xaa is any aa, unknown, or other
  misc_feature (99)..(99): Xaa is any aa, unknown, or other
  misc_feature (108)..(108): Xaa is any aa, unknown, or other
  misc_feature (109)..(109): Xaa is any aa, unknown, or other
  misc_feature (119)..(119): Xaa is any aa, unknown, or other
  misc_feature (124)..(124): Xaa is any aa, unknown, or other
MGVYTIMCRNNGGEWTAKQHSGEIEASAAAPYELQRRLVAASSATDSAYGIQSRFSWATXSSAASHATARADRAGTMVISRXDNRASRXGESXPHASTXHTNAKLKGXXQLLLRILPYXQQILXLLPEPTQVA

SEQ ID NO: 58366 - DNA, 638 bp, Zea mays
  misc_feature: Ceres CLONE 1511523
  misc_feature: Encodes the peptide sequence at SEQ ID NO. 58367
ggctgcaggaattcgtctcacccctagaaaaatcgcctagctgttgctggcgctttccatactagcttcatgaaacccgctgtttcaagattggaatctgcgttggctgccactgagattaaaacacctacaattccggtcatctccaatgttgatgcgcacccccactcagatcctaacaccatcaagcagattttagctcaacacgtaacctctccggtgcaatgggaaaccactgttaagaatcttatgggcaaggggcttgagataagttatgaactccgacctggaaaggttatagcaggtattctcaagaggatcaacaaaggcactatcattgagaacatcggggcttaaacgtctgggatctgaataactcttgatggaaccaagttacacaacacacgatttgaaacatgccattatagtggaacgatgtttccactcagagttaccggtttttttaccataacgggtagaatttctgatcttgatggaaaattgaacatgaaacacatgggttaatgattttatgaaacagtggaaagtattcacacgcctacaagaaaaaataaaaaaaccgagaatgttcggagggtaccccaaattccccgcttaataggggagatccattataa

SEQ ID NO: 58367 - protein, 95 aa, Zea mays
  misc_feature: Ceres CLONE 1511523
  misc_feature: SWISSPROT Homolog: EC 2.3.1.39 [Acyl-carrier-protein] S-malonyltransferase
MKPAVSRLESALAATEIKTPTIPVISNVDAHPHSDPNTIKQILAQHVTSPVQWETTVKNLMGKGLEISYELRPGKVIAGILKRINKGTIIENIGA

SEQ ID NO: 58368 - DNA, 651 bp, Zea mays
  misc_feature: Ceres CLONE 1511525
  misc_feature (611)..(611): n is a, c, t, g, unknown, or other
ggagctccccgcggtggcggccgctctagaactagtggatcccccgggctgcaggaattcgtctcacccctagaaaaagtaccaggacggcgtctccagggagctggcgcacgcctgaagaccctgatccatccatgtctgtccaccacgctatgtacgtatgtgtagcagatggtttacatctacgtgttagaccaactccagcagcactccgcatgcggctccggatccctattttgcggagcctagctcactattcatcagtccagcaggctccgcatccggctccgtaaaacgcacggcctgtacctgcactccccatttccacgctttctctctcctctccgcagctctctgcgtgcgcgcgcggctgctcgcgggccccaggtgtcatagactgcatgcggagtgggatgtggagtgttgctggaaacggagacggatacggagaggagagagaaactgttggccgcgcgttttagggatacggagagggagtctgctggagttggtcttagagcccggagagctggagaagctagctagcgtgcttacagaataacagcagccaagcaaagccaagggtgtgtatataatagacatagccttgngttgtgtcagctgcgactggtatgtatagtttaaacgaaa

SEQ ID NO: 58369 - DNA, 601 bp, Zea mays
  misc_feature: Ceres CLONE 1511527
  misc_feature: Encodes the peptide sequence at SEQ ID NO. 58370
agtggatcccccgggctgcaggaattcgtctcacccctagaaaaaagacccttctcttcatcttcactctcctggtttattcctccgtgccgatctcgtcttctccggcgggaccatggcgccgtcctcctcccgattcgacgatccggcggcggtgaggcgccccccgcagcatgaacggaagccgccgtatatgttgcttctcccgctcgtctacgcccccgtcctccccctcatcaggatcgggctgcggcacaatcccgtagtgagggaccgtctcttctacggcgtcctcgccggcgcattcgcccacggcgcctacctcatatcggaactgtatgatgtggagagcaaatgatgggcatccctcgaaggatgaggggattagttttcaggtagcaaaatttgattccatcggggattccagattgttggatgaaagctgacatggcaattcagactaactagtgtgctatggacccataatgttttcctttgggcttgctaattatggttgggcaaaaaggagggaaatggtttgaagcaaataaaaggtaatttcccagatttggagaaaaaattttttccagccaaattggag

SEQ ID NO: 58370 - protein, 80 aa, Zea mays; identical to SEQ ID NO: 9524
  misc_feature: Ceres CLONE 1511527

SEQ ID NO: 58371 - DNA, 667 bp, Zea mays
  misc_feature: Ceres CLONE 1511530
  misc_feature: Encodes the peptide sequence at SEQ ID NO. 58372
tggagctccccgcggtggcggccgctctagaactagtggatcccccgggctgcaggaattcgtctcacccctagaaaaagccctcccttttacgcggttacccctaactcccagctccctcgttcaggcgcgctctctctagccggcgacgattgggcgagcggcgccactcaacgccaggtcttcgtgaaaaccatcgccggcgatgagtttcaaccagtctactgtcaaggggcaggccaggagggagaggcctagggctcgccctcatggcctgacgcagcagaggaggcaggaaataaaggaagcctttgatctgtttgatacagataactctggaaccattgatgcaaaagagctcaatgttgccatgagagccttgggatttgagatgactgaagagcaaattacgcaaatgattgctgatgttgacaaagatggcagtggagcgatcgactacgaggagtttgagcacatgatgactgccaaaatcggagagagggatagtaaagaggagctttcaaaagcatttcgcattattgatcaagatggaaatggaaagatttctaacatttgatatccagaggattgcccaaagagctgggtggaaaatctcaccctccgatgagatcccagaacttggtggcaagaggcctgataaaaaatg

SEQ ID NO: 58372 - protein, 123 aa, Zea mays
  misc_feature: Ceres CLONE 1511530
  misc_feature (31)..(59): Pfam Name: efhand Pfam Description: EF hand
  misc_feature (67)..(95): Pfam Name: efhand Pfam Description: EF hand
  misc_feature: SWISSPROT Homolog: EC 2.7.11.1 Non-specific serine/threonine protein kinase
MSFNQSTVKGQARRERPRARPHGLTQQRRQEIKEAFDLFDTDNSGTIDAKELNVAMRALGFEMTEEQITQMIADVDKDGSGAIDYEEFEHMMTAKIGERDSKEELSKAFRIIDQDGNGKISNI

SEQ ID NO: 58373 - DNA, 612 bp, Zea mays
  misc_feature: Ceres CLONE 1511532
  misc_feature (35)..(35): n is a, c, t, g, unknown, or other
  misc_feature (54)..(54): n is a, c, t, g, unknown, or other
  misc_feature (78)..(78): n is a, c, t, g, unknown, or other
  misc_feature (82)..(82): n is a, c, t, g, unknown, or other
  misc_feature (83)..(83): n is a, c, t, g, unknown, or other
  misc_feature (612)..(612): n is a, c, t, g, unknown, or other
cttgctggagctcaccgcggtggcggccgctctanaactagtggatcccccggngctgcaggaaattcgtctcacccnctanngaaaaaaagacagcccgtcagcccctctcgtttttatccgccttcgcctcaaccgcgtgcgctccacgcctcctccaggaaagcgagagcttctgcataagaacaacaaatcaaaagcttgatcagctcggtgccaacaaaacctcaacaaccaagtttcatgtctgatctcgacgtccagcttccatctggcctttgatccgttttgctgacccaaatggcagaaagacccctgggtgcttgttcccttgttaccgaagggaatgtggttgaaatgttggggcttcccttttttttttttcccccccccccccgagggggggggggggggggggccttttttccttaaaaaaaaaaaatccccgccctttgagaggggttcccccaaaaggaatccggcaaccacgggatttctcgggcgcgcagggggtccccctgtattttccgggacccacaagaatacacggcccaatttactcttcgtctccccgaggggggaactccccgcgcgcaatattgtttctccccn

SEQ ID NO: 58374 - DNA, 624 bp, Zea mays
  misc_feature: Ceres CLONE 1511545
  misc_feature: Encodes the peptide sequence at SEQ ID NO. 58375
ctggagctccccgcggtggcggccgctctagaactagtggatcccccgggctgcaggaattcgtctcacccctagaaaaaagattcgcatattctcgcgatgggagcggaggaagcagagggtactcccccgccgctgcccgccaccggcgagcccgcaaccacggcaagggcgcagccaatatctgcagcacaattcctctcctggaagcagcgcaagtaggatgcagaggtagccgtaaggaaagctgaagcagctcagaagcgagctgatgatatcgcttcgggagcggtgcagatgaacggccgcgagctgttccaacaagagccctgggtgtttgacaaccacatttactgagatcgtgtcgggctactgttcctgcattagtccaagctccagcggtggtttcattttgtactgctatatcagctttgcggaactgtggattttatttcaccgtttataagattattctctcaataggtatttgaacttgtttcaaatacgttttgccaaatctttgtgcagtcaccgaatgatatctagtgtcgctattctttttctaaactcttacaaacaaagagtattggtcggaagaaataaaaaaaaaaaacgagacgctcg

SEQ ID NO: 58375 - protein, 40 aa, Zea mays
  misc_feature: Ceres CLONE 1511545
MGAEEAEGTPPPLPATGEPATTARAQPISAAQFLSWKQRK

SEQ ID NO: 58376 - DNA, 642 bp, Zea mays
  misc_feature: Ceres CLONE 1511546
  misc_feature: SWISSPROT Homolog: EC 2.7.7.49 RNA-directed DNA polymerase
cgcggtggcggccgctctagaactagtggatcccccgggctgcaggaattcgtctcacccctagaaaaaaaactagaaaaaagccttctactgtcttaggagcaaatttagattttctacctcttttaacaaaaataaagcatttgctaccaaagactctaaaatatgaaatgttgggctttttaccggttagaagttcgtatgatgtcttcttgaggattcggtgtagatacaaccggttgatggcgtagcaggcggtgttgaccgcctcggcccaaaaccgatccggcgtcttgtactcatcaagcatggttcttgtcatgtccaatagagttatattctttctctccactacaccattttgttgttgtaaagcccaaattttatataagggaaaagagaaagagaaggaaaatactatataaggaaaataaatatataaataaatatattctttttataatagtatttgaatttgttcatttagattagatgtgaaactcacaatcaaatttgacttcaaatttgaactctaaatctgagaaataagaacatagaaaaacaaaaaaaaaaaaaaaacgagacgctcgaggtaccaattcgccctatagtgagtcgtaatacgcgcgctcactgggcgtc

SEQ ID NO: 58377 - DNA, 654 bp, Zea mays
  misc_feature: Ceres CLONE 1511547
  misc_feature: Translation starting site: 242
tccccgcggtggcggccgctctagaactagtggatcccccgggctgcaggaattcgtctcacccctagaaaaattgctcgttgcttctgcgtctccgacttcgtcccttcgtccccacgactaaccgataatccgccggcgttaacatgttggtttatcatgatctccaatctggcgacagagctcctgtaggattcattcccctatctcgacctcgacaacggcgtcctgtgctagggccatggaaactgtctcaccccacgtcctgttgatgtgcaccttgtggtccatccatccgacgaggatggtgaggactacagcgttgatgactcgcctgtcaatgtggttgatattgttgacacattccgtctacgggagcgacctccttttgaccagaaatcatttgtgtcttacatctcaacatacatcgacaatctcactgctgtgatggagccacacaaagcggatagagttcacaaagggtgaccagggtgcaatctgatttctccttaccacgctgatggacctctcatttttttgttgctgagtccatgaaggatgatgcgtctgtggtattcacctaataccaggatggtgcctctagcccgacatcccgctatttctcgcatggtcgtcaggagatcaactgctagg

SEQ ID NO: 58378 - DNA, 693 bp, Zea mays
  misc_feature: Ceres CLONE 1511549
  misc_feature (384)..(384): n is a, c, t, g, unknown, or other
  misc_feature (390)..(390): n is a, c, t, g, unknown, or other
acccgcggtggcggccgctctagaactagtggatcccccgggctgcaggaattcgtctcacccctagaaaaagtgggttgtggcctcctatccttgcacgcacacgcaaacgcatcccatcctgtcctcgcgttactactagttagttagagagacagagaggatcgatctgctggcggcgtctaagctggagaaaggcggcgccaccgccgagggcgacgagataggcatcgacccagcggcggagactccggagcagcgcaacaagttcctggtcctccgcctgtacgaggcgctcaacgcccgggaccacgtctccgtggagtcgctgctggcgccccgactggaattgttcccccccccccccggggggggagggggganaaaatnattcccccccctgacaacccacaccaccaacacaaccggaagtttccgcttcgggggccgcgtccgggaacccccctttccggtttagtcggggaacggggttcccccgaggggtacgaagaggggttttctaccggggggcccccgctgcccccttgggaaacccaaagggggggggtacctccagtcgccgccggaggttattccaaccgccgacgccctccgtgatcccgccggtcccgacacccaaccatcgggcgaccgatgtgtgttttttgtcactgtacccccgctggccccccg

SEQ ID NO: 58379 - DNA, 660 bp, Zea mays
  misc_feature: Ceres CLONE 1511554
  misc_feature: Encodes the peptide sequence at SEQ ID NO. 58380
acccgcggtggcggccgctctagaactagtggatcccccgggctgcaggaattcgtctcacccctagaaaaaagtcgcccacaaaaacccagtaactcgcatcttcctccgtgatccaagttctagcagcgcagcgctcggtttcggcaatgtcggggcgcggcaagggcggcaagggtctgggcaagggcggcgccaagcgccaccgcaaggtcctgcgcgacaacatccagggcatcaccaagccggcgatccggaggctggctaggaggggcggcgtcaagcgcatctccgggctcatctacgaggagacccgcggtgtgctcaagatctttctggagaacgtcatccgtgacgccgtcacctacaccgagcacgcccgccgcaagaccgtcaccgccatggatgtcgtctacgcgctcaagcgacagggccgcaccctctacggcttcggcggctaggtcgcttcctcatctggtggcgaactgcatctgtgtcggcggtggtcgtgttgtgtgcctaatctagtgtagtccgttctctatatcgtcgctgtgttctgtggtgtcttgtatcccatttcctgcaataccaacttgccattatcaatggaaaaccctcgttttcaaaaaaaaaaaaaaaacgagacgctcgaggtac

SEQ ID NO: 58380 - protein, 103 aa, Zea mays; identical to SEQ ID NO: 6459
  misc_feature: Ceres CLONE 1511554
  misc_feature (25)..(94): Pfam Name: Histone Pfam Description: Core histone H2A/H2B/H3/H4

SEQ ID NO: 58381 - DNA, 647 bp, Zea mays
  misc_feature: Ceres CLONE 1511558
  misc_feature: Encodes the peptide sequence at SEQ ID NO. 58382
  misc_feature (557)..(557): n is a, c, t, g, unknown, or other
gctctagaactagtggatcccccgggctgcaggaattcgtctcacccctagaaaaagatttttttcttactgaaattcagttggtgcagggagaaggccgagtggtggactggaccacagagccatgtcaagttccacaaattcaacagtggccacggagttgtcggtgtctgagaatagcagggaaattgagccgctaccttttgtgaatgacaaacatggaggcgtcatcattgagatgaagactccaatggatcctggagtgttttcagcttacttgaaagcagcgctggcaaaatggagggagcagggaataagaggtgtctggatcaaattacccatcaccctttccaaccttattccaacagttgtagatgaaggtttctggtaccatcatgcagaggaaacttacttgatgcttgcgtactggcttccaaatacaacacatacactaccagtaaacgcaacccaccgtgttggtgttggagcttttataatgaatgacaaaagagaggtcttggttgtacaagaaaagagtggtgtacttcgaggcctangtgtgtggaaatttccactggcgtagttgaaccgggggaagatattaacgttggagccaaaaaaaaaaaaaaaacgagacgctcgaggta

SEQ ID NO: 58382 - protein, 152 aa, Zea mays
  misc_feature: Ceres CLONE 1511558
  misc_feature (145)..(145): Xaa is any aa, unknown, or other
MSSSTNSTVATELSVSENSREIEPLPFVNDKHGGVIIEMKTPMDPGVFSAYLKAALAKWREQGIRGVWIKLPITLSNLIPTVVDEGFWYHHAEETYLMLAYWLPNTTHTLPVNATHRVGVGAFIMNDKREVLVVQEKSGVLRGLXVWKFPLA

SEQ ID NO: 58383 - DNA, 639 bp, Zea mays
  misc_feature: Ceres CLONE 1511563
  misc_feature: Encodes the peptide sequence at SEQ ID NO. 58384
  misc_feature (472)..(472): n is a, c, t, g, unknown, or other
ggcggccgctctagaactagtggatcccccgggctgcaggaattcgtctcacccctagaaaaatttgtgaacctcgccgccgcccgtcccctgccttcacgaacccgtcgccgcccgtcccctactcttcctcgtgcacccaccgtcgctcgtcccctcgtcttccttgcgctctcgccgtcgccgcctcctcaccctcacgcacttgaggccagctgcggaacgaggtcggacggcggagacgaggtcgaggtctgtgacctcctcaacttgcgcaagactgccgagactgcagggacaagctctttgctgcctcgtcagctgcttctcggatactaacaaatgggttctataattgagttgataaggaaacatttgaagcaggtgatacacaagggattttcatcaacaagtggccgccagaagaactgaaacatcaagatggcgtttgcttttaggtcatgccattcangagtacactgagactgttttattatgagactatgttttattatgatgcactgagactatgtttgtgtacactgagactatgttttattatgatgcactgagactgttttattaagcagtgtggagttctcagctgctggtctcatttttaaaaaaaaaaaaaacgag

SEQ ID NO: 58384 - protein, 29 aa, Zea mays
  misc_feature: Ceres CLONE 1511563
MGSIIELIRKHLKQVIHKGFSSTSGRQKN

SEQ ID NO: 58385 - DNA, 661 bp, Zea mays
  misc_feature: Ceres CLONE 1511565
  misc_feature: Encodes the peptide sequence at SEQ ID NO. 58386
  misc_feature (547)..(547): n is a, c, t, g, unknown, or other
  misc_feature (638)..(638): n is a, c, t, g, unknown, or other
ctccccgcggtggcggccgctctagaactagtggatcccccgggctgcaggaattcgtctcacccctagaaaaagccgccacttcccctccgagcctcagttcgcatccacgcgcgccgccgccgcctcgcagctcgacgctcaccgcgcagccatggcggaacagactgagaaggctttcctcaagcagccaaaggttttcctcagctcaaagaaatccggcaaaggtaagaagcctggcaagggcggcaaccgattctggaagagcattggccttggcttcaagactcccagggaagcaattgaagggacctacattgacaagaaatgcccattcactggaactgtttctatcacacgcagaattattgctggggacatgccccattgcttagatgaacagaactatcgttgttccccaggaacttacctcccctttggaaaagagattccagaagtaagaagaagaggcccctccaacatttcctggttgcgagtctccccaatggtttccgtggtggagaggaaggggaacccctgctcctcntttgggccaggtggagagaccccgtggtgaaaaaacggggggagggttcccggggggcggtaaaagcccggttccgggcatgggagccgcncagccggccgtgaaaagagaggg

SEQ ID NO: 58386 - protein, 140 aa, Zea mays
  misc_feature: Ceres CLONE 1511565
MAEQTEKAFLKQPKVFLSSKKSGKGKKPGKGGNRFWKSIGLGFKTPREAIEGTYIDKKCPFTGTVSITRRIIAGDMPHCLDEQNYRCSPGTYLPFGKEIPEVRRRGPSNISWLRVSPMVSVVERKGNPCSSFGPGGETPW

SEQ ID NO: 58387 - DNA, 660 bp, Zea mays
  misc_feature: Ceres CLONE 1511566
  misc_feature: Encodes the peptide sequence at SEQ ID NO. 58388
aaagctggagctcaccgcggtggcggccgctctagaactagtggatcccccgggctgcaggaattcgtctcacccctagaaaaagcttaaccgacccgaaccctcggcgcatttctcaagcacccttctttctctgtttcgtcttcatctcgctctcggtctcggttccatccggcctccgatccccaacagcaagaatcaccggccgcggcggcgatggtgtgcgctaagtgcgagaagaagctcgggaaggtgatcgtgcctgacaagtggaaggagggcgccagcaacaccaacgagagcggcggccgcaagatcaacgagaacaaactcctatccaagaagaacaggtggactccatatggaaacaccaaatgcataatctgcaagcaacaggtgcaccaggacgcaaaatattgccacacctgtgcttattcaaaaggagtgtgcgcaatgtgtgggaagcaagtgttggacaccaaactctacaaacaaagcaatgtgtgatcatagctttactaaactgctaataacgtgtatgaaatcttgtactcgccatacaatcaaggtattgataatagttaaccaaaaatttaaaaaaaaaaaaaaacggaaacgctcgaagtacccaattcgccctaaaagggagggggattaccg

SEQ ID NO: 58388 - protein, 96 aa, Zea mays
  misc_feature: Ceres CLONE 1511566
MVCAKCEKKLGKVIVPDKWKEGASNTNESGGRKINENKLLSKKNRWTPYGNTKCIICKQQVHQDAKYCHTCAYSKGVCAMCGKQVLDTKLYKQSNV

SEQ ID NO: 58389 - DNA, 621 bp, Zea mays
  misc_feature: Ceres CLONE 1511571
  misc_feature: Encodes the peptide sequence at SEQ ID NO. 58390
  misc_feature (575)..(575): n is a, c, t, g, unknown, or other
ggcggccgctctagactagtggatcccccgggctgcaggaattcgtctcacccctagaaaaaatctactgactagctcgccatggcctccctctcctctgcggccgtcaccgccccttccttcgacacaccagcgccagcccgcgccgtgctcataaggacgtccttcaccgtgcgcgcctctctccgcaaggtgaccggcatcgccgacgtgacaatggctgccagagccctgcttgccggctgtgccatgtcccaggacgtgctgctgggcgcaagcgaccgcgggatcgtcttcaagcccagccagttcaccgtatatgccggcgaccccatcacgttcaagagcaacggcggcttcccgcacaatgtcgtcttctaccaagacgatgtgccgattggagtccacgccactgagatctcacaggatgaatacctcaatgctccaggcgagacctactccgtcacctctcacgtgccgggaacctacggcttctactgcgagccgcatcaaggagccggagtgctcggacagatcaccgtcaactaattaagctagctatcgatcgatatcanatcatgtattagctgttgctgcctgctttgaactcctgcgatctgt

SEQ ID NO: 58390 - protein, 155 aa, Zea mays
  misc_feature: Ceres CLONE 1511571
  misc_feature (59)..(155): Pfam Name: Copper-bind Pfam Description: Copper binding proteins, plastocyanin/azurin family
MASLSSAAVTAPSFDTPAPARAVLIRTSFTVRASLRKVTGIADVTMAARALLAGCAMSQDVLLGASDRGIVFKPSQFTVYAGDPITFKSNGGFPHNVVFYQDDVPIGVHATEISQDEYLNAPGETYSVTSHVPGTYGFYCEPHQGAGVLGQITVN

SEQ ID NO: 58391 - DNA, 632 bp, Zea mays
  misc_feature: Ceres CLONE 1511572
  misc_feature: Encodes the peptide sequence at SEQ ID NO. 58392
  misc_feature (602)..(602): n is a, c, t, g, unknown, or other
aaagctggagctccccgcggtggcggccgctctagaactagtggatcccccgggctgcaggaattcgtctcacccctagaaaaactgaagtttctgcggcggcgtaagtaacggcggcgtgcttgtgatctcgatctcaacccctggctagctcggatccggacaaccggctatccacggaaccctgtcgaggaggaataccaccgagcccgaggaggagaacgttacccttggaccccctggccgtagaagatagtttgtctttggtgttgctcacatctttgcatccttctatgacaccttcattcctgcctctgattcgactgggatggagaccttggctctgatcactggtggcatgtgcgtgaatgctgatcatgatgagtcgtctccttatgctgctatgcttgctgcccaatatgttgcacagctttgcaagcatctcggtatctctgagctgcacattatgcttcgtgcccgtggaagttactggacctagacccctggacctggtgctcagcctgctctctgggctcttgcacgtgctgaggatgaaattagcaccattgaggatgttaccccggttcgcactgtcagcactnctacatgggtgcgtaggttgggtaaatagg

SEQ ID NO: 58392 - protein, 56 aa, Zea mays
  misc_feature: Ceres CLONE 1511572
METLALITGGMCVNADHDESSPYAAMLAAQYVAQLCKHLGISELHIMLRARGSYWT

SEQ ID NO: 58393 - DNA, 638 bp, Zea mays
  misc_feature: Ceres CLONE 1511583
  misc_feature: Encodes the peptide sequence at SEQ ID NO. 58394
acccgcggtggcggccgctctagaactagtggatcccccgggctgcaggaattcgtctcacccctagaaaaaaaaacattttatcttctttatcgctactccaagagtacccaatcaccgagccatggccatctcagtcactgccgtggccgccttgtccgctttctcggctcaaagaagcctcccgcagccgtaccgccagagggtcgtaacgttcatcgtcgtccggccggtgcgcgcgcaccgccggtttgtgggcgtggcggccagctcgccgcccacgccgccggatctcgcaaagaaggtgtccgagagcatcaagcaggcccaggagacgtgcgcagatgacccggtgagcggcgagtgcgtggcggcgtgggacgaagtggaggagctcagcgcggccgccagccacttgcgcgaccggcagaggggcgccgacccgctccgaggagtactgcaaggacaaccccgagaccgacgagtgccgcacgtacgaggactgaaacacgcgcgcgcgaggtttggatcgctgtcacttgatctagctagcagcttagctccgcgtgatggcgacatgtgtagacatgcaatggatcggggatgaatcctccgttgattcagtcctgctttgtggg

SEQ ID NO: 58394 - protein, 160 aa, Zea mays
  misc_feature: Ceres CLONE 1511583
  misc_feature (57)..(119): Pfam Name: CP12 Pfam Description: CP12 domain
MAISVTAVAALSAFSAQRSLPQPYRQRVVTFIVVRPVRAHRRFVGVAASSPPTPPDLAKKVSESIKQAQETCADDPVSGECVAAWDEVEELSAAASHLRDRQRGADPLRGVLQGQPRDRRVPHVRGLKHARARFGSLSLDLASSLAPRDGDMCRHAMDRG

SEQ ID NO: 58395 - DNA, 664 bp, Zea mays
  misc_feature: Ceres CLONE 1511585
tccccgcggtggcggccgctctagaactagtggatcccccgggctgcaggaattcgtctcacccctagaaaaatgaagttcgggtgtgcatgaggcccccgcatcttggcgacagcgatcttgtgctatcctagaacgaggaaaacaggtagctttcggattttccagtgccatgtttattgccatgagatactcgaacgtaacaggtggtgccatggatcagtgagagccatcatatttgctgctaaacatgtagcttataagttgagaaattcttttcctccataagtccccgttcggttaggctggaataagactaggaactattccaggtgaccaattgttatactacaaattatacagttatttcagctgggatccttcctggagtagattcctgaataaccgaacgggacctaaaagttctgtggtttaggcgaaagttacctcctacctctgttaattccccccctcccctctgtacctctgttacacaagtacatcactatttggcgatcttccttgactatctgaaagctggctagtgttaagattctgtgtatattcaggcgaccaggttcgtaataatgtcgatggctacttctgattttgaggttcggaatcgtgttgtcgatttcgagagttattttgtaaaaaaaaaaaa

SEQ ID NO: 58396 - DNA, 679 bp, Zea mays
  misc_feature: Ceres CLONE 1511588
  misc_feature: Encodes the peptide sequence at SEQ ID NO. 58397
tggagctcaccgcggtggcggccgctctagaactagtggatcccccgggctgcaggaattcgtctcacccctagaaaaaaccttgcgatcacatcgtcgtctatcctgccgctggcatcatgtgccaacgccatctgtgctctgctctcgcaactgaatgacacgcccgggcttctgccacagttgctatgccaaccatagccactatggcgctgctaaagcccgcccccaatgcagccgcgcgatctgacccttcaagcaggagaggcagcatctctctgaacgtccggagggtgcaggccgccgtcaacgttgccgagtacgagtccgcgatcgccaccctagccgccaccatcttcccggagcatggcctcgtcggccgaagctgcgacttactacgtcatggttacggttgcacgcaacctagggatttctacgggcaaagctgcttcaaggacttgggaaatgcccggccaaagagccgcgccacctaaataaagtcaggctgcccggtcgcaaaacccatcgaaagcttaatgctggtgccatcctggtttttgaccgcctggacaatttgtccgtatcctaaaagcgttttttgtgcttggtttatatacgcctcagggaccaactcccgctaagaaaaaaataaatatatgtggaaatttcctaggttatg

SEQ ID NO: 58397 - protein, 95 aa, Zea mays
  misc_feature: Ceres CLONE 1511588
MALLKPAPNAAARSDPSSRRGSISLNVRRVQAAVNVAEYESAIATLAATIFPEHGLVGRSCDLLRHGYGCTQPRDFYGQSCFKDLGNARPKSRAT

SEQ ID NO: 58398 - DNA, 653 bp, Zea mays
  misc_feature: Ceres CLONE 1511590
  misc_feature: Encodes the peptide sequence at SEQ ID NO. 58399
aaagctggagctccccgcggtggcggccgctctagaactagtggatcccccgggctgcaggaattcgtctcacccctagaaaaaagcgactcctcccacagtcccacttccactcccacccacccacacgcacggccgcaggcagcagcaccatgtggtcggcagcaacggcggcggcggcgcgcgcggtgtccgtgtccccagtcccggcgccttccctcctcagcggccggcgcggcgggtcgcggggcggccgggggtcggtgtcggtgcgcagcacggtgtgggacttcgtgggcggcgacctggtgcggccggacctgggcaagtggctggacgaacgtggagaagcacaaggcgctggccatctacccgccgcacgaaggcggctaccaaggccgctacctgaaccgcctccgttaccagggctacctacttcctcgacctctccccgcgggggctccgcgacccggaaaccacctccccaaggtcccaccccgtctgcccgcctagcctcggcaggcagccggtggcgcggtggtaccttcccgccggaagtggactacaggctcagcctgctgcacccggacgccaaaggccccgtcgtctggatcatcgaagccatagttctgtccaaagctgagctgcagttc

SEQ ID NO: 58399 - protein, 167 aa, Zea mays
  misc_feature: Ceres CLONE 1511590
MWSAATAAAARAVSVSPVPAPSLLSGRRGGSRGGRGSVSVRSTVWDFVGGDLVRPDLGKWLDERGEAQGAGHLPAARRRLPRPLPEPPPLPGLPTSSTSPRGGSATRKPPPQGPTPSARLASAGSRWRGGTFPPEVDYRLSLLHPDAKGPVVWIIEAIVLSKAELQF

SEQ ID NO: 58400 - DNA, 636 bp, Zea mays
  misc_feature: Ceres CLONE 1511591
  misc_feature: Encodes the peptide sequence at SEQ ID NO. 58401
ggagctccccgcggtggcggccgctctagaactagtggatcccccgggctgcaggaattcgtctcacccctagaaaaacctagaatccaccctgccgcctcaccgcctctctcaatctgataccgcagatccgtcgtccggtgagtggaagccgcacgaacccatggcctccggcgagcttgcctgcacctacgccgctctcatcctcagcgacgatggcatcgccatcaccgccgagaagatcgccacgatcgtgaaggcggccaacatcaaggtcgagtcctactggccggccctcttcgccaagctcctggagaagcgcaacgtcgaggacctcatcctctccgttggatctggtggcggagctgctccagttgctgctgccgcacctgctggtggtgctgcggctgctgctgccccggctgtcgaggagaaaaggaagaggcaaggaggagtctgatgacgacatgggcttcagcctgttcgactgaggagaccccccacccagccttaaccaatttcacttgtgctgtcaaagacaacttggccttaggtaaggccccaggctttggtacacctaaccaagttttgagttttttaaaaagggctttgggctgaacccaaccattttttgag

SEQ ID NO: 58401 - protein, 98 aa, Zea mays
  misc_feature: Ceres CLONE 1511591
  misc_feature (21)..(92): Pfam Name: Ribosomal_60s Pfam Description: 60s Acidic ribosomal protein
MASGELACTYAALILSDDGIAITAEKIATIVKAANIKVESYWPALFAKLLEKRNVEDLILSVGSGGGAAPVAAAAPAGGAAAAAAPAVEEKRKRQGGV

SEQ ID NO: 58402 - DNA, 669 bp, Zea mays
  misc_feature: Ceres CLONE 1511599
  misc_feature: Encodes the peptide sequence at SEQ ID NO. 58403
  misc_feature (236)..(236): n is a, c, t, g, unknown, or other
  misc_feature (253)..(253): n is a, c, t, g, unknown, or other
  misc_feature (374)..(374): n is a, c, t, g, unknown, or other
  misc_feature (377)..(377): n is a, c, t, g, unknown, or other
  misc_feature (378)..(378): n is a, c, t, g, unknown, or other
  misc_feature (379)..(379): n is a, c, t, g, unknown, or other
  misc_feature (380)..(380): n is a, c, t, g, unknown, or other
  misc_feature (389)..(389): n is a, c, t, g, unknown, or other
  misc_feature (391)..(391): n is a, c, t, g, unknown, or other
  misc_feature (394)..(394): n is a, c, t, g, unknown, or other
  misc_feature (450)..(450): n is a, c, t, g, unknown, or other
  misc_feature (453)..(453): n is a, c, t, g, unknown, or other
  misc_feature (454)..(454): n is a, c, t, g, unknown, or other
  misc_feature (460)..(460): n is a, c, t, g, unknown, or other
  misc_feature (588)..(588): n is a, c, t, g, unknown, or other
  misc_feature (617)..(617): n is a, c, t, g, unknown, or other
  misc_feature (669)..(669): n is a, c, t, g, unknown, or other
tggcggccgctctagaactagtggatcccccgggctgcaggaattcgtctcacccctaggaaaatggcgagcaccaacatggcgtcggccacctcgcggttcatgctggccgcgggcgtgcccactgccagtagcggcagcggccgcgtcagcttcgcctcggcgcccaaccggcttggcaggaggcttgtggtccgggccgatgaggagttcccggcagagccggcgcccacggnggaaggggagggcgccntggccaccaagcccaatgccgagaagccggcgccgatcgggcccaaaagggtttccaaggtgaagatcctgaggggggaagtctattgtttcccccccccccgcggggggaagaagggggnatnnnnatttctaananccntttacctgggggggggggcgaaaaaaacaaaggaaagtggggggggggggggcgcnccnnacttanccgttggaacaaaactccgaggggaaaaggagtgaggcgcatccggcataaaacccccgggcccgcggggaatcttcaaatgccggaaaaaagggggtgcggacttacgccaaaccccaccaaaaacncggtggtggaaattgtcgagagcccgcanccgtcggggggagtttaggtgggcggttcgcgcgaccggagacgcacaaaan

SEQ ID NO: 58403 - protein, 143 aa, Zea mays
  misc_feature: Ceres CLONE 1511599
  misc_feature (58)..(58): Xaa is any aa, unknown, or other
  misc_feature (64)..(64): Xaa is any aa, unknown, or other
  misc_feature (104)..(104): Xaa is any aa, unknown, or other
  misc_feature (105)..(105): Xaa is any aa, unknown, or other
  misc_feature (106)..(106): Xaa is any aa, unknown, or other
  misc_feature (109)..(109): Xaa is any aa, unknown, or other
  misc_feature (110)..(110): Xaa is any aa, unknown, or other
  misc_feature (111)..(111): Xaa is any aa, unknown, or other
  misc_feature (131)..(131): Xaa is any aa, unknown, or other
  misc_feature (133)..(133): Xaa is any aa, unknown, or other
MASTNMASATSRFMLAAGVPTASSGSGRVSFASAPNRLGRRLVVRADEEFPAEPAPTXEGEGAXATKPNAEKPAPIGPKRVSKVKILRGEVYCFPPPRGGKKGXXXFLXXXYLGGGAKKTKESGGGGGAPXLXVGTKLRGEKE

SEQ ID NO: 58404 - DNA, 606 bp, Zea mays
  misc_feature: Ceres CLONE 1511603
  misc_feature: Encodes the peptide sequence at SEQ ID NO. 58405
  misc_feature (344)..(344): n is a, c, t, g, unknown, or other
  misc_feature (356)..(356): n is a, c, t, g, unknown, or other
  misc_feature (357)..(357): n is a, c, t, g, unknown, or other
  misc_feature (529)..(529): n is a, c, t, g, unknown, or other
  misc_feature (547)..(547): n is a, c, t, g, unknown, or other
tccccgcggtggcggccgctctagaactagtggatcccccgggctgcaggaattcgtctcacccctagaaaaagcagattggcggcagcaaagcaacacgcgcctcgatcctcctcgcccctccggcctctcctcccctccctgcacccgcacctgcggagagcgccgcaagctagctgcagaggagcgagacagtagcaggaggaggacgagaggaagaagagatggcgggctgtgatggagccaagtcgtcggcgtccatggaggaagaggcatgcgcggagaagaagtacggagggatcgcacccaagaagcccttgatatccaaggaccacgaagcgcgncctacttcgatnntctgcggactggggtgctggggcaagcaagccgcgaacagcagcagcagcacgaggaccgcagccgcggtcgagtctctgaagcccagctgaagagacgccgcaccacagctgccgctcgtagcccactgcgcttccagtgagaccatggcacgcgtcgcactgctggagangagctcggtcagagtcangactgaggatgccgacaacctcagctccgaataatgttttaactgggtcggaatccgta

SEQ ID NO: 58405 - protein, 74 aa, Zea mays
  misc_feature: Ceres CLONE 1511603
  misc_feature (44)..(44): Xaa is any aa, unknown, or other
  misc_feature (45)..(45): Xaa is any aa, unknown, or other
MAGCDGAKSSASMEEEACAEKKYGGIAPKKPLISKDHEARPTSXXCGLGCWGKQAANSSSSTRTAAAVESLKPS

SEQ ID NO: 58406 - DNA, 650 bp, Zea mays
  misc_feature: Ceres CLONE 1511607
  misc_feature: Encodes the peptide sequence at SEQ ID NO. 58407
  misc_feature (376)..(376): n is a, c, t, g, unknown, or other
gaaagctggagctcaccgcggtggcggccgctctagaactagtggatcccccgggctgcaggaattcgtctcacccctagaaaaagctcaagccacctacaccaccaccccgccggccacactcgtctttctcacgagccacaggcacaggcaggctctcgagctcagtccacccagcgcaggggatggcgtcgtcgttcgccgtggcaacggtcccgtcgctggcggccccggcggccaagaagcggtccggcggcgtcacgtacgtggagggcatgaacgcctacagcggcctcaaggggctcaacaaggtgaacatgctcggggtgcgcaagaccgccgactactccttcgccaaggtcgtggcgtcgctcanccccccggggcagaagcggcgcgggcggcgcgttctgcgcccagatgaacgccgccggccgagttcttcaggatcgccgccaccatgaaacggcctcgtgctcgtccggcttcccccttcgggttcctgctgctcccgggggaaggccgccccccaagaaatcccaattaagggggggggggcccggccccgggtcggctggcccccccggggccaaatctggtttcaaaaaccctggtttttttttttaacccaatgtgccccctttcaaaaa

SEQ ID NO: 58407 - protein, 92 aa, Zea mays
  misc_feature: Ceres CLONE 1511607
  misc_feature (64)..(64): Xaa is any aa, unknown, or other
MASSFAVATVPSLAAPAAKKRSGGVTYVEGMNAYSGLKGLNKVNMLGVRKTADYSFAKVVASLXPPGQKRRGRRVLRPDERRRPSSSGSPPP

SEQ ID NO: 58408 - DNA, 650 bp, Zea mays
  misc_feature: Ceres CLONE 1511609
  misc_feature: Encodes the peptide sequence at SEQ ID NO. 58409
tccccgcggtggcggccgctctagaactagtggatcccccgggctgcaggaattcgtctcacccctagaaaaaaagtaagcagcacagcagctagatagcgcgcgctcatcaccaaagccgagagccaagcagccagctaattaagcagccaaattcagtgcgatggcgtcgtccgtcaccagaaccgcatgtctcctcgtgctcacactgttcgtcgtctccgcggcggtgatcttgcccagctccctgtgccatggagcccgcggcgtcgctgggttacgtatcggtttggaccctaaccatcctgcgtgcatcggggcatgcccagctcctgggggctcctacactcaccttcccccctatgggggtgggggccctgtgaaaccgcttcccccaccgaaaggagggaacccctgacgccgcctggcctcccatcacgggcgctctatgatggaacgatgcacccacgccaactgtatcttaactgtggttatatagtaaatgaagatcaaaaaaactgggagtaggactgggaaaaaaaaaaaaaaacgaaaaccctcgaggaccccattcggcctaaaggggggcgaattacccgccgccccctggccgtgcgttttacacagccgggccggggaaaaacccgggt

SEQ ID NO: 58409 - protein, 84 aa, Zea mays
  misc_feature: Ceres CLONE 1511609
MASSVTRTACLLVLTLFVVSAAVILPSSLCHGARGVAGLRIGLDPNHPACIGACPAPGGSYTHLPPYGGGGPVKPLPPPKGGNP

SEQ ID NO: 58410 - DNA, 647 bp, Zea mays
  misc_feature: Ceres CLONE 1511611
  misc_feature: Encodes the peptide sequence at SEQ ID NO. 58411
  misc_feature (257)..(257): n is a, c, t, g, unknown, or other
cgcggtggcggccgctctagaactagtggatcccccgggctgcaggaattcgtctcacccctagaaaaaacccatccatcgagctgccctgctacagggtgccctgccaagatcgatcttcccggttacaccgcctgatcgaagtgaacaagcagagaacatgcatggcgagcgagcacgctgcggggggcgaggctaagaatgaccagaaacagagcctgatgtacaacgcgaaggggttcgttgtgtagaagatnacgcacatccccaaacccgaggtgactctggacggcgtgacgattcatgggcctgacccgagagtgcatcatgctgcacagcagcgtgaacgtgtcctagccctacgaccaccgcctccccatctgctaggtgacctacacgctccggagcacccatgagaaagtgtcgtccggcaccatgactgaccccgtgtggatcaccgcgctaggctccaccgagctggacatctccgcgaaggagccctacgatttcctcgactccctcgacagggacgtctgctggcactggtacatccactacaatctccagtctgaggtctcgtctgactccgcatgtaccgaaagttcatgatcgcgatcatctcctcctgcgagctaaagctccgcacc

SEQ ID NO: 58411 - protein, 57 aa, Zea mays
  misc_feature: Ceres CLONE 1511611
MTDPVWITALGSTELDISAKEPYDFLDSLDRDVCWHWYIHYNLQSEVSSDSACTESS

SEQ ID NO: 58412 - DNA, 638 bp, Zea mays
  misc_feature: Ceres CLONE 1511627
  misc_feature: Encodes the peptide sequence at SEQ ID NO. 58413
  misc_feature (274)..(274): n is a, c, t, g, unknown, or other
  misc_feature (562)..(562): n is a, c, t, g, unknown, or other
cgcggtggcggccgctctagaactagtggatcccccgggctgcaggaattcgtctcacccctagaaaaagtcgtcatcgcttggcgtccgcctcagcccgccgccaggagagccggctcggtcggttcgtcgaagatcccggatctgctctgtcacgaggtctttcggcgggtgttgtctcgcgaggtgtagcgagccaagttcaggagagtttcgagaagctgaaatggctcctaaagctgctcctgccaagaagggtgatgccaagacccangcctttgaggttgccagggctgtgaagtctgggtcagtaaagaagaccaagaagatccgcacgtccgtgacattttcacggccccagaacctgaagaaggctaaggacccccagtaccccagaattcagcactacgggaagggacaagcttgatcagtaccaaattctcaaagtatcccctaccacagaaatccgcgatgaaaaagaattggagataacaacactctctgtcttcactgtctcaccttctaggcgcacaaaaaaaaaatctcagggtgcttgtcaagngatgtgatgaaacttcccggccagaaaggtcaaaacccccggtttcgggcctgaagggaagaaaaaaagggttacc

SEQ ID NO: 58413 - protein, 66 aa, Zea mays
  misc_feature: Ceres CLONE 1511627
  misc_feature (11)..(63): Pfam Name: Ribosomal_L23eN Pfam Description: Ribosomal protein L23, N-terminal domain
  misc_feature (16)..(16): Xaa is any aa, unknown, or other
MAPKAAPAKKGDAKTXAFEVARAVKSGSVKKTKKIRTSVTFSRPQNLKKAKDPQYPRIQHYGKGQA

SEQ ID NO: 58414 - DNA, 701 bp, Zea mays
  misc_feature: Ceres CLONE 1511631
  misc_feature (501)..(501): n is a, c, t, g, unknown, or other
aaaactggagctccccgcggtggcggccgctctagaactagtggatcccccgggctgcaggaattcgtctcacccctagaaaaaatgccttcatcttcgtcgtcttgcagccccgcaacagtcgttagcttagagcatcgcacctcatcgttccaccgtccgtccgtccgctcgttcgcgtgatctgtttgagagttggggaatggaggcctacgtcctgttcgcgcccgccaaggaggtgatcaggttctaggagcaggaggaggacatcggctgcccgtccgagtcgtccgcggagcgttcaacgtccccgtcctcctcctcgtcagacggggtacctcgccgacgacgccaattcttccccgccccccctgtcacgggggggatgggcttccctcatgaacccacccccccatccaggaggggacctgtcaaacttcttggacggccaagatcggaaatcggttcgccgtcactggcgggccggtccgccggccctcnaagaaccttgccccaaccccccccgcaaaatcgcctcaagaaccttccccgaatctgcgtacactccaacctccaaaaacccgcaacgcgctcgtgggccctcccttcccacaaccgttccgtgaataaggcttccctccggtttcgccgtaactccgatctgcgcctcccctccccgcctgtattaaagtgtccaacag

SEQ ID NO: 58415 - DNA, 638 bp, Zea mays
  misc_feature: Ceres CLONE 1511638
  misc_feature: Encodes the peptide sequence at SEQ ID NO. 58416
  misc_feature (541)..(541): n is a, c, t, g, unknown, or other
  misc_feature (638)..(638): n is a, c, t, g, unknown, or other
tccccgcggtggcggccgctctagaactagtggatcccccgggctgcaggaattcgtctcacccctagaaaaagcaaaaaccctaatcgcatctgcttccagagccccccgccgccgctgcgccctcctctcggtcctgccgtccgtcgaggtaaaaggacagcatggtgagggtcagcgtgctcaatgatgctctcaagtccatgtacaatgctgaaaagatagggaaacgtcaggtcatgatcaggccgtcatccaaggtgatcatcaagttcctgacggtcatgcagcgccatggctacattggcgagttcgagtacgtggatgaccacagagctgggaagatcgtggtggagctgaatggaagactgaataaatgtggtgttattagcccacgttttgatgtaggtgttaaggagatcgagggatggacggcgaagcttcttccatctcgccagtttggctacatcgtccctaacacttctgctggaatatggggacatgaggagcccgccgtaagaaatgtggtggcaggttctangtttcttttatgaaatgtgttttttttgagcacagatgcgtccaagactcgtctgatgttttgagtttgttaagactggtgtctgagcctttgcgtn

SEQ ID NO: 58416 - protein, 129 aa, Zea mays
  misc_feature: Ceres CLONE 1511638
  misc_feature (5)..(123): Pfam Name: Ribosomal_S8 Pfam Description: Ribosomal protein S8
  misc_feature (126)..(126): Xaa is any aa, unknown, or other
MVRVSVLNDALKSMYNAEKIGKRQVMIRPSSKVIIKFLTVMQRHGYIGEFEYVDDHRAGKIVVELNGRLNKCGVISPRFDVGVKEIEGWTAKLLPSRQFGYIVPNTSAGIWGHEEPAVRNVVAGSXFLL

SEQ ID NO: 58417 - DNA, 652 bp, Zea mays
  misc_feature: Ceres CLONE 1511640
  misc_feature: Translation starting site: 172
  misc_feature (501)..(501): n is a, c, t, g, unknown, or other
  misc_feature (609)..(609): n is a, c, t, g, unknown, or other
aaagctggagctccccgcggtggcggccgctctagaactagtggatcccccgggctgcaggaattcgtctcacccctagaaaaaatgcctcctcgcccgctccgaatcagctcgaggtagcagctccccccgcaaaaaccctaactttacctccccacaagcgcctccaagatgaagctcgtcaggttcttgatgaagctgaacaacgaaacggtgaccatcgagcttaagaacggcaccgtcgtacacggaaccattaccggcgttgacattcagcatgaatactcatctgaagactgtgaagctgacactaaaagggaaaaatcctgttacccttgatcaccttagtgtgaggggaaacaacatccgctattatatccttcctgacagcctaaacctgtagactttgctggttgaggaaacaccaagggtcaagcctaagaagcctacttctgggaagcccttgggacgtgggcgtggccgtggtcgtgggcgcggtcngggtctgggacgttgagcatgctagctgcttttggaaattgcattgcgtgcatctgcagtgtaacctacattcctatcaattgtacgaagtatgcctttgattatgcnaccatgtatcaattgttttttttttgccgtggatttatgttga

SEQ ID NO: 58418 - DNA, 637 bp, Zea mays
  misc_feature: Ceres CLONE 1511647
  misc_feature: Encodes the peptide sequence at SEQ ID NO. 58419
aaagctggagctccccgcggtggcggccgctctagaactagtggatcccccgggctgcaggaattcgtctcacccctagaaaaagtccatcgctccagcctccagaggagcagcgtcactacgtactacttggctgtagctagttagctactgcactcccgcttagcccgacatggggagggcgccgaggggtgtgtggaacatggagcttctggggcttgccgtcttggtggttcttgcggtggtcgccgagacgcggtccttggagaagcagaatctgtgcaggtgctggctctggcggcggcggtggttatggtgctggtggcggaggtggaggtggcatcggcggcggtgtctgaatcagcgtctcacatgcatgcatggtggtgcaagctgcaagcagaagcaagtgctcgaactcgctcggtattcccttcgcaggggtgcgtggacgtggagtcgagctataccgatcgatatccgggatcatactctctgcgtagcgaataccgatcatagtaataacagaataaggatgctggcatacgtctaatcaggcctccttattccatggtttataccggatatatacactgggttggtagcaaccgaaaaaatactttggatccgaacattt

SEQ ID NO: 58419 - protein, 126 aa, Zea mays
  misc_feature: Ceres CLONE 1511647
MGRAPRGVWNMELLGLAVLVVLAVVAETRSLEKQNLCRCWLWRRRWLWCWWRRWRWHRRRCLNQRLTCMHGGASCKQKQVLELARYSLRRGAWTWSRAIPIDIRDHTLCVANTDHSNNRIRMLAYV

SEQ ID NO: 58420 - DNA, 574 bp, Zea mays
  misc_feature: Ceres CLONE 1511649
  misc_feature: Encodes the peptide sequence at SEQ ID NO. 58421
  misc_feature (457)..(457): n is a, c, t, g, unknown, or other
ctggagctccccgcggtggcggccgctctagaactagtggatcccccgaggctgcaggaattcgtctcacccctagaaaaaaccgccaccatctatggctagtctacagcctagcacacatccccacaacatatatatatcgtcgctcgtgcgcggattgagagttgacagttgccataccaccagtactagctcgctcgatcgcttgctctccgaactgatcgctgtgaggagtatgccatcactgtggccaacaaggaagaagcgggcgcgaggctcggcggtccagtcgtggtcgcgccgccgcgagagcaagaaatcatcgtcctcttcgtcgctggtggcgctgtggcggcggatggtcgagccacgcatggggacccagacccggactctgacccggggccgggtgaagaagcaaggctgctctcgcgcgcccgcgagtgctctcatgcgncgccgctcctactgaccgatgcactccggcgcggaccggcgggccgggtcgaatcgtccaaagccatatctgcccgggacccgcccgccgtgacttggccccaatccacctcggggg

SEQ ID NO: 58421 - protein, 125 aa, Zea mays
  misc_feature: Ceres CLONE 1511649
MASLQPSTHPHNIYISSLVRGLRVDSCHTTSTSSLDRLLSELIAVRSMPSLWPTRKKRARGSAVQSWSRRRESKKSSSSSSLVALWRRMVEPRMGTQTRTLTRGRVKKQGCSRAPASALMRRRSY

SEQ ID NO: 58422 - DNA, 573 bp, Zea mays
  misc_feature: Ceres CLONE 1511652
  misc_feature (41)..(41): n is a, c, t, g, unknown, or other
  misc_feature (169)..(169): n is a, c, t, g, unknown, or other
  misc_feature (170)..(170): n is a, c, t, g, unknown, or other
  misc_feature (189)..(189): n is a, c, t, g, unknown, or other
tccccgcggtggcggccgctctagaactagtggatcccccngggctgcaggaatttcgtctcacccctttagaaaaaactctcgcgccgccgcggaacacaacaccgcacacactacccagcggaatccgcccacccgcacccggagcagaggagatattgtcgcaggnngaaagggaaggagccgtcnaaggaaaagagggaaggtggtcaaccaggggattacaccattcaacttcccaaaagggcctccacgggttggcccatttaagaaaaaaggcccccccacccccctttcagggagaattccggggattttttgccccaaaaagggcccttggggcccccccccgggggaatttttttggatttttgttttttttgaaaaactttctaaaaaaaaggcaattttttttttgggggacacacccccgggatttattttaaaaaatggtccccccccaaaagagttttttttttttgggaaaaatccccccccccccgggggagaccccccccctgggggggtttcccccgcgggggggagctctttttttcctccttttttgttgcg

SEQ ID NO: 58423 - DNA, 637 bp, Zea mays
  misc_feature: Ceres CLONE 1511653
  misc_feature: Encodes the peptide sequence at SEQ ID NO. 58424
aatagctggagctccccgcggtggcggccgctctagaactagtggatcccccgggctgcaggaattcgtctcaccccctagaaaaaatcgagcagggggctcattcatccgcacagaccggcacccagctcaagtcacccccgaaacgcaagctaagcgcgcagccatggcggcggctccagagcggccgctggcggtggacttcgaggcgctgagctacatcagcagcctggtggaggcgttccaggcgttcgactccgacaacgacgggctggtgacggcgcccgagctccggggcctgctggcgtcgctgggcctggccaagtcggaagccgaggcgcgcgacatgctggcgcgcgccgacgccgaccgcgacggccgtctcagcgtcgaagagttcctggacgtgacgaacgccgggagctcggactgggcgcgctcggggcggtgctgcagtcggcgctcccccagctggaagccgcgggaggcgccctggtcggcgcgaaaaatctcgcccgggcgctccgggccctcggaaggcttagcgcaaagactggccggctatggttgaatgcctggaaggggaagggcaacgggccctccccattggagaattccgggtcctggccgacccgct

SEQ ID NO: 58424 - protein, 134 aa, Zea mays
  misc_feature: Ceres CLONE 1511653
  misc_feature (21)..(49): Pfam Name: efhand Pfam Description: EF hand
  misc_feature (57)..(85): Pfam Name: efhand Pfam Description: EF hand
MAAAPERPLAVDFEALSYISSLVEAFQAFDSDNDGLVTAPELRGLLASLGLAKSEAEARDMLARADADRDGRLSVEEFLDVTNAGSSDWARSGRCCSRRSPSWKPREAPWSARKISPGRSGPSEGLAQRLAGYG

SEQ ID NO: 58425 - DNA, 659 bp, Zea mays
  misc_feature: Ceres CLONE 1511654
  misc_feature: Encodes the peptide sequence at SEQ ID NO. 58426
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
cataactggagctccccgcggtggcggccgctctagaactagtggatcccccgggctgcaggaattcgtctcacccctagaaaaacttagacgggcaattctgttttttgagaattgcaaagtgcaacaatatccatttacatcaaatcaagtggcgcctcctcttgactgggagcaatatgtgtctgaaatagcaactgatatacttacagaacaaagccctaaaaggctatttgctgtacgccagaaattctatgaattactcgtcaattgtatcccacccgaaaatattttgaagaagttgttggcagaattactgacgaagttagatgcggatctgaaacatgaaatctgtcattgggccgcacattatgaacacaagatgcgcctcggatcaaaagctatttttcatctagaagctttcgtggccaaattcatgaacgtttacaaagaattcctggtggcaacattttggttgaccaaaacctcatggcattggggttgccccccgccaaaaccaataaaagatgggaagcggcttatcgccccggttcaaggcaagagccttgccctgctgtaattttgtaactgaaaattcctgaaccaattaactttccccaacatacannnnnnnnaaacccacccgttaaactcggggg

SEQ ID NO: 58426 - protein, 192 aa, Zea mays
  misc_feature: Ceres CLONE 1511654
ITGAPRGGGRSRTSGSPGLQEFVSPLEKLRRAILFFENCKVQQYPFTSNQVAPPLDWEQYVSEIATDILTEQSPKRLFAVRQKFYELLVNCIPPENILKKLLAELLTKLDADLKHEICHWAAHYEHKMRLGSKAIFHLEAFVAKFMNVYKEFLVATFWLTKTSWHWGCPPPKPIKDGKRLIAPVQGKSLALL

SEQ ID NO: 58427 - DNA, 635 bp, Zea mays
  misc_feature: Ceres CLONE 1511658
  misc_feature: Encodes the peptide sequence at SEQ ID NO. 58428
tagctggagctccccgcggtggcggccgctctagaactagtggatcccccgggctgcaggaattcgtctcacccctagaaaaaaataattaccggaagagaaaaatgtaactcgggaaaagatggagacgccgaattttctgaaggggaggggaaagcaaagctgatgggggaagcccaggggaaagctgagcaaatggcggaagccccgagcaagatcgtatccatgaggaagtgggtgcgtctagcacaagctccgagccgtaagttgcctctggctaggtgggatcagcagttcgatcgcctacgactggtcgcggcccattatgatgcctagcgtcaagatcttccacgcaaggttgcatgctcaagctctaaccctggctgcattacttggctctgcatgcatggagtactatgaccagatctatggttcttctgggccagaggtggactatatacgcaagccaatacctggcccattcgcataaagattaaaggtcgccatgttggttcctgcatgccggattaattttgggctcatctcgggttgctcatgagtcatgacccgcgcatggatgctggatgtttattctttttgttgtcgtcatattacataatggtggtgtacttgcc

SEQ ID NO: 58428 - protein, 54 aa, Zea mays
  misc_feature: Ceres CLONE 1511658
MMPSVKIFHARLHAQALTLAALLGSACMEYYDQIYGSSGPEVDYIRKPIPGPFA

SEQ ID NO: 58429 - DNA, 685 bp, Zea mays
  misc_feature: Ceres CLONE 1511665
  misc_feature: Encodes the peptide sequence at SEQ ID NO. 58430
  misc_feature (181)..(181): n is a, c, t, g, unknown, or other
aaagctggagctccccgcggtggcggccgctctagaactagtggatcccccgggctgcaggaattcgtctcacccctagaaaaaataacggagacgaagagagcagatgcgaagagcagcggcgcaaaggaaagggagccatgctcgcctcgccggcgctcgccggcgcccactccttctnggcgtccgtgtatggaaacatcctcgtcccctcgcctcccgtccccgcgccggtacgtcacgcgatgctgtccgtcgtcgcaaaggtcaaggtggcaatcccctttaccaccgaatcagcagccacttcttcttctttttttaaggtaagtggccccactgacaggtctaagggtgatttttccccccccccccactggggggggggggggggtagtgtcaaccaccgacctttaggagaggggcggcaaaaaataaaatattaaggggtgtcgctaaatcgcggggggccataaaaattacgcatactgcggctggggtcgacgctttcctggatatgcgtttgggggggtgatatatgtggagtgtccacgcccttacccggcacttatattgcggctcaatttatggtttgtgcaaccaatggggggcggggcgttaatagataaacaaccatattttctcacgtcgcctcgtacgtcccaatttggcgtcgggtgtaaac

SEQ ID NO: 58430 - protein, 101 aa, Zea mays
  misc_feature: Ceres CLONE 1511665
  misc_feature (14)..(14): Xaa is any aa, unknown, or other
MLASPALAGAHSFXASVYGNILVPSPPVPAPVRHAMLSVVAKVKVAIPFTTESAATSSSFFKVSGPTDRSKGDFSPPPHWGGGGGSVNHRPLGEGRQKIKY

SEQ ID NO: 58431 - DNA, 677 bp, Zea mays
  misc_feature: Ceres CLONE 1511670
  misc_feature (642)..(642): n is a, c, t, g, unknown, or other
  misc_feature (651)..(651): n is a, c, t, g, unknown, or other
ttgctggagctccccgcggtggcggccgctctagaactagtggatcccccgggctgcaggaattcgtctcacccctagaaaaaactccaccttgggcgctgttctcctcaccgctcgtgctctctctctctcggagccgactcggctaccgccgccgccctacggaagcttcccaggtcttcgtcaggcttttctccggcaacgagcaccctgcacagatcgtgaacctccacacctcaacgatagatggcggggttcagaagccttgcacccaacaccaggaacctggtggtggccgggagactgtctgccttcgtgctcgggggtctactactacaccaagacagcggtgggaggcacggacaagctccccgtggcgatgggagggggttgagaaaactaagaaaccggatgccgctagaaactctcgctcctccgcaggaagatcttaattcatatacacggggacaccccctggatctgctgcaggatgaaatggaattgggaactaaaacaaacccttcccctctcaaagccctgacctttgccttctgcgtcgtaatggagcaaaaaaataaaaagaaggggcttttggcccccctttaaacaagggaaaaacctgggaaaccttagtgacttttnaaagaaggnaaaaaaaggggcgcccccaaacgtgg

SEQ ID NO: 58432 - DNA, 648 bp, Zea mays
  misc_feature: Ceres CLONE 1511674
  misc_feature: Encodes the peptide sequence at SEQ ID NO. 58433
atagctggagctcaccgcggtggcggccgctctagaactagtggatcccccgggctgcaggaattcgtctcacccctagaaaaatagaagaataactaaggccgcgtttggttacaccagattatcagaatctgcatcattcacgtaatccaaaaaaatccaactcaagcttgatttttatggatagtctctggcagcacattatccaaggtaagaaatctgctacgtttggttgagcctatagattctactagccagattctgactatccataggaaccaaacgctccctaagattgggtaggaaggaaggatggtggattgggtagctagctgctggctgcttggttcaggagttggggttaaattagcgtctgaaatacttgtttggtttaggtattcctatgtagacgacctgattatgattcagggtggtttatcgtagcagtaatctgaagtttggtgtggtgtttgatctgtgtgagtcttgtgttaggtgagtcatgaacaaatttatgtggtctttattagtaggtcaaggggaaattcttctccttatggatccatatcagcttaactgggaatacccgtgtgagtcgtaaatttccaaatattgaaagtctgttcctgcatctgaacaaggaattgg

SEQ ID NO: 58433 - protein, 43 aa, Zea mays
  misc_feature: Ceres CLONE 1511674
MVDWVASCWLLGSGVGVKLASEILVWFRYSYVDDLIMIQGGLS

SEQ ID NO: 58434 - DNA, 649 bp, Zea mays
  misc_feature: Ceres CLONE 1511675
  misc_feature: Encodes the peptide sequence at SEQ ID NO. 58435
ggagctccccgcggtggcggccgctctagaactagtggatcccccgggctgcaggaattcgtctcacccctagaaaaaacatgtgcatctcagcagcactagcagtgacaaactcgaagcttgccttctagcttgtttacaccccaaaactaaaactagagtcggcggcggcaacaagcggtacgtagaggatgaagagcaggagcagcactctgttggtgatcctagttctccaggcccttctgctctctgcggctgtggccaaaggacctgcagggccgaagaagcagtgctggtgcggcgagtgcaccagctggtcgggcgtgtggacctgcgacgacctcctcaccaagtgcgccgccacctgcaagaactgcgtccccgtctccacggacaagggcgccaccaagtacagatgccgcgacttcctccccgaaaactgcggctgcaagatccactagagactcatccaatcaaccatggccacagccgatggacccttcttccatatgcatgctctcctccgtccgtccgcctagcttgctacaagcaggcgctaataagctagcaagctgttgttgttgttttgcatgtttgattgggtgtcccttcccagtagagatgcaatggggacccgatcccccgatcc

SEQ ID NO: 58435 - protein, 89 aa, Zea mays; identical to SEQ ID NO: 3974
  misc_feature: Ceres CLONE 1511675

SEQ ID NO: 58436 - DNA, 705 bp, Zea mays
  misc_feature: Ceres CLONE 1511676
  misc_feature: Encodes the peptide sequence at SEQ ID NO. 58437
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
nnnnnnttttnnnnnnnnnnnnnnnnnnnnnnnnnnnnnnnnnnnnnnngggatggcggtccaaaactggagctccccgcggtggcggccgctctagaactagtggatcccccgggctgcaggaattcgtctcacccctagaaaaaacagaacgatcgtcatctccctagcactctctagcagcagatcctcgtgcgaagcagagcgctagcccccttcgtactggcccgatggcccgcacgcaacagacggcgaggaagtccactggcggccaggcgcctaggaagcagctggccaccaaggcggcgcgcaagtctgccccggcgaccggtggagtgaagaagcccccaccgtttccgccccggcaccgtagggctccgggagatccgcaagtaccaagaagagaacggagctgctgatccgcaaggtgccgatccgaacgcctgggggcgggagatcccccaggactttcgagaccgaaccttcgcttccagagctccgccctgccccagggctgcagggtggcttccgcaagggctacctccctccgggctctttccagagaaaccaaacctcgggggccatttacggtccagggggcggcccccattgtgggccccaggggcttttccaagattggcgccggcgcttatccccggggggaagagggggccttaggccgtttggttcccggggtgtgggggg

SEQ ID NO: 58437 - protein, 62 aa, Zea mays
  misc_feature: Ceres CLONE 1511676
MARTQQTARKSTGGQAPRKQLATKAARKSAPATGGVKKPPPFPPRHRRAPGDPQVPRRERSC

SEQ ID NO: 58438 - DNA, 637 bp, Zea mays
  misc_feature: Ceres CLONE 1511677
  misc_feature: Encodes the peptide sequence at SEQ ID NO. 58439
  misc_feature (413)..(413): n is a, c, t, g, unknown, or other
ctggagctccccgcggtggcggccgctctagaactagtggatcccccgggctgcaggaattcgtctcacccctagaaaaaaccttgccatcacctcctcgcctagcctgccactgccagcaggtgccaccgccatctctgctctgctctcgcaacgcaagcacacgcccggccgcctgccacagttgccatggcaaccatagccacgatggagctgctgaagcccgccgccaaagacgcggcgcggtcagcgccatccaccagcagcggcagcgtctcgctgcgcgtccggacggggcaagccgccaagaaagctgcggtgtccgcatccgcatcgtccacgctaggcggcaccttactcacagcgctggcgtcgtcgcacgaccctgcgctggagacgtcgtagcagcagcngacgcccgcagcgacagccgcgacagctgctgctcgtcttagtagagccccgcatcggggtgggggctgtaacacctccctgtagcccgtcgctgaaacttcttgaacccaatggcccaacgccaagacgtggccaaaaggccgagggcccaacccccgccccccccggtatggcaggcccgcccataaacatcagcccccttgggttaaaacctccaaaaatc

SEQ ID NO: 58439 - protein, 71 aa, Zea mays
  misc_feature: Ceres CLONE 1511677
MATIATMELLKPAAKDAARSAPSTSSGSVSLRVRTGQAAKKAAVSASASSTLGGTLLTALASSHDPALETS

SEQ ID NO: 58440 - DNA, 731 bp, Zea mays
  misc_feature: Ceres CLONE 1511678
  misc_feature: Encodes the peptide sequence at SEQ ID NO. 58441
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
nnnnnnnnnnnnnnnnnnnnttttnnnnnnnnnnnngggtattttttttcaaagtggagctccccgcggtggcggccgctctagaactagtggatcccccgggctgcaggaattcgtctcacccctagaaaaaaaaaaactgctcgaccggaccgacgagcgacgaagcgcgcagaaagagaagaacctcggagctgagatggcacaagccatggcgtcgatgaccggcctctcgcagggcgtcctgcccagcaggcgcgccgacagcagaaccaggacggccgtcgtcatcgtcagggcgtccgcggagggcgacgccgttgcgcaggcgggccgccgcgccgtgatcgggctggtggccactggcatcgtcggcggcgccttgtcgcaggcggcgcgcgccgagaccgtcaagaccatcaagattggagccccgccgccgccctccggtggactccccgggactctcaactctgaccaggcgagggacttcgacctccccttgaaggagcggttctacctgcagccgctgccgccggcggaggcggcggcgagggtgaagacgtcggcgcaggacatcatcaacctcaagccgctcatcgaaaagaaggcgggggccctaccgtccagaaaggaacctccgccctcccggggccctccttacctgtgggcttacgaacccctcaaaaaaacgggtcaattcccctttttccaaagccccccaaggggag

SEQ ID NO: 58441 - protein, 177 aa, Zea mays
  misc_feature: Ceres CLONE 1511678
  misc_feature (15)..(166): Pfam Name: PsbQ Pfam Description: Oxygen evolving enhancer protein 3 (PsbQ)
MAQAMASMTGLSQGVLPSRRADSRTRTAVVIVRASAEGDAVAQAGRRAVIGLVATGIVGGALSQAARAETVKTIKIGAPPPPSGGLPGTLNSDQARDFDLPLKERFYLQPLPPAEAAARVKTSAQDIINLKPLIEKKAGALPSRKEPPPSRGPPYLWAYEPLKKTGQFPFFQSPPRG

SEQ ID NO: 58442 - DNA, 696 bp, Zea mays
  misc_feature: Ceres CLONE 1511685
  misc_feature: Translation starting site: 161
  misc_feature (1)..(1): n is a, c, t, g, unknown, or other
  misc_feature (402)..(402): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (417)..(417): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (429)..(429): n is a, c, t, g, unknown, or other
  misc_feature (430)..(430): n is a, c, t, g, unknown, or other
  misc_feature (432)..(432): n is a, c, t, g, unknown, or other
  misc_feature (462)..(462): n is a, c, t, g, unknown, or other
  misc_feature (488)..(488): n is a, c, t, g, unknown, or other
  misc_feature (489)..(489): n is a, c, t, g, unknown, or other
  misc_feature (493)..(493): n is a, c, t, g, unknown, or other
  misc_feature (659)..(659): n is a, c, t, g, unknown, or other
  misc_feature (670)..(670): n is a, c, t, g, unknown, or other
naattctggagctccccgcggtggcggccgctctagaactagtggatcccccgggctgcaggaattcgtctcacccctagaaaaaagactgcacccccatcccgcagcagccaaaacctacctagccgccgccgcaggcggcccccccatcgccgccaagatgcagatctttgtgaagactctgacggggaagaccatcactttggaagtggagtcctccgacaccattgacaatgtgaaggccaagatcccggacaaggaggggctccccccggaccagcagcgggttctccttcgaagagaagaagcctcgaggacggttctttccttccccgactacaacaattcagaaagaaggcttttttttttcccccccccccagaaggggagggaggggagggntnnnnnnnttnnntnttannnnnttanncnaaaacaaaaaaaaaaaaaaacccccccccncctcggggggggggggcctccccccnncttnaatttttattataggggggccaaccgcccccttggcaaggcggaaccccgccccccaaaaggaacaggccccgtgagcgaataagtggggtgcagtgcgtgctcttcatccgggcaaaccctctgcccaacccgcacctcgccgcgtcgcaaatagaggaactccncaccaatgtanctctcagccaaaaagaacgaatcacg

SEQ ID NO: 58443 - DNA, 832 bp, Zea mays
  misc_feature: Ceres CLONE 1511687
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (38)..(38): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (49)..(49): n is a, c, t, g, unknown, or other
  misc_feature (55)..(55): n is a, c, t, g, unknown, or other
  misc_feature (58)..(58): n is a, c, t, g, unknown, or other
nnnnnnnnnnnnnnnnnnnnnnnnnnnngggggggccnccnnngggccntttttnttnttaaaagtggagctcaccgcggtggcggccgctctagactagtggatcccccgggctgcaggaattcgtctcacccctagaaaaactgcagccaaccatctaccagcgactcagcgagcgagagcagcacacactgcacgcagctagctaggagcagcagcagcggcggcgatggcggcctccatgatctcctcgtcagctctggcggtggcgccctcaggggctgccgcccctccggccgccgcgcctcctccttcaacgtaatatgcttccagaagaagatagacacccaacaagccccctcgggaatggggggggggcccgacccgacaacgaccaacagtctatggtagaaaacgtgccggcgcgaggggcgttgtaccactttcaatccaacgactccaccaccaaaacaatccaacggaaaaaaactcccaatcctcgaaccagcgaccaacaggggacacccctacccggccacacagtgccccgcagcggtcttgaacctatccttgccctttcccgaaacagatcaccccgcgccccccctcccctcccagcaacacgttccattcaccatataacaacccccccccgaaaaaaaaaaaaaccacaatccccattcctcccgctgcgcgggggaggggcaggggaacaaagacgccccctcgccccacacccccccctcgccccacctcccgacatgatatccagcccactcccctcccacgtcgcgccctgtcagggctggggaccctttagggcgggagaaag

SEQ ID NO: 58444 - DNA, 721 bp, Zea mays
  misc_feature: Ceres CLONE 1511695
  misc_feature: Encodes the peptide sequence at SEQ ID NO. 58445
ggagctccccgcggtggcggccgctctagaactagtggatcccccgggctgcaggaattcgtctcacccctagaaaaaaacggttcacacttcacagcccacatcaacaaatggccaggaaagaagtgacgctcctgctcttcctcgtgctgcttgtcgcagccgtcgaggcacagctgcacgacgagcctacggcggccgctgtcgggcggcggcgtggcgcgaaggccgccacggcgccgacgcacctctacttcttcttccatgacacggtgagtggacagtcgccgacggcggtacgcgtggtgagcccgccggagtcttccccgtcccccgtgttcagcatggtgaacgtgatggaggatctactcaatggggggttgaacaagggtctaatcccccccccccgggttagaacggacgcgccctacgtacgcaacctatatcccctgttaacccccgtcgctcaccggcagcccctccccgccgtatccggcgtctcgtttcccgttctcttcctttgcccccttccacgttcccgctttttcggcgtgttgttatccccccctttatccgtactcgcatcgctaccccgttacctttgctcccttcctcgtatggttccccccagtttccgacccctcccccttctttttctcccccactccttatcttaactcgcccgcttttccgcgttagcccccttttatcgctcccgtta

SEQ ID NO: 58445 - protein, 188 aa, Zea mays
  misc_feature: Ceres CLONE 1511695
MARKEVTLLLFLVLLVAAVEAQLHDEPTAAAVGRRRGAKAATAPTHLYFFFHDTVSGQSPTAVRVVSPPESSPSPVFSMVNVMEDLLNGGLNKGLIPPPRVRTDAPYVRNLYPLLTPVAHRQPLPAVSGVSFPVLFLCPLPRSRFFGVLLSPPLSVLASLPRYLCSLPRMVPPSFRPLPLLFLPHSLS

SEQ ID NO: 58446 - DNA, 734 bp, Zea mays
  misc_feature: Ceres CLONE 1511696
  misc_feature: Encodes the peptide sequence at SEQ ID NO. 58447
cttagctggagctccaccgcggtggcggccgctctagaactagtggatcccccgggctgcaggaattcgtctcacccctagaaaaacccaccacaccaaaacccgcatccataaacaagaaaaagaaaagaaaacccccgctgccagcgacagaagaagaaggggtcccttctccttggttgcgttgcgcctccctcctgtctgcgtgcgtgcaatcgacgcagaggcgcgggcgctcgcaccaccacgaccacgacccgatggctttcatgcgctcccgctcaaatgcatcttctgggatgggagttgctcctaacattagggagacattcgtccagcttcaaatgaagaagggttttttatatgttatcttcgggggggggggggaggcaaaaccctgtggtttgtgcaccacacagggggctactactgaaaagctttgactgacttttttggcctctcctccccgaaaaatgacttgccgatattgccctggatgcatttttgatatttgtcacggggggagaatggtgcctatatacccaagattttctttcctttgtcttggggcctcattttacatttccccccccgtttggcccagtaggttcggacttccctgcgcccgaaggggactgcgctttaaggtgctaagtattgtagggggtttcctctagcggcatttgaggggggccctcgctcatcttggaggtttggggattaccggagttccc

SEQ ID NO: 58447 - protein, 60 aa, Zea mays
  misc_feature: Ceres CLONE 1511696
MAFMRSRSNASSGMGVAPNIRETFVQLQMKKGFLYVIFGGGGEAKPCGLCTTQGATTEKL

SEQ ID NO: 58448 - DNA, 697 bp, Zea mays
  misc_feature: Ceres CLONE 1511697
  misc_feature: Encodes the peptide sequence at SEQ ID NO. 58449
  misc_feature (493)..(493): n is a, c, t, g, unknown, or other
  misc_feature (502)..(502): n is a, c, t, g, unknown, or other
  misc_feature (503)..(503): n is a, c, t, g, unknown, or other
  misc_feature (514)..(514): n is a, c, t, g, unknown, or other
  misc_feature (539)..(539): n is a, c, t, g, unknown, or other
  misc_feature (542)..(542): n is a, c, t, g, unknown, or other
  misc_feature (615)..(615): n is a, c, t, g, unknown, or other
  misc_feature (625)..(625): n is a, c, t, g, unknown, or other
aaagctggagctccccgcggtggcggccgctctagaactagtggatcccccgggctgcaggaattcgtctcacccctagaaaaagtgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtctacgaggcccagtcccgcggcggccgtggaagcggcggcggtgggtacggtggtggccgtggaggcngcggctacnngcgtggcgggncgcccttgatgcggcggcggctacngcngtgggcgccgcggctacggtggcggcggcggctacggtggttggtggcggcggctacgcggtggcaacgtggngggcgctacnggaactccaacggaacttgagaaactgaacggggggcccgcccggccattatcctgttccctaccgggttgt

SEQ ID NO: 58449 - protein, 153 aa, Zea mays
  misc_feature: Ceres CLONE 1511697
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (104)..(104): Xaa is any aa, unknown, or other
  misc_feature (107)..(107): Xaa is any aa, unknown, or other
  misc_feature (111)..(111): Xaa is any aa, unknown, or other
  misc_feature (119)..(119): Xaa is any aa, unknown, or other
  misc_feature (120)..(120): Xaa is any aa, unknown, or other
  misc_feature (148)..(148): Xaa is any aa, unknown, or other
MAASDVEYRCFVGGLAWATDDHSLHNAFSTYGEVLESKIILDRETQRSRGFGFVTFSTEEAMRNAIEGMNGKELDGRNITVYEAQSRGGRGSGGGGYGGGRGGXGYXRGGXPLMRRRLXXWAPRLRWRRRLRWLVAAATRWQRGGRYXNSNGT

SEQ ID NO: 58450 - DNA, 705 bp, Zea mays
  misc_feature: Ceres CLONE 1511701
  misc_feature: Encodes the peptide sequence at SEQ ID NO. 58451
aagctggagctccccgcggtggcggccgctctagaactagtggatcccccgggctgcaggaattcgtctcacccctagaaaaaaaatcccccgactcctcgcttcctcccgttccgtcgccgccgcgcgcctcggagaagagatagaggcggccgctgcatcgaccccgcgccacccccgcctgcctcccccggcaccgatcgggtttgatcgatggcgtcgaagacgatcctgaatgagttgaaggacctgcagaaggacccgcccacctcctgcagcgcatgtcctgttggtgaggacatgttccattggcaagcgaccatcatggggccttcggacagcccatttgcaggtggggtattcttggtgaacattctcttcccaccggattaccctttcaagccaccaaaggtgtctttccgcaccaaggatttccacccgaacatcaacagcaacggcagcatttgccttgacattcttaacgtacagcggagtcctgctttaactatctcagaggttctcctgtcgatctgctcactgctcaccggaccaaaccctgatgatcctcttgtccctgagattgctcacatgttctagagcgacagggcccagtatgagtccgccgcacgcttcctggacacagaagtatgccatgggctataagcaaggctaaaagcttgccaaactggtgtatgtgtcggaccc

SEQ ID NO: 58451 - protein, 127 aa, Zea mays
  misc_feature: Ceres CLONE 1511701
  misc_feature (5)..(126): Pfam Name: UQ_con Pfam Description: Ubiquitin-conjugating enzyme
  misc_feature: SWISSPROT Homolog: EC 6.3.2.19 Ubiquitin--protein ligase
MASKTILNELKDLQKDPPTSCSACPVGEDMFHWQATIMGPSDSPFAGGVFLVNILFPPDYPFKPPKVSFRTKDFHPNINSNGSICLDILNVQRSPALTISEVLLSICSLLTGPNPDDPLVPEIAHMF

SEQ ID NO: 58452 - DNA, 693 bp, Zea mays
  misc_feature: Ceres CLONE 1511702
aagctggagctccccgcggtggcggccgctctagaactagtggatcccccgggctgcaggaattcgtctcacccctagaaaaatccgattttcaatcctgatccgcgatcggcgtgccgcgtgtgtgaggcgatctcagcatttcgtcccgaggaggagaatatcccgagacacatgggtgaacattgggggaatacgctccgtgccgatgaaggagggacgatgtccgctctgtcgcccttccagacgaatgtgatggttggcgctgtggaagggcgtctgctccaagatcttgtacacggtctgcgagtactgtgtctccgacgcgctcctcctcacgccctctcttcgcccctacctgaacgccgtgggggtctgagtgcatgcatagctttcccaagtatatttaccccactttccttgacagacagcgatcgtgagttttcattgatgggtttcgtactcctcccatgatgattgaacatgtgggaggtcaggttcttgtcatcgtcgtttcatccctccttatgtctatctgggatccgtgtctggcaaacttattttgaggcttgctaaatatgtaccttttgtctctgaagttgttaaataaagcaaattaacttccagtctaaaaaacctcaaggaccagactctcgaggtacccaattcgccctatagtgagtcgtattacgc

SEQ ID NO: 58453 - DNA, 703 bp, Zea mays
  misc_feature: Ceres CLONE 1511703
  misc_feature: Translation starting site: 189
  misc_feature (680)..(680): n is a, c, t, g, unknown, or other
ggagctccccgcggtggcggccgctctagaactagtggatcccccgggctgcaggaattcgtctcacccctagaaaaaattttatctctaggtcgttcgccatcccctgcccggatgctggccccaacggaacgacggccagagggagctacgacagatcgatcgatcgtgacagagagagagagagcatggctggtacgactttcctgattcggtcccccaacgaggaggagtcgaacgccgccgacagagaagctgtactgctgggagcaaagaacgccgcaatagctggtactgtggacgcagttcccacgatgggtggctgccgtgtccttccttgggctacggcgaatcgtgaactacactgcacaagcgctcattatatctgagacctgtattgctggcttcttcgtcactgactgacaaaaccattctacggaacgcacgacttagcaacgtcgggaagcttgactagacatattgatgcagagatgcagctgaagctggacagggtctctgggtgccgcggcggtagataggctgtctagtgccccatatgcagcgacaccatttctctacgtgcactggcaattattgggtgtttggttaatcagaccagagggtgtgctatactgacttgtctacctgagggacccaacgtgtgcatccagtttactccngattggtatctgaatacgctgcg

SEQ ID NO: 58454 - DNA, 738 bp, Zea mays
  misc_feature: Ceres CLONE 1511705
  misc_feature: Encodes the peptide sequence at SEQ ID NO. 58455
  misc_feature (386)..(386): n is a, c, t, g, unknown, or other
  misc_feature (389)..(389): n is a, c, t, g, unknown, or other
  misc_feature (395)..(395): n is a, c, t, g, unknown, or other
gagctccccgcggtggcggccgctctagaactagtggatcccccgggctgcaggaattcgtctcacccctagaaaaaaagaccaccgacgcgtagcacagtccattattgccgtctcccttttgcgtgagcaaagaaagagagcgagaagagcagtcgccatgcctggcatcatccacaagatcgaggagaagctccacatggggggcgaccacaagaataaggaggaggagcaccacaagaaggccgaggagcaccacaagaaggaggagggggagcaccacaagaaggacggcggggagcacaaggaaggcatcttggagaagatcaaggacaagatcatcgggttagtacggcccaccagtcggggggggggggggggaaaanaangacaanaaaaataacaaccccggccgagggccacgacccaccacgggcggccacggtaggcggcacgccgctatcggcgactggaaatcttggtgtccccagccccaggtgccaacccactgtatgctcggctggatgggaggattcatacccccctcaatgctggaggagagggtttccctggagggtcatgcaatggtccccggcctttttctattcgctgaaccaagtaggaaaataaccccccccgggaaggggttgccgtttcccaaggccgcccctggcagccctccaagcataaaaataatggggtggctccgcccctgtcctcgctgcgcctcgctactaa

SEQ ID NO: 58455 - protein, 80 aa, Zea mays
  misc_feature: Ceres CLONE 1511705
  misc_feature (76)..(76): Xaa is any aa, unknown, or other
  misc_feature (77)..(77): Xaa is any aa, unknown, or other
  misc_feature (79)..(79): Xaa is any aa, unknown, or other
MPGIIHKIEEKLHMGGDHKNKEEEHHKKAEEHHKKEEGEHHKKDGGEHKEGILEKIKDKIIGLVRPTSRGGGGGKXXQXK

SEQ ID NO: 58456 - DNA, 687 bp, Zea mays
  misc_feature: Ceres CLONE 1511706
  misc_feature: Pfam Name: Ribosomal_L38e Pfam Description: Ribosomal L38e protein family
ggagctccccgcggtggcggccgctctagaactagtggatcccccgggctgcaggaattcgtctcacccctagaaaaatccgaatttcaatccagtcgtgcgatccgcgcgccgctgtcagaagaagagctcgagcgattccgagcgtcccgcgagaatctgccgaagcgaatgcatgagattaaggacttcctcctcaccgcgaggaggatcgatgcccgctcagtgaccatccacgaagagtgatgatgttgtctcggtgcacgggctctgctccaagtacatgtacacgctcagcgacatctaggcgaataaggcgcacgtcctgaagccatctcttcacgcctatttgagcgtccagcaggtcagagtggatacaggctacgccaagttgaactaccgaagctgctttgacctatcacagcatgctcctcgatgggacttatggattctagtccatgggaactgtcattgttggacgtcaggatctcgccgtcatcggagaactacggctgataccccgatcagggatgcggcgtttcgtaattaagctgggagtgtggacaaaaaaaacatctacgattcccgggttcggggggacctggaaatgatttttgccctaaaaagggggggcgcggcccatagggcccccttaaacgatcacgaattggggggccctcgagggcc

SEQ ID NO: 58457 - DNA, 680 bp, Zea mays
  misc_feature: Ceres CLONE 1511707
  misc_feature: Encodes the peptide sequence at SEQ ID NO. 58458
  misc_feature (622)..(622): n is a, c, t, g, unknown, or other
aagctggagctccccgcggtggcggccgctctagaactagtggatcccccgggctgcaggaattcgtctcacccctagaaaaaacctccatccagcttgagccagcccgtcgcctgcgcgcatctctctacacttctactgcttcatactctcgtagagagatccccgcggcccaataaaaacccgactcgctagctgcactacacactcgcagatggccggcctcaggatgaagttcgtcgccgtcgccgccatggccgccgcgctcgtggcgtccgccgcagccgccgaggcccccgccccggcccccgcctccgacgccgcggccgccgtgcccctcgccgcggcctccctcgccgccgccgccttcggctacctcttctgctagatccgcgctggacacccggtttgtgcttgatttgtgattcgtctggcgcgagtggagtccgtgtcgtgcgcgtgtctgtgtgagttgtttcggcgggcgtgtgtctgtatgtatggagtcggcggcggcggaggtgtgcgcgtggtggtacgtgcgtcgacgctccattgtttgtggcggcgatcatgtgcctggcccgttttctggttatcaatgagatgatttatttgattnccaacgaggaaaatagtagaccacctagtgccgataccaattattactgaccaaagta

SEQ ID NO: 58458 - protein, 57 aa, Zea mays; identical to SEQ ID NO: 43282
  misc_feature: Ceres CLONE 1511707

SEQ ID NO: 58459 - DNA, 684 bp, Zea mays
  misc_feature: Ceres CLONE 1511708
  misc_feature: Encodes the peptide sequence at SEQ ID NO. 58460
aagctggagctccccgcggtggcggccgctctagaactagtggatcccccgggctgcaggaattcgtctcacccctagaaaaagtgctctctcgcatgtgggctggcttctcctccccctcttacctacgtcctcctcgggttacggatccttagggttttgtgaaggcgccatggccttcgctgatgggcactaccgctgcttcatctgcggccttggctggggcgccagcacccagtctctggaaaatggctacgactcctacagccacatccaccactcccaggtcatcacctaaccggagaccgcgaggtctcgcggcttgcggattagttaccttctcctccgagaactccaatgctcgacgctctctacaacgtgagctgcatggagctctcctgccggaacgtctccgtgccccgtgcccaatcccgtgcttccggtcgtggctcgctccaggctacgccggctgtccctcccctcgcgtctaatgaggccggatccgtgctccgcagtatatagctgctgtggcagctacagcagactacttctcaggtgtaggccctgctgctatctgaagctgttttttctacggcacatcgcacgagggtggtggtggcgtctacggtttgtactacccttgctgcagggactgatttgtgaacccatcctggcttcggccga

SEQ ID NO: 58460 - protein, 41 aa, Zea mays
  misc_feature: Ceres CLONE 1511708
MAFADGHYRCFICGLGWGASTQSLENGYDSYSHIHHSQVIT

SEQ ID NO: 58461 - DNA, 505 bp, Zea mays
  misc_feature: Ceres CLONE 1511709
  misc_feature: Encodes the peptide sequence at SEQ ID NO. 58462
  misc_feature (190)..(190): n is a, c, t, g, unknown, or other
  misc_feature (191)..(191): n is a, c, t, g, unknown, or other
  misc_feature (199)..(199): n is a, c, t, g, unknown, or other
  misc_feature (200)..(200): n is a, c, t, g, unknown, or other
  misc_feature (228)..(228): n is a, c, t, g, unknown, or other
  misc_feature (248)..(248): n is a, c, t, g, unknown, or other
  misc_feature (253)..(253): n is a, c, t, g, unknown, or other
  misc_feature (256)..(256): n is a, c, t, g, unknown, or other
  misc_feature (398)..(398): n is a, c, t, g, unknown, or other
aagctggagctccccgcggtggcggccgctctagaactagtggatcccccgggctgcaggaattcgtctcacccctagaaaaagacctgcagccaaccatctaccagcgactcagcgagcgagagcagcacacacgcagctagctaggagcagcagcagagcagcggcgatggcggcctccatggatctnncctcgtcnnagctctgggcggtggggcgcctcagggncctgggccgccccctcgggnccggncgncgccctccctccttttcggccggtcgttctgggtccccaggaaagaaagattctcgggaccggcaaaaggcccttaagggggaatttggggggggggggccccttgaacccctctttaaaaatttttaaaaacccccccaanggggggaaaaaaaaaaggggggccaagggggggggcaaaaggggggggggggttttaaaccaaaacacaatttttttttgtcccgacaaaaacaaaaaaaaaaaaac

SEQ ID NO: 58462 - protein, 71 aa, Zea mays
  misc_feature: Ceres CLONE 1511709
  misc_feature (8)..(8): Xaa is any aa, unknown, or other
  misc_feature (11)..(11): Xaa is any aa, unknown, or other
  misc_feature (20)..(20): Xaa is any aa, unknown, or other
  misc_feature (27)..(27): Xaa is any aa, unknown, or other
MAASMDLXSSXLWAVGRLRXLGRPLGXGRRPPSFSAGRSGSPGKKDSRDRQKALKGEFGGGGPLEPLFKNF

SEQ ID NO: 58463 - DNA, 679 bp, Zea mays
  misc_feature: Ceres CLONE 1511710
  misc_feature: Encodes the peptide sequence at SEQ ID NO. 58464
  misc_feature (485)..(485): n is a, c, t, g, unknown, or other
  misc_feature (539)..(539): n is a, c, t, g, unknown, or other
aagctggagctccccgcggtggcggccgctctagaactagtggatcccccgggctgcaggaattcgtctcacccctagaaaaatcgccattcgccacaaagccatttgaaccccccacgtctcctcgcctcgttccccatttgctgcgtctccttgcccgcgccgccgctcgccgtttgcccctcgtctccgcaccgcgcgctgttgtccatccttgtgcagcaaaaatgacggctggctacattgttggctcactggtcggatcctttgccattgcatacctgtgtgacacatttatctctgacaagaaggcatttggaggtagcacccccaagactgtttctgagaaggagtggtggcaagccacagacaccaagttccaggcctggcctcgcactgctgggccaccggttgtcatgaaccccatcagccgccagaacttcatcgtcaagtccactgagtaagtttgggctggagaagctggntctgcgacttggtgcgccatgaaagcagagttccttttctaagggtctaatcanttggtataaaacgaatacagtcaggatttttttgtgatttttacttgatctgggaacgaacactggggctttccacttgtcatcccaggggttctgcctcctggtgaatccccccaccgcagtaaagaactggggtgttt

SEQ ID NO: 58464 - protein, 78 aa, Zea mays
  misc_feature: Ceres CLONE 1511710
  misc_feature (3)..(75): Pfam Name: DUF1138 Pfam Description: Protein of unknown function (DUF1138)
MTAGYIVGSLVGSFAIAYLCDTFISDKKAFGGSTPKTVSEKEWWQATDTKFQAWPRTAGPPVVMNPISRQNFIVKSTE

SEQ ID NO: 58465 - DNA, 670 bp, Zea mays
  misc_feature: Ceres CLONE 1511711
ggagctccccgcggtggcggccgctctagaactagtggatcccccgggctgcaggaattcgtctcacccctagaaaaaacaagccacacgccgacgcctcggtctctgcttccctctccattttgtcatcacattcggtgccgcgataccccctgctcgtcactcgcaatggcccggatcaaggtgcacgagctgcactggaaagagcaagatggatctgcaagcgcagctcatggagcttaaagcgtagctctccctcctactcgtcgccaaggtcaccggcggggctcccaacaagctctccgaaaacaagattgtgcgcacctccaacgctcgcgtgctcgccgttatctcggacaagtagaagtcggtcctgcgtgacgcgtacaataagaataaccttctcccgcactatctctggcacaagaagaaccgcgccatactcaggcgcctcaccagaaccagctctccttgaagacagacagggaaaacaaccatgataagtattttcccatgcggaaggacgctatccaggcctatattagtgaaagaacagcttttatcccatctagttttgcccagaagtaatttgagtctgatgttccccacatcattcgccactacaaatgttcagttgtatgatgaaaaaatgttttgccccaaatttcct

SEQ ID NO: 58466 - DNA, 570 bp, Zea mays
  misc_feature: Ceres CLONE 1511712
  misc_feature: Encodes the peptide sequence at SEQ ID NO. 58467
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
ggagctccccgcggtggcggccgctctagaactagtggatcccccgggctgcaggaattcgtctcacccctagaaaaaatccaacaaccagcagtgcaacaagcaagatttacctgcccatcgatcatatcgtcaactggtccggcagttcgcgacaccatgagctccacggagtgcggcggcggcggcggcggcgccaagacgtcgtggcctgaggtggtcgggctgagcgtggaggacgccaagaaggtgatcctcaaggacaagccggacgccgacatcgtggtgctgcccgtcggctccgtggtgaccgctggattatcgccccctaaaccgtggtctgcaatcttcgttcgaaaaatcttttccccccaaaaaaccccccccccaaaatggggggggaaaaaaaaaannnaaaaaaaaaaaaagcgccccccttttttttttctttttttccccccaacgtgggaaaataattttttttcaaaaaaaacccgcccggggccccccaaaaaaaaagggggggggacactccctccccccccaccaaaagagaaggaggaggaggga

SEQ ID NO: 58467 - protein, 137 aa, Zea mays
  misc_feature: Ceres CLONE 1511712
  misc_feature (14)..(80): Pfam Name: potato_inhibit Pfam Description: Potato inhibitor I family
  misc_feature (85)..(85): Xaa is any aa, unknown, or other
  misc_feature (86)..(86): Xaa is any aa, unknown, or other
MSSTECGGGGGGAKTSWPEVVGLSVEDAKKVILKDKPDADIVVLPVGSVVTAGLSPPKPWSAIFVRKIFSPQKTPPPKWGGKKKXXKKKKRPPFFFLFFPPTWENNFFSKKTRPGPPKKKGGGTLPPPPPKEKEEEG

SEQ ID NO: 58468 - DNA, 771 bp, Zea mays
  misc_feature: Ceres CLONE 1511714
  misc_feature: Encodes the peptide sequence at SEQ ID NO. 58469
ggcggccgctctcgaactagtggatcccccgggctgcaggaattcgtctcacccctagaaaaaacgccatccatcgcaatggccgccgccgccgcgctcctcctcctcctgtgcgccgcgtctctcgcgtccgcagccgccgacgacgggttgacgaccttcaaggtgtacttccacgacgtcgtggcggggacgaacccgacggcggtgcgcatcgcgcaggcggcgtcctccaacacgtcgtccaccaacttcggcgcggtggtggccatcgacgacccgctgacgacgggtcccacgcgcgccgcgggcacggaggtgggccgcgcctagggcccctacacgttgggggggagggagagacgttcggcctccttcatggtcacccccccctcctggttcacggccgggcgaggcccagcgggcatgcacgcttcggctatctcttggccgccaacaaggctgtttcgcccaccccccgccaggagggagcatccgcttagggggccgcctggcaagtttttggtagtggttccgtcccgtcccggggcttgaatcccccccctattcaagcgccgggttagcccccctccggggagtacttgagcgcgacccaatgtggcctcttatccccggtcttaggggcccgccgccgctttgtactccctcccgccggattatatatagcgcgtgcgcagcgcccgttggtttgtcttttgatcgcggcgcgctccgccatacaatttcccgcgcccgccgcttttatcgcgg

SEQ ID NO: 58469 - protein, 84 aa, Zea mays
  misc_feature: Ceres CLONE 1511714
MAAAAALLLLLCAASLASAAADDGLTTFKVYFHDVVAGTNPTAVRIAQAASSNTSSTNFGAVVAIDDPLTTGPTRAAGTEVGRA

SEQ ID NO: 58470 - DNA, 684 bp, Zea mays
  misc_feature: Ceres CLONE 1511715
  misc_feature: Pfam Name: PSI_PsaH Pfam Description: Photosystem I reaction centre subunit VI
ctggagctccccgcggtggcggccgctctagaactagtggatcccccgggctgcaggaattcgtctcacccctagaaaaaggaagctcgccgtcgccaggccgtcggcccgctccatccgcaggccccgcgcagccgccgtggtggccaagtacggcgacaagagcgtctacttcgacctcgacgacatcggcaacaccaccggacagtgggacctctacggctctgacgcgccctcgccctacaacccgctacagagcaagttcttcgagacgttcgcggctccgttcaccaagagaggtctgctgctcaagttcctgctgctgggcggcggctcacttctggcctacgtcagcgcgtcggcgtcaccggacctcctgccgatcaagaagggacctcaggagccgccgcagccgggcccgcgcggcaagatctaagctcagctactccatttgcatggtctagtagtagcttgctttgtactgctagcgccggtcgatccgtcgcaatcgtcatggatcatctctctatcttgttgttacgctgttcataatttggtatattcgccatgctgctattgtgtactctttggcatacatacaataaactaaattgcgttgcgtggctctcatataaaaaaaaaaaaaaaacgagacgctcgaggtacccaattcgccctatagtg

SEQ ID NO: 58471 - DNA, 699 bp, Zea mays
  misc_feature: Ceres CLONE 1511716
  misc_feature (699)..(699): n is a, c, t, g, unknown, or other
aagctggagctccccgcggtggcggccgctctagaactagtggatcccccgggctgcaggaattcgtctcacccctagaaaaaatacctctccccgttcggagcccctcaccctcatcctctctcccttcaccgagtcctcttgcggcatgccacgtcgcgagtgccctcgctctctgctctactgcgtgctgattcattgacccatcgatcttgaccagatgagatggtttagactacctccacctctggctcccatcaacccagcgagcatgacctgtaacagctgctgctgctgcagatgataatactactcatggcatggccgccaggtatgacagcagtggagctccagcgtgtttccctctacggcaccgtctccaccaccggcgtcgaccatgaccccccccacgatgagagcacgtgttcctcggtgcggccggggcgatcaagctctgatgctccgtcatgttctgctagcaggaccactcactgggttgggtcgcgggcatcaagcacatcttctgctcccccggatgcgtcataaccatcaccacttttggcctgtgacgctgtaggcgtcaacttcccacaatcaaccccccgactacgggtcacctgaaaaccctcgtttgcgacgtaataggcatccgctttttggtttaacggggcgccccaatccattttgacccggatctan

SEQ ID NO: 58472 - DNA, 671 bp, Zea mays
  misc_feature: Ceres CLONE 1511717
  misc_feature: Encodes the peptide sequence at SEQ ID NO. 58473
  misc_feature (671)..(671): n is a, c, t, g, unknown, or other
aagctggagctccccgcggtggcggccgctctagaactagtggatcccccgggctgcaggaattcgtctcacccctagaaaaaaatcccctccctgttctgtaccactctccctcttcctctctcccttccccgcctcctcttgccgtacgccacgtctcgagtcccctcgccctctcctcgcctgcgcgctgatccaccgaccgaccgctcgcgacgagtcaaaggggcgaggacccctcgacctcttcctcccagcaacccagcgagcatgacgtgtaccggcagcggcggcggcggcggcgagcactactcgcggcaggtccgcgagctctgcgcgctgctgctcgccatcgtgtccacctccccggcgccgccgcggcagccggtgtcaaccacaaccccagccgcggccgcggccatgctcctcggcgcgtcggtggcgctcatgctctgcggctccgtcaccttcgccatcggcttcctcctcatgccctgtggcgccggcctcgcgctcctcttcggcttcgccggcgccgtcaacaccctctcttcctcggggctgttcctctgcaccggcagaggcaacaagcagtcccccgccgcgggcctctgcaaacacacgcgggtgaccgatcggcatcgggctccggccgccggggccccaaccan

SEQ ID NO: 58473 - protein, 133 aa, Zea mays
  misc_feature: Ceres CLONE 1511717
MTCTGSGGGGGEHYSRQVRELCALLLAIVSTSPAPPRQPVSTTTPAAAAAMLLGASVALMLCGSVTFAIGFLLMPCGAGLALLFGFAGAVNTLSSSGLFLCTGRGNKQSPAAGLCKHTRVTDRHRAPAAGAPT

SEQ ID NO: 58474 - DNA, 690 bp, Zea mays
  misc_feature: Ceres CLONE 1511721
  misc_feature (690)..(690): n is a, c, t, g, unknown, or other
ggagatcaccgcggtggcggccgctctagaactagtggatcccccgggctgcaggaattcgtctcacccctaggggaggcgacaccaccaaacgcctctctctctctctctctctctctctctctctctctctctctctctctctctcgcgggagctctctgtctgtggcagaataaggaggaggaagtaggggaggagggagtggagggggccgtgagagtggagagagaagggaagcagttaagggatgggtggagggaggggaatgaggagcgggagagagggtagaggagcgcgggggggagcaggaggggggagaggggagggggcgggggagaggggggggggggggagagagagagagagaaagagaaggagggcagatagagagaggagtacaaatagagcggagaggagagataggcaagagagagcgcgagaggaagcgagatgtagtcctaaaaaacacgtttgaaggaaggcatggtggggaggagggacgaaatcgttagaaaactgaaagaagggaggcagatggacaagagaagtatacggtgagagaagaagagttgaggaaaaaggccatgaggtgggggaaaaaaaaaaaaagaaacgagagggttctagggaaccaaaatcagcagtaaaggggaggagggaataagggggggggaagtgggagggagaan

SEQ ID NO: 58475 - DNA, 686 bp, Zea mays
  misc_feature: Ceres CLONE 1511734
  misc_feature: Encodes the peptide sequence at SEQ ID NO. 58476
aaagctggagctccccgcggtggcggccgctctagaactagtggatcccccgggctgcaggaattcgtctcacccctagaaaaagcccttcgcttgggttcagtaaagtttccccttgccctcaggttttagctcgagaccactgcgtaagtgctggaattcctgtgttcacgctagtactcacctctccccagtcaccaaactttgcccctcacagaaacttgcacgccatcttcctgccagtggtgaccacgcccacccgttcttaacctcaccatggccagggttcgtggagattgtctcggccgtgttgtgctcgttccttgtttctcacagagtgccaagaaggagattctgaagaggagtctactccagtgtctgctgatcaagtgattcagctatctaactggttatggggtagaagtatctagaacctcttctctgcaacaaaggagaagttttattcccttatcttttggttagttacttcatgtggaggacttgaagcttagaaggtttttatatatctcttatggaaaggcttcacccttccaattattgtaataagttatgcacttcgagtactatcaggacttgtaataaatacatctctttataccatgtaaaacttgagttctggaatgtaaagtgtactttgtaaaagtcttccgctctatctccaatgt

SEQ ID NO: 58476 - protein, 38 aa, Zea mays
  misc_feature: Ceres CLONE 1511734
MARVRGDCLGRVVLVPCFSQSAKKEILKRSLLQCLLIK

SEQ ID NO: 58477 - DNA, 684 bp, Zea mays
  misc_feature: Ceres CLONE 1511736
aaagctggagctccccgcggtggcggccgctctagaactagtggatcccccgggctgcaggaattcgtctcacccctagaaaaatagtactgcttaactagaactaatcaatattttctttgttcagtgcattcaacgaaacaatcctgattttgggtaattagcagcagcaatacatgatacgtccttgctgaagcctgaacttgattgtcatggaaactggcagtgatttccaaaaaaagaagaagaaagaaacgaactatttaccgacacagctcctcgactactattcattcacacctttctgcgagttctccttcccgattaatgtcgcctacttgtgcagctcattgcttgtggcgtcgctgtggccacctacaacgacggggcaacggatttcaaacacacgcctgcttacaaggaatcccaatcacaggagttccctgaggagtcggaatcatcgagcgctgatgtgttcgaaggcaacccgactgaggtagcaccagctcttgagtaggactagcaaggaggcacgggggagaaaacttgtctgtctattcaagctttagcaccagctcttcgcgtttggcgtatagatgtaaaaaggttgggttaaaatctgatgccacaaaaattggctgggaacacaaaaaacccccccccccccctatgtccccccgaccg

SEQ ID NO: 58478 - DNA, 660 bp, Zea mays
  misc_feature: Ceres CLONE 1511740
  misc_feature: Encodes the peptide sequence at SEQ ID NO. 58479
ggcggccgctctagaactagtggatcccccgggctgcaggaattcgtctcacccctagaaaaaatcttcaaaagctacagctgcagcacacagatttgcagatagacctcacctatctactccagctcgaagcagacacagcatctagctagctagttggttattggcaaagagcgtccgtgacctgtgagaaccgactgagtgaagtggctgctgtctaggttgagtcgctcttggagaagacgcgcagcgcggccgatgctaaccgcggtgaggtacgggtatgacctgcatagctactaccagaacttcgacgacggcggtgacacctgcgcccaccaccgcttgtagctcgtgcagcagagcttatatgttcgctaccaccctaattgccggtgactattactaactagctgttacagcgcaaaactccttgcccctgactatgcgttcaatgtggagctatctcattgaacccttgcaccacaaatggaatatccgtttccttatcataacaatgatttcttgatggctttctggatcctggtgttccacgggttttaacttcacctaccccatacctcgatacccccctcgaggggtcccccacatttcccccccctataatggtggggggtcgttaaatttcacccccttttt

SEQ ID NO: 58479 - protein, 30 aa, Zea mays
  misc_feature: Ceres CLONE 1511740
MLTAVRYGYDLHSYYQNFDDGGDTCAHHRL

SEQ ID NO: 58480 - DNA, 615 bp, Zea mays
  misc_feature: Ceres CLONE 1511754
  misc_feature: Encodes the peptide sequence at SEQ ID NO. 58481
  misc_feature (396)..(396): n is a, c, t, g, unknown, or other
ggagctccccgcggtggcggccgctctagaactagtggatcccccgggctgcaggaattcgtctcacccctagaaaaatttgttgttggccacctttatctcgtgatgtttgtgtgcatgtgaatactctgaatgtgcatttcgaagatcaactcgcaattccgcattcgttccaactcctgagcactttctcctcgtcccagacaagccaatcgaagccgagatacgaccatggactccaccggcaccggagcagggggtaaggggaagaagggagcggccgggcgcaaggtcggcgggccaaggaagaagtcggtgtcgaggtccgtgaaggccggtctccagttccccgtcggccgcatcgggcgctacttgaagaagggccgctacgcgcancgtgtcggcaccggcgcccccgtctacctcgccgctgtcctcgaatacctcgccgctgaggttctggagcttcgcggtaatgctgcccaggaccacaagaagactcgcattattccgcgccacgtgctttctggcaatccggaacaacaaggaacttgggaagctggttggggggcttgaccctcgctccaggggggggggctcccccaatatcaaccc

SEQ ID NO: 58481 - protein, 114 aa, Zea mays
  misc_feature: Ceres CLONE 1511754
  misc_feature (31)..(101): Pfam Name: Histone Pfam Description: Core histone H2A/H2B/H3/H4
  misc_feature (55)..(55): Xaa is any aa, unknown, or other
MDSTGTGAGGKGKKGAAGRKVGGPRKKSVSRSVKAGLQFPVGRIGRYLKKGRYAXRVGTGAPVYLAAVLEYLAAEVLELRGNAAQDHKKTRIIPRHVLSGNPEQQGTWEAGWGA

SEQ ID NO: 58482 - DNA, 839 bp, Zea mays
  misc_feature: Ceres CLONE 1511766
  misc_feature: Encodes the peptide sequence at SEQ ID NO. 58483
  misc_feature (35)..(35): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (52)..(52): n is a, c, t, g, unknown, or other
aaacaaccgtatttacccttctttccccaacctcnccccccctnnncttttntatactggaactccccgcggtggcggccgctctagaactagtggatccccgggctgcagaatgcgtctcacccctagaaaaagctaacgccgctcgcgcatcctattgccctcgcgccaccgtcgccgccgctgcagcgagccaccgccctgccgtcgcctgaggtagacaccaagccaccgccatggggcgtatgtacagccgcgggaagggtatctctttcgtcggcgctggccgtacaagagggactcctccgattccgggctctagacagactacaggcggacggttggcaccaaattaatttccccccgtcttttttaggaaaggctcccgctggccttccacaaaaattgcgggtccctgcctacccgggacccatgataggcgctccccgcctttggtcaaaaaccgcgcacttcggaaacctaacgtatccctccgcttatcccccccccccccccccagggggtgttgcgccccccccaactatatccccgggaagactttttccctatccttttctcctttaccccacaaatccccctattgccgccttttattgcgacatctcttttttggccggccgcataattcggtttcgtgacatgcacgaaccctcttcaaatttttccgtcccgtctttttgcttttggttggaaggcccgtttgtctctttccccttccccgcgttgtcctttctcccatcctcctcgaattgatctccacgctcaaacaggttttctccccgttgactccccgtggtctccttctcttcgtcctttta

SEQ ID NO: 58483 - protein, 39 aa, Zea mays
  misc_feature: Ceres CLONE 1511766
MGRMYSRGKGISFVGAGRTRGTPPIPGSRQTTGGRLAPN

SEQ ID NO: 58484 - DNA, 744 bp, Zea mays
  misc_feature: Ceres CLONE 1511768
  misc_feature: Encodes the peptide sequence at SEQ ID NO. 58485
tccccgcggtggcggccgctctagaactagtggatcccccgggctgcaggaattcgtctcacccctagaaaaagcctcgcatcaaaccaactctttcccaaatccaccgccggctcggctcgcccttctccgcgccaagcacccaagctccgatggcccgcacgaagcagacggcgcgcaagtcgacgggcggaaaggcgccccgcaagcagctggccaccaaggcggcgcgcaagtcagcgccggcaaccggtggcgtgaagaagcctcaccgcttccgccccggaacgcgtcaagctccggggagattcccaagtgccagaagagcacgggagctgctcatcccgaaagtctgccccatcatgggccggggggcgggggatcctcccatgaacttcaagaaagggggccccccccaaccaacaatccaactagggcctccagattccccccagcaccccaaagggggaaaaagccctgtggcgggcttccccggggggaccagactcgcacgccccgtaaggcgtgtaaacccccgcgcagtaccacggccgcaatgaacccccgcgatcgttcgcccggaaatacccagcaccgcgcaaaaaacccggccacctagtccccaaaatccccccaactctacccgggccgacggtacccccgccgccaagtataatacgggccggaaacgccgtaacgcatatccggggcgggcgcctcacagaagcgcgcgcgggcgtacgc

SEQ ID NO: 58485 - protein, 135 aa, Zea mays
  misc_feature: Ceres CLONE 1511768
MARTKQTARKSTGGKAPRKQLATKAARKSAPATGGVKKPHRFRPGTRQAPGRFPSARRARELLIPKVCPIMGRGAGDPPMNFKKGGPPQPTIQLGPPDSPQHPKGGKSPVAGFPGGTRLARPVRRVNPRAVPRPQ

SEQ ID NO: 58486 - DNA, 705 bp, Zea mays
  misc_feature: Ceres CLONE 1511970
  misc_feature: Translation starting site: 466
  misc_feature (408)..(408): n is a, c, t, g, unknown, or other
  misc_feature (519)..(519): n is a, c, t, g, unknown, or other
  misc_feature (520)..(520): n is a, c, t, g, unknown, or other
tccccgcggtggcggccgctctagaactagtggatcccccgggctgcaggaattcgtctcacccctagaaaaagctgaacccggacggcactgtgaaggtggtgaacgagacgtgggccgacgggcgccgcggccacatcgagggcacggcctggcgcgccgaccctgccagcgacgaggccaagctcaaggttcgcttctacgtgccgcccttcctccccctcatccccgtcaccggcgactactgggtgctccacatcgacgccgactaccagtacgcgctcgtcgggcagccctccaggaactacctctggatcctttgcaggcagcctcacatggacgagtccgtgtacaaggaactgggtggagcgtgccaaggaggaagggtacgacgtgtcgaagctccgncagacggcgcaccctgacccgccgccggagagcgagcagagccccagggacggcgggatgtggtgggtcaagtccatctttggcaagtacccttgtggtggtgggtggcanncgcggtgctgccgtgccgagcaggcgagcgcacgcaagagatgcctgtgaccgtcggttccccgtgtacattcacactagctggggattaagttggttcgtgttgctgccccatctgaaatggcaaaaaggtgcttgtttctgccccgcttgattgaatcaactttaacggatgtttcgtttgcg

SEQ ID NO: 58487 - DNA, 564 bp, Zea mays
  misc_feature: Ceres CLONE 1511978
  misc_feature: Encodes the peptide sequence at SEQ ID NO. 58488
  misc_feature (257)..(257): n is a, c, t, g, unknown, or other
  misc_feature (366)..(366): n is a, c, t, g, unknown, or other
gctcttgaacttgtggatcccccgggctgcaggaattcgtctcacccctagaaaaaaaagcctccgcccccttccctgacaccctcgccgccgcgcacgcacgcacgaaccagcgaagagatgggcgtctacaccttcgtgtgccgcagcgccggcggcggcgagtggaccgccaagcagcactccggcgagatggaggcctccgccgccaccccctacgagctgcagcgccgcctcgtcgcccgcgcctccgcggncgactccgcgtccggcgtccagtcgtccttctccatggtcacccccagctccgccgtcttcaggtgatcctcggtgttgcgcgatgatggtagtggccgggcggcggcnccggttcccccccccccccccaccaggtggcgcctccgcccaaaactcccccgggagggaaaaaaacggaaaaggaaaaagggaaaaaaaccgcccaacaaaactggggaattcccccccgggttccaacaaaaaaattaaaaccccggggggggggcaaggggtttccccgtttccccccgggggggggggcccccc

SEQ ID NO: 58488 - protein, 67 aa, Zea mays
  misc_feature: Ceres CLONE 1511978
  misc_feature (46)..(46): Xaa is any aa, unknown, or other
MGVYTFVCRSAGGGEWTAKQHSGEMEASAATPYELQRRLVARASAXDSASGVQSSFSMVTPSSAVFR

SEQ ID NO: 58489 - DNA, 690 bp, Zea mays
  misc_feature: Ceres CLONE 1511979
  misc_feature: Encodes the peptide sequence at SEQ ID NO. 58490
ataagctggagctcaccgcggtggcggccgctctagactagtggatcccccgggctgcaggaattcgtctcacccctagaaaaactcccggccgccgccaccacttgctcgcctttgccccttccccttctgtcacccttcgtccgtagcagaccaggaacgcccaaggcgctagcgtctccaagatggtgctgcaaaacgacattgacttactcaatccaccggcagagcttgagaagctaaagcacaagaagaagcggctagtccagtcccccaactccttcttcatggatgacaagtgccagggctgtttcagcatgaccactgtgttcagccactcccagactgtggttgtgtgccccggctgccgaggggggggctgccaaccaactcgtgggaaaggtggggcccaccaacccccgctccattctggtaaaagggcagatgagggtcctgcttctcctaacgtaacaaaagataaattttggcggtttggcaacgtatcccgggactttgtgcattgtttttcggagaggatttggtttagatagtgatgggtgggttagggggggccgtgaaatagctggcggggaacctgtccacatggggtgcgggcgcccgtgggaattctcccgttcgcggggtctatggccaaagggaaaacccacgcgggtgtgagtcggttgatgt

SEQ ID NO: 58490 - protein, 121 aa, Zea mays
  misc_feature: Ceres CLONE 1511979
  misc_feature (30)..(84): Pfam Name: Ribosomal_S27e Pfam Description: Ribosomal protein S27
MVLQNDIDLLNPPAELEKLKHKKKRLVQSPNSFFMDDKCQGCFSMTTVFSHSQTVVVCPGCRGGGCQPTRGKGGAHQPPLHSGKRADEGPASPNVTKDKFWRFGNVSRDFVHCFSERIWFR

SEQ ID NO: 58491 - DNA, 697 bp, Zea mays
  misc_feature: Ceres CLONE 1511985
  misc_feature: Encodes the peptide sequence at SEQ ID NO. 58492
caaagctggagctcaccgcggtggcggccgctctagaactagtggatcccccgggctgcaggaattcgtctcacccctagaaaaaatcgcatccatccaccacgcaccccaccaacccatacccataccagaggctctctgattttacttctcagcggtagatcggctgagcgagcgagcgagcgaggcacacgggtagaaaagcaagatgtcggacggcacggcgacctgcatcgacatcatcctcgccatcatcctgccgccgctcggggtcttcttcaagttcggctgcggggttgagttctggatctgccttatcctcaccttcttcggctacctccccggcatcatctacgccgtctgggccatcaccaagtagcccggccggagcagagcaaccacggcccccccccaatgactcccgcgcgtgcgttagcatgcaaggtcttgagatggggatccctccctcctttgttaagctgccggcggcccccgctggtgtacccccgcccttttcatatcctagattaactcgctcccgcgaaagacattaggcccccgggccgcggggttgttggccaccctccttggccctagttcgaacccttcccccgcctggtacactgacgacccccttccgcccacgtttgggcgaacccgcgaacctccgccgctttccaaatccccaaaccgacag

SEQ ID NO: 58492 - protein, 56 aa, Zea mays; identical to SEQ ID NO: 52841
  misc_feature: Ceres CLONE 1511985
  misc_feature (6)..(56): Pfam Name: UPF0057 Pfam Description: Uncharacterized protein family UPF0057

SEQ ID NO: 58493 - DNA, 870 bp, Zea mays
  misc_feature: Ceres CLONE 1511992
  misc_feature (28)..(28): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (62)..(62): n is a, c, t, g, unknown, or other
ttttgcccgtttttttccttttcacttnaaaannnnnnnnnnnnnnnnnnnccagagctggngctccccgcggtggcggccgctctagaactagtggatcccccgggctgcaggaattcgtctcacccctagaaaaatgctttcttagaggtgggttggcttctccttcccctccggttcgggttcgggttcgtgaggttctccggggtgcggttttgtgggtgatcggatctcgatggcggcgtcggatgttgagtacccttgcttcgtcggcggccttttttggtgttcggacgaccattatcctctcccacgccttccgggctttcggcgaggttttttagtttctgatccatccccgattcgggacgactcataggtgcccgcttgtctcagcctttttccctcttcgccctcggtaggagggtgattgcaagaaaccccggtcttagggtattgtatttgcagtgggaggttccccccccccccccaacacttattagtttaacttgtatgcccccgcttcccattctgtattttcccctgcttaggcccggcttgcgcgtgctgcccaaccatttgcgcctgtgcccttgtctttgttcccgtccggttttttcgcgcccgtggtgcgtggcgcccccgccttgctttggtcattttaggccgttctttattgggggctttttttttgctcgcccccgctctccgtgtgtgcggtccttgtcttgtttatttggcggcgggcggcgtggcgttttcttatacccgcggcggttgatacaccctttttattttgatttgccctggcgcggactttgccctccttttaccacagtgcgctagcaccctacgtcgggggagggtttt

SEQ ID NO: 58494 - DNA, 810 bp, Zea mays
  misc_feature: Ceres CLONE 1511993
  misc_feature: Encodes the peptide sequence at SEQ ID NO. 58495
  misc_feature (90)..(90): n is a, c, t, g, unknown, or other
  misc_feature (326)..(326): n is a, c, t, g, unknown, or other
  misc_feature (338)..(338): n is a, c, t, g, unknown, or other
  misc_feature (339)..(339): n is a, c, t, g, unknown, or other
  misc_feature (395)..(395): n is a, c, t, g, unknown, or other
  misc_feature (397)..(397): n is a, c, t, g, unknown, or other
  misc_feature (398)..(398): n is a, c, t, g, unknown, or other
gcggtggcggccgctctagaactagtggatcccccgggctgcaggaattcgtctcacccctagaaaaagctgttcttgtttgttgtgtanccgccactagtacgaagccctcagtcctccctcacacaccgaaccgagcgcaccatgttctcggcggctggaggagtgaagaaaacggtgcgggcgtcccacttcctcatcaagcacgagggttcccgccgcagggcctcctggaaggaccctgacggccgcatcatctccgccaccattttttgccacgccggagggagcctcctgggacttccgtttttttattgtttaagganaaaaaaaaaaannagaaattttttcccccccccccccgggggaaatgaaaagggggaactcttttcttnanncccccggcctgtccccccggagggagaatggagaagaagcccctcaagagggcccgcgcgcgcccttccctccttggtgaaagctccccacgaccatctggatttcaggatggtgatgatacgggcaagaccaccaattactctcgacagcatcggggacaaaactgataccctcccatacactaaccactacattacttcaatctctctttctgggacgagagtgtgagtatacatgtgtactcggactcgaaagtctggttggcgctcgcgttccgcttctatatctggtcgcccgttgtcgccgtacggttatttttttgtagccacacttattgtttcgtcttggtgcgtgcgccggaacctgcgccttagcacgcgctgcgtttccttcatcgacgcatcaactata

SEQ ID NO: 58495 - protein, 160 aa, Zea mays
  misc_feature: Ceres CLONE 1511993
  misc_feature: SWISSPROT Homolog: EC 5.2.1.8 Peptidylprolyl isomerase
  misc_feature (61)..(61): Xaa is any aa, unknown, or other
  misc_feature (65)..(65): Xaa is any aa, unknown, or other
  misc_feature (84)..(84): Xaa is any aa, unknown, or other
  misc_feature (85)..(85): Xaa is any aa, unknown, or other
MFSAAGGVKKTVRASHFLIKHEGSRRRASWKDPDGRIISATIFCHAGGSLLGLPFFYCLRXKKKXRNFFPPPPGGNEKGELFSXXPRPVPPEGEWRRSPSRGPARALPSLVKAPHDHLDFRMVMIRARPPITLDSIGDKTDTLPYTNHYITSISLSGTRV

SEQ ID NO: 58496 - DNA, 716 bp, Zea mays
  misc_feature: Ceres CLONE 1511998
  misc_feature: Encodes the peptide sequence at SEQ ID NO. 58497
  misc_feature (407)..(407): n is a, c, t, g, unknown, or other
aaagctggagctccccgcggtggcggccgctctagaactagtggatcccccgggctgcaggaattcgtctcacccctagaaaaaagtctccccaacccatgcatcatacgccacaccctcccctccccacgcatcatacgccacaccctccccttacccttacgacaggccggttggacacggcgtgtactgcacccggagcccgccggtgatcagggagccatatgtttacccagctgaggaggtagccaccgtcaacgtcggcattcccatggcctactccaccccgcccatgagctaccctgctgccccctacggcggctatggcaacgggatgccagcttacaccaatggaatggctcctgccttccaccaggcttactaccggtaggttcagtcaggaaacnaagaagtcgctgatgaatgacatgacaacaactgatgatgccaacgactcgaaaccccgctcaatggccctgttttgtagcgactgactacaacggtaggttgggaacctcatcttccatgtccttacccaccgctactactagatgtgttggcctttagctctccgcctcatctttagtccgctaccggaaattttttttttaccacccctacctaagggaacctggaatgttaaattatgtatgggtattcagccagaacttgtcctccccaacccttatggtaaattttgtttccaaaacttttaa

SEQ ID NO: 58497 - protein, 39 aa, Zea mays
  misc_feature: Ceres CLONE 1511998
MAYSTPPMSYPAAPYGGYGNGMPAYTNGMAPAFHQAYYR

SEQ ID NO: 58498 - DNA, 735 bp, Zea mays
  misc_feature: Ceres CLONE 1512003
  misc_feature: Encodes the peptide sequence at SEQ ID NO. 58499
ggagctccccgcggtggcggccgctctagaactagtggatcccccgggctgcaggaattcgtctcacccctagaaaaaaccaaagcaaaccgaagccgcactctaccgcgctcctcccgaaccacagctatgctcgcccaccgcctcctcctcctcctcgccgtcgccgcggcgagcggcaccgccttcgctaagccgacggcgtacgaagccctcgctgactacgacttcccgccggggatcctccccaagggcgtggtcgcctacacgctcgacaacgccacgggcgccttcacggccacgctcgacgcctccgcgtccggcagcgggtcctccgtctgcgagttctccatccagggctcctactcgctccgctaccagaccaagatcaccggaaagatcccccccgaccacctcaacgacctcgagggcgtctccgtcaaggtcctcttcctctggctcaacatcgtcgaagtcaccccgcgcggcgacaacctcgagttctccgtcggcatcgtctcccgcgggatttcgggattgaaaaacttcctccgaggggccccactggggggctgcggggttccaatggcaaacaacctggttcctggctgcgaaaaaccccggggccccgccccccgccccaagcgggggcccggggcggggggggcccttcaaaaaaatcccaccttttttgcaaaatatttggggggaacggggtggccggtaaaaccctgg

SEQ ID NO: 58499 - protein, 202 aa, Zea mays
  misc_feature: Ceres CLONE 1512003
  misc_feature (3)..(153): Pfam Name: DUF538 Pfam Description: Protein of unknown function, DUF538
MLAHRLLLLLAVAAASGTAFAKPTAYEALADYDFPPGILPKGVVAYTLDNATGAFTATLDASASGSGSSVCEFSIQGSYSLRYQTKITGKIPPDHLNDLEGVSVKVLFLWLNIVEVTPRGDNLEFSVGIVSRGISGLKNFLRGAPLGGCGVPMANNLVPGCEKPRGPAPRPKRGPGAGGALQKNPTFFAKYLGGTGWPVKPW

SEQ ID NO: 58500 - DNA, 725 bp, Zea mays
  misc_feature: Ceres CLONE 1512007
  misc_feature: Encodes the peptide sequence at SEQ ID NO. 58501
  misc_feature (248)..(248): n is a, c, t, g, unknown, or other
  misc_feature (421)..(421): n is a, c, t, g, unknown, or other
  misc_feature (517)..(517): n is a, c, t, g, unknown, or other
  misc_feature (518)..(518): n is a, c, t, g, unknown, or other
  misc_feature (525)..(525): n is a, c, t, g, unknown, or other
  misc_feature (526)..(526): n is a, c, t, g, unknown, or other
ggccgctctagaactagtggatcccccgggctgcaggaattcgtctcacccctagaaaaaaaatatatccaacaaccagcagtgcaacaagcaagatttacctgcccatcgatcatatcgtcaactggtccggcagttcgcgacaccatgagctccacggagtgcggcggcggcggcggcggcgccaagacgtcgtggcctgaggtggtcgggctgagcgtggaggacgccaagaaggtgatcctcanggacaagccggacgccgacatcgtggtgctgcccgtcggctccgtggtgaccgcggattatcgccctaaccgtgtccgcatcttcgtcgacatcgtccccccggacgccccgcatcggctgataatatataagctagccgctatttccttttcttgccccagaacttgaaatnaatatatatacgatgaaataacgcgggcatgccgaataatggatgtgtgaattctcactaattaagtaatgcataaataaccgtattcaaatgccnnaaaaaannaaaaaaaacctaaacccttttatacttaaaacaaaaaaaatcaataatccacattaaccactttcctaaactctatttcactaccatgaaaggggagaatagtactgtgtgccggcgcctcgcgggggccccatttccccccaatagggggggggaatatcgggggcgccctgggggggtttttttaaaacggcgggag

SEQ ID NO: 58501 - protein, 89 aa, Zea mays
  misc_feature: Ceres CLONE 1512007
  misc_feature (14)..(71): Pfam Name: potato_inhibit Pfam Description: Potato inhibitor I family
  misc_feature (34)..(34): Xaa is any aa, unknown, or other
MSSTECGGGGGGAKTSWPEVVGLSVEDAKKVILXDKPDADIVVLPVGSVVTADYRPNRVRIFVDIVPPDAPHRLIIYKLAAISFSCPRT

SEQ ID NO: 58502 - DNA, 774 bp, Zea mays
  misc_feature: Ceres CLONE 1512010
  misc_feature: Encodes the peptide sequence at SEQ ID NO. 58503
caagctggagctccccgcggtggcggccgctctagaactagtggatcccccgggctgcaggaattcgtctcacccctagaaaaaaacagcgccactggccactgagcgcgtctggtttgcttagctaggagtcatgacctccatcgccgccctctccgtgaatcacgtggatgtcaagggtctcgtcggttgctctatctccctaaggaagcttcgccgtcgacaggctatttgtccaggccgtccccatgccccggccagacctcgtggtggccaactacggcgacaagagcgtctacattcatctcgataaccttgagggacgccatcagccagcggggaccaccagctgtttttgatggtctctttgtttttaaaccaccatgagaaataagggtctttggaaagctttttatggccccccccccccacaaaaaacaggatagccaggttccaggttctaagcttgccgggacccgcgggtttcacctcccccggccttaatgttaaggcccgtccacccccgctatttggtgaccttccgttcccgtattctaatattaggaggctcattctaacccaacttaggcaccagtgatatcccgcccccttgttgtatttggcgacgtctaagtagaattccccggtattacgtgtgccacccccttctaaacataagggttatttaataaaacaaaagcctctaaacaacatctaaatttcaaacagtaccccgagggcattcgctcctcccattaaatatgaattgccccc

SEQ ID NO: 58503 - protein, 36 aa, Zea mays
  misc_feature: Ceres CLONE 1512010
MPRPDLVVANYGDKSVYIHLDNLEGRHQPAGTTSCF

SEQ ID NO: 58504 - DNA, 709 bp, Zea mays
  misc_feature: Ceres CLONE 1512022
  misc_feature: Encodes the peptide sequence at SEQ ID NO. 58505
  misc_feature (408)..(408): n is a, c, t, g, unknown, or other
ccccgcggtggcggccgctctagaactagtggatcccccgggctgcaggaattcgtctcacccctagaaaaaatcgaaaatatatttatggtctctagacttgctcccgatttcccctcccccttgtccgccgcatcctggttcggattcgccgtcgcgctagggcaaacaggaaaggaagatggcggctgcggcggccgccagcatggtggtggtgcgggaggtcctgggcctcgacgtcatcgacgaggtggaccagcccatcatcgactacatcgccaacgtcctcgccgacgaggacttcaacttcggggccccggaaaggcacggcatcttcgaagcgctcggggagctcctcatcgactctgggtgcgtctctgagcaggagcactgcccccccccctgcantaggctttgtgagaatttggaaagcatggtctgcggaaacccaaacaagctatgcgcagccttgtcacaccattaccaatgaatgcggggatggacgatgatgtcgctcccaaaaagccgcagcctgaaatattcgatggaccactgctgtcttcccgcgataaagcaaaatttgacggaaaaaaaaaaaaaaaacaaaacctcgaggtacccaatccccctaaaatggagccgaattcccccgctcccggccgccgtttaaaacgtcgggaatgggaaaacccggcggttccccaattaa

SEQ ID NO: 58505 - protein, 102 aa, Zea mays
  misc_feature: Ceres CLONE 1512022
  misc_feature (76)..(76): Xaa is any aa, unknown, or other
MAAAAAASMVVVREVLGLDVIDEVDQPIIDYIANVLADEDFNFGAPERHGIFEALGELLIDSGCVSEQEHCPPPCXRLCENLESMVCGNPNKLCAALSHHYQ

SEQ ID NO: 58506 - DNA, 707 bp, Zea mays
  misc_feature: Ceres CLONE 1512025
  misc_feature: Encodes the peptide sequence at SEQ ID NO. 58507
  misc_feature (324)..(324): n is a, c, t, g, unknown, or other
  misc_feature (354)..(354): n is a, c, t, g, unknown, or other
  misc_feature (382)..(382): n is a, c, t, g, unknown, or other
gctctagaactagtggatcccccgggctgcaggaattcgtctcacccctagaaaaaaaaagaaagaaacaaagaacggcgaaaaatggtcgatgccggcgacataacggccggagggccgccacgcgctcacgaggaggagcaagcgggaactccggcatacggttcggtggtcctcggcggcacttttgaccgcctccacgacggccaccgccgccttctcaaggcctccgcggatttggggagagaccggatcgtggtgggcgtctgcacgggacctatgctcgccaagaaggagtatgcggagcttattgagcccgtcgancagcgcatcaagggtgtggaggattacatncagtctataaagccagaactgatagtancagtggagcctattgaggaccctttatggccatcccatactgatgagaagttggatgccattattgtcagtaaggagactttaaatggtggactggctgtaaataggaaaagagaaaagaaagggtcccactgtttaaggtttgaggtgttgatctctttccggcggggttggagggggaaaaatggaattcttctgctttagggaacttgaggcaaacaccctcacacaggggaaaaaaatccgggaaccttgaaacttcttaggggggaaatgaaaacctttgattcgggtagccgaaaggccaaaacgcgggggggttctcc

SEQ ID NO: 58507 - protein, 166 aa, Zea mays
  misc_feature: Ceres CLONE 1512025
  misc_feature (30)..(156): Pfam Name: CTP_transf_2 Pfam Description: Cytidylyltransferase
  misc_feature: SWISSPROT Homolog: EC 2.7.7.3 Pantetheine-phosphate adenylyltransferase
  misc_feature (80)..(80): Xaa is any aa, unknown, or other
  misc_feature (90)..(90): Xaa is any aa, unknown, or other
  misc_feature (100)..(100): Xaa is any aa, unknown, or other
MVDAGDITAGGPPRAHEEEQAGTPAYGSVVLGGTFDRLHDGHRRLLKASADLGRDRIVVGVCTGPMLAKKEYAELIEPVXQRIKGVEDYXQSIKPELIVXVEPIEDPLWPSHTDEKLDAIIVSKETLNGGLAVNRKREKKGSHCLRFEVLISFRRGWRGKNGILLL

SEQ ID NO: 58508 - DNA, 757 bp, Zea mays
  misc_feature: Ceres CLONE 1512029
  misc_feature (119)..(119): n is a, c, t, g, unknown, or other
  misc_feature (369)..(369): n is a, c, t, g, unknown, or other
  misc_feature (371)..(371): n is a, c, t, g, unknown, or other
  misc_feature (372)..(372): n is a, c, t, g, unknown, or other
  misc_feature (373)..(373): n is a, c, t, g, unknown, or other
  misc_feature (374)..(374): n is a, c, t, g, unknown, or other
  misc_feature (375)..(375): n is a, c, t, g, unknown, or other
  misc_feature (376)..(376): n is a, c, t, g, unknown, or other
  misc_feature (377)..(377): n is a, c, t, g, unknown, or other
  misc_feature (378)..(378): n is a, c, t, g, unknown, or other
  misc_feature (380)..(380): n is a, c, t, g, unknown, or other
  misc_feature (387)..(387): n is a, c, t, g, unknown, or other
  misc_feature (388)..(388): n is a, c, t, g, unknown, or other
tctgaactagtggatcccccgggctgcaggaattcttctccccctagaaaaaccaccatctcacttcatataccactccctaggaggacccagcaacacaacagccgagctttgcttangcaagatgaacaggaagccaggagactgggactgcagggcttgccaccacctcaacttcagccgccgagacatatgccagcgctgtaacgagccccgtgaagttgctgatccttggcgtggcctccgccgcatatttaccacaggggaggacgccatcttctcgtggcctatttttttttttttttttacaataaaattagagaaaattttttttaccccccccccggggggggaagaagggggcccccncnnnnnnnnanaaacccnnccctcgggtgcttcgttgggccccccccccccccaaaaaacacaggaggaaggtagagtaaaaacacgctcttagatccgtttttctcgtcggtaagtgcaccgctggtggagggcttttggatacggcctcccccacacacctccctcttttgggataagccgcccctcttcgcgtccctccccccacctttttttgccgccgttccctccgcccatgtaggggatgttattcgtagatacttatacccccccccccgcctccacctttaccccccacccccccccacgacgctcacagccccgcttgtatttgactcacacccacccttcccctccctgctgccttctctttgtcatgacgctcaca

SEQ ID NO: 58509 - DNA, 619 bp, Zea mays
  misc_feature: Ceres CLONE 1512034
cagagctggagctccccgcggtggcggccgctctagaactagtggatcccccgggctgcaggaattcgtctcacccctagaaaaaatcgtcctcaccagggtacagacgtgcccctcctcccctccccttgtccacagcccccgtagaccatggaagatgcatggcttgagcatctgcatggttcttgagagttaaagctgcacgacgatggatagtggaaacagagcttctcaagaagcattcgttttcgtggtgcctttcctgacctccttggtggtcagctgaggtgcgcacaaaccggcaagtcacaatacggcaatggcggattccattaggagtcctcctttttatttctttacccctttttacattctagttgtgtgattgtgtcaggcggaagctagaagacaaataacctaagtattcatgtgtgatggattatacgtatacattggtgagacaatgttttgtctcatgtgtaactcagtctccaaaaacaaggctgctaaaaataaaattgttgcctttttccaaaaaaaaaaaaaaaaccaaaaccctctaagggaccccaatttccccctaaaaaggagaacccaaataaccccccccccccagggc

SEQ ID NO: 58510 - DNA, 556 bp, Zea mays
  misc_feature: Ceres CLONE 1512051
  misc_feature: Encodes the peptide sequence at SEQ ID NO. 58511
aagctggagctccccgcggtggcggccgctctagaactagtggatcccccgggctgcaggaattcgtctcacccctagaaaaaaaaaaccctagcagccacccggttctccctcgctccagatctcccttcgcagccggccagggaccccttcacagcgcgggagatggctgatcaggaggccccagttgcagttgaggcaccaaccccagttcttggagagccaatggacttgatgactgcgctgcagctggtgatgaagaagtcaagtgctcatgatggacttgtgaagggtcttcgcgaggctgcaaaggccattgagaagcatgctgctcagctttggcgtcttgctgaggactgtggacagccagattatgtcaagctggtgaaagggccttctttgcttgaaaccaaaaggtttccccctttttgaccacggtttccccccggggggcaaaaaaaaaaaccaccctttttccaaaaaggaagggggggggggggggtgttttttttaaagaaattaacccccccccgggggggggggggggagagagagg

SEQ ID NO: 58511 - protein, 88 aa, Zea mays
  misc_feature: Ceres CLONE 1512051
MADQEAPVAVEAPTPVLGEPMDLMTALQLVMKKSSAHDGLVKGLREAAKAIEKHAAQLWRLAEDCGQPDYVKLVKGPSLLETKRFPPF

SEQ ID NO: 58512 - DNA, 702 bp, Zea mays
  misc_feature: Ceres CLONE 1512052
  misc_feature: Encodes the peptide sequence at SEQ ID NO. 58513
  misc_feature (550)..(550): n is a, c, t, g, unknown, or other
  misc_feature (624)..(624): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (702)..(702): n is a, c, t, g, unknown, or other
acccgcggtggcggccgctctagaactagtggatcccccgggctgcaggaattcgtctcacccctagaaaaaatccactctcagcatcaccagctaagaacaggtcttcgtctcaataatggaaggcaaaacagggcagctcaggtgctgtttcgtcgccatcgtgctcgtcctgggtcttgtccttgagcagtcccagcaggctgaagctagaggcaaatggtgctgcgaaaccgccaccggaaaataccattttaatcgctgcgttgactcgggttgggtcgacaatattgggttctgtgcgagtaatgccggttgcatcattatggaggacagatgtggaggtcgttggccagtgcctgctcgtgatgcgctttctctggatgtcatttgatcacatataagcaagtacgtgaagttaagaaacgagggccagacgactgtcgtccagcgattggttatttgtgaaactggcgtttggcctctaatttccactttccaataagccccttcgtgtaatcgtgtcctccccttcaagtttgtcgactgntgcgtaatcaaatctatataacaataaagacggcgccctacgtggaataggccccaatttcggatcttgccagncgtttgcttaatccannnnnnnnaaaaaattaaaaaaaaaaaaaaacggaggccctcgagggtacccatttcccccan

SEQ ID NO: 58513 - protein, 91 aa, Zea mays
  misc_feature: Ceres CLONE 1512052
MEGKTGQLRCCFVAIVLVLGLVLEQSQQAEARGKWCCETATGKYHFNRCVDSGWVDNIGFCASNAGCIIMEDRCGGRWPVPARDALSLDVI

SEQ ID NO: 58514 - DNA, 725 bp, Zea mays
  misc_feature: Ceres CLONE 1512053
aaagctggagctccccgcggtggcggccgctctagaactagtggatcccccgggctgcaggaattcgtctcacccctagaaaaactctcgatccggaaacctctcaaaccctagccgcctcctgcaagtttcagagctcaggaatctgcgccatggcgagtgagacggagaccttcgcatttcaggctgagatcaaccagctcctctcactcatcatcaacaccctctactccaacaaggagatcctcctccgcgagctcatctccaattcttcccatgccctggccaacagaaggctccagagtctcactgacgacagcacgcttcgatgcccagcctgaactttccctccaccttgtctcaagacacggccggcgaacgcgcctctcccaccaccgtaagacgacatcccccccccccggggcccccacccgtgaggaaaaaaccccgtgggccgcccccctgcggaccggacatcaagcggagttttatggaacccctcgtgcactccctccgccccacgcacgatacgtgatttgtcccagacctggccgatccgaatcccgcccgcgccccctttccccgcaccgccattattatacccccgccacagtccttcttctatattctcccgcgggagctgcgcttgtaatattgtccccgtgcccccactctggcaaaccgtagcgaaatgcccatccgttgtacttagtccgtccatcttt

SEQ ID NO: 58515 - DNA, 687 bp, Zea mays
  misc_feature: Ceres CLONE 1512059
  misc_feature: Encodes the peptide sequence at SEQ ID NO. 58516
taaagctggagctccccgcggtggcggccgctctagaactagtggatcccccgggctgcaggaattcgtctcacccctagaaaaaatcggtttatctatccttctatccccattcccatcccgagacaggagagggcaaggatgctgctcctgagctcccccttcgtgtccgtgtcgccgccgccgccgccgctcagctcccatggcgctcgcccggcgctgcggatcgaggcggccaggcagctgacggggcgggtggtgacgaccaaggcggacaagacggtcggggtggaggtggtgcgcctggctccacaccccaagtacaagcgccgggagcgcatcaagaagaagtaccaggcgcacgaccccgacaaccagttcaaggtcggcgacgtcgtcgagctccaaccctcccgtcccatctccaagaccaagcacttcctcgccatcccgctcctgccccgcgacactcgccgcaagtctcagctcctaccgccgctccagtccgacgacgaccaggagccgtcctcgcaagagtgatggattgtgattgattgctgcctgtctatggcttcgtcgaaagctcctctcatcaaaagtgctgcttccccaattccaatgcaatccatgggggtttttgccaacattccctttttctttttcatcaaggctttaccccaattcacc

SEQ ID NO: 58516 - protein, 132 aa, Zea mays
  misc_feature: Ceres CLONE 1512059
  misc_feature (37)..(105): Pfam Name: Ribosomal_S17 Pfam Description: Ribosomal protein S17
MLLLSSPFVSVSPPPPPLSSHGARPALRIEAARQLTGRVVTTKADKTVGVEVVRLAPHPKYKRRERIKKKYQAHDPDNQFKVGDVVELQPSRPISKTKHFLAIPLLPRDTRRKSQLLPPLQSDDDQEPSSQE

SEQ ID NO: 58517 - DNA, 624 bp, Zea mays
  misc_feature: Ceres CLONE 1512071
  misc_feature: Encodes the peptide sequence at SEQ ID NO. 58518
  misc_feature (400)..(400): n is a, c, t, g, unknown, or other
  misc_feature (401)..(401): n is a, c, t, g, unknown, or other
acccgcggtggcggccgctctagaactagtggatcccccgggctgcaggaattcgtctcacccctagaaaaaaaaaatctcctaccactacactaccaccgtttcagtgctataggataggattttcttttgacggccatgaaaccccctcagctgccggccggggagcgctcctgggctcacgaggtcaagcaggccctccgtgagaaactccggcgctcctacggcgccgcctccgccacaccggcggccggtgaaccgagccgtggcgccgactgccgtggctcggccgccgaggaccccataatgagagtcatgttcttgggctccctggggccacacataaaacacaaaccccaaatctgggctttgcaagagcaatggcccggatcttgcaaannaactgctcaaacatacttaaaaggactggagcttgtcttgtaactatggaacatgctgcttgcaccacaacatgaacgcatggctgggttactaggaaaataaggggtgggaagggggaaaaaaaaaaaacaagggttggggtcccccgactcccctgaattttgggtgggagaaggcctggaaatttggggaagccccttgcttgggcccgggggggtggct

SEQ ID NO: 58518 - protein, 101 aa, Zea mays
  misc_feature: Ceres CLONE 1512071
  misc_feature (88)..(88): Xaa is any aa, unknown, or other
MKPPQLPAGERSWAHEVKQALREKLRRSYGAASATPAAGEPSRGADCRGSAAEDPIMRVMFLGSLGPHIKHKPQIWALQEQWPGSCKXTAQTYLKGLELVL

SEQ ID NO: 58519 - DNA, 733 bp, Zea mays
  misc_feature: Ceres CLONE 1512078
  misc_feature: Encodes the peptide sequence at SEQ ID NO. 58520
  misc_feature (498)..(498): n is a, c, t, g, unknown, or other
  misc_feature (589)..(589): n is a, c, t, g, unknown, or other
tccccgcggtggcggccgctctagaactagtggatcccccgggctgcaggaattcgtctcacccctagaaaaaatcgccccttgaaccctagctcccgcaactgccgccgccactcccacgcccgcagccatgccgcccaagctcgacccgtcgcaggtggtggaggtgttcgtccgtgtgaccggcggcgaggtcggcgcagcgtcttcgctggcccccaagatcggcccgctcggtctttcccccaagaagatcggagaggacatcgccaaggagacggccaaggactggaagggcctccgcgtcaccgtcaagctcaccgtccagaaccggcaggccaaggtctccgtcgtcccctccgccgcggcgctcgtcatcaaggcgctcaaggacccacacagggaccgcaagaaggtcaagaacatcaagcacagcggcaacatcagcctcgacgacgtcatcgagatcgccaggaccatgaggcacaggtccatggncaaggaattggccggcaccgtcaaggagatcctcggtacctgcgtcagcgtcgggtgcaccgtcgaacggcaggacccccagggactgcancaggagattgaccacggcgaggtggaaattccgtccgcttaaaaaagattggtgtccaggactgggtttatctttgctgctgaagcctttttctctgcctaaattttctcctatttttttttagggtggggttgaaactggaat

SEQ ID NO: 58520 - protein, 166 aa, Zea mays
  misc_feature: Ceres CLONE 1512078
  misc_feature (76)..(144): Pfam Name: Ribosomal_L11 Pfam Description: Ribosomal protein L11, RNA binding domain
  misc_feature (12)..(71): Pfam Name: Ribosomal_L11_N Pfam Description: Ribosomal protein L11, N-terminal domain
  misc_feature (123)..(123): Xaa is any aa, unknown, or other
  misc_feature (153)..(153): Xaa is any aa, unknown, or other
MPPKLDPSQVVEVFVRVTGGEVGAASSLAPKIGPLGLSPKKIGEDIAKETAKDWKGLRVTVKLTVQNRQAKVSVVPSAAALVIKALKDPHRDRKKVKNIKHSGNISLDDVIEIARTMRHRSMXKELAGTVKEILGTCVSVGCTVERQDPQGLXQEIDHGEVEIPSA

SEQ ID NO: 58521 - DNA, 713 bp, Zea mays
  misc_feature: Ceres CLONE 1512088
  misc_feature: Encodes the peptide sequence at SEQ ID NO. 58522
aagctggagctccccgcggtggcggccgctctagaactagtggatcccccgggctgcaggaattcgtctcacccctagaaaaaacgttgcccttctcttccccactcgcctccgctcaccttgcctcgatcgttccaggagtaataaaacactaaaatggcgatggcggcggcgaggagagcgctcctggcccacctccgcgtgccggtggtccaccctgcagcggcggcagcgaccatccccgcggcagggcggctcctgtcgtcgacgacggagagaaagggctcgttcctcgacaagggcgaggtcgctgaccgtgtcgtctccgtcgtcaagaacttccagaaggtcgaacccctcaaggtgacacctagtgctcattttcagaaggaccttggacttgatagcttgcacactgtggagatcgtgatggccttttgaggaagaattttcccttgaagattcctgaccacgaaaccagaaaaaattgacttcctccagaccgcgggtgatttcattggcttcccatcttcaagcaaaaaaaaaagaattcctttttttccaaatttccaaagggggttttgcctccacaacctttatccgacccgggaacaggttttccccctacctgccccccaaaaaaaaagaaaactttttctttccctttccaaaccccccggggccccaaaaaagtttgggtttcctttgccccc

SEQ ID NO: 58522 - protein, 94 aa, Zea mays
  misc_feature: Ceres CLONE 1512088
MAMAAARRALLAHLRVPVVHPAAAAATIPAAGRLLSSTTERKGSFLDKGEVADRVVSVVKNFQKVEPLKVTPSAHFQKDLGLDSLHTVEIVMAF

SEQ ID NO: 58523 - DNA, 758 bp, Zea mays
  misc_feature: Ceres CLONE 1512091
  misc_feature: Encodes the peptide sequence at SEQ ID NO. 58524
  misc_feature (113)..(113): n is a, c, t, g, unknown, or other
  misc_feature (416)..(416): n is a, c, t, g, unknown, or other
agagataagagagagggccgctctagaactagtgagatcccccggagctgcaagaattcagctcacccctaagaaaaaccaaacaaagaaactaggctgagtcaccagagtgntaacatgtagcatcaggggagagctccacagaggtgaataaggagaggaggaaacgtagacgacctgctgacggacggtcaacaaaactcctggaaggcgcggaactccatcattcttcgcacagtgctctctgtcaatggtaccttaggggcgggaccagtgcaacgcgtaccagcatcgcgcttgcctaccgtcaacacggaacacaacaacagctgccaacgacacgctgttcgaggtccaagtgaaaaacctgtgcttatgcagcgtcaggaacgtgcgcgtggacggtggcggcttcncgacgacggtggaggtccacccggccctgttccgcccagtggacggcggtgtcacctagtgaacccggcgagccatcgcgagcatggcatcgtgagcttccgtacgcttgggaccacttcttccagttgactcctaggagcttggaggtcgacggcccaggctagtagctactccctcccgttcttttttattaatcgctgggaaatggtaaaattttcaatattcccgcgaaaaataaaaaaaacgggagggaggtacttagctacccaaacttacttaaagtccgtaagccaggcttggtttgccccttgtttgaagttataccttgtaattgtgggggg

SEQ ID NO: 58524 - protein, 32 aa, Zea mays
  misc_feature: Ceres CLONE 1512091
EIRERAALELVRSPGAARIQLTPKKNQTKKLG

SEQ ID NO: 58525 - DNA, 693 bp, Zea mays
  misc_feature: Ceres CLONE 1512096
  misc_feature: Pfam Name: PSK Pfam Description: Phytosulfokine precursor protein (PSK)
  misc_feature (433)..(433): n is a, c, t, g, unknown, or other
  misc_feature (566)..(566): n is a, c, t, g, unknown, or other
  misc_feature (623)..(623): n is a, c, t, g, unknown, or other
ggcggccgctctagaactagtggatcccccgggctgcaggaattcgtctcacccctagaaaaaaccacactccaaagtccaaagtcgcgtctcccagcctccctccactgtcccacaccccaacactgttccagtccagcggctagcactagcagacagagcccctcctccccctagctcttgctcttccacaggcacagcgcaacgcttccagctagtctcgagacgaccggcagagatgatgaggcgttgcagcatcgccgccctcgccatcttcctcctcctcctcgtgtgctcctcatcctcctccaactgcgcggcagccgctcgcctcctgcctggcgccggacatctccggcctctccgccatgccgccgtgggcgccagtggcgacgagctttccgcgggctccgaggtgacaacccaaaacacnatggaggcgtgcgaagaagggaacgcaaggacgagtgcgtgcagaagcggctgctcctcgacgcgcacctcgactacatctacacgcagcacaagggcaagccgtgaccgcgaagggagatgccatgccgcanctgcagtggagcgaggagctcgcaaatgcagggcaccgtctcgggtccggctgctantgctacgggcccccctaacgaaaaaagtggggttggggaagggaaaattttaaaaaccccttgggaaaaa

SEQ ID NO: 58526 - DNA, 671 bp, Zea mays
  misc_feature: Ceres CLONE 1512097
cgaagctggagctccccgcggtggcggccgctctagaactagtggatcccccgggctgcaggaattcgtctcacccctagaaatgagcaagcgatcacttttgatggtttgagtgaagatgattggatcgagagagagctggagtctgggatcatcgttgagccagcacctgctaccaagaagcggaagctggagtcaagctgttagctctgcattcgaaggccagattccaagcaggtgaataataacagatggttgcgagtaggaccacatcgaagccaagagatacatgtcgcacagatgggaggatcaatattatcctttttttttatttctttataaccaaacaccttggagtactttgacacaaggggtgtgtgcgcagtgggatctcccccgtttcttgaatgcagaaccgtatccgttgtatttgttccttcttgccgtgagtgtaaatctagcgtgtccgaagttcggttttagattgtaggtgtaactgtagcaggaattatctggtgttaagccccacgagaaaatgattccggggaactgttacctggagggaagaagttattccgtggagaattatggttaaaaaaaaaaaaaaacgagacccctcaaggtccccattccccctatagggaggccgattacccccgcctcccggccct

SEQ ID NO: 58527 - DNA, 701 bp, Zea mays
  misc_feature: Ceres CLONE 1512098
  misc_feature: Encodes the peptide sequence at SEQ ID NO. 58528
  misc_feature (52)..(52): n is a, c, t, g, unknown, or other
  misc_feature (609)..(609): n is a, c, t, g, unknown, or other
aaagctggagctccccgcggtggcggccgctctagaactagtggatcccccngggctgcaggaattcgtctcacccctagaaaaaaaaaaaaccgaaggccagcaggccaccacacattccttccttgttccttccccagctccgcaggctgctcatcgccctccctccgcgcccccgatccagatccagatccaggggcttgtcatggcatccaaacgtatcctcaaggaattaaaggacttgcaaaaggaccctccaacatcatgcactgcaggtcctgctggtgaggatatgttccactggcaggcaaccatcatgggtcctcctgatagtccatatgctggaggtgtattcttggtgaacattcatttcccgccggactacgccttcaagcctccaaaggtatctttccccaccaaagtcttccatcccaacatcaatagtaatggaaacatatgtcttgactttcttaaagaacagtggagccctgctttgacaatctctaagggttggggttccatcggcccccggctaactgatcccaacccaaaacaacccccttgcccccgaaaaatggacacatggaaccaaacgggatccgtcctaanttaccaaggcgaacagccccccatttgggcccccaaaagtcccccttggggaagaaaaccttccggcgtttccgggcaaaaatccaaaacca

SEQ ID NO: 58528 - protein, 165 aa, Zea mays
  misc_feature: Ceres CLONE 1512098
  misc_feature (5)..(133): Pfam Name: UQ_con Pfam Description: Ubiquitin-conjugating enzyme
  misc_feature: SWISSPROT Homolog: EC 6.3.2.19 Ubiquitin--protein ligase
  misc_feature (135)..(135): Xaa is any aa, unknown, or other
MASKRILKELKDLQKDPPTSCTAGPAGEDMFHWQATIMGPPDSPYAGGVFLVNIHFPPDYAFKPPKVSFPTKVFHPNINSNGNICLDFLKEQWSPALTISKGWGSIGPRLTDPNPKQPPCPRKMDTWNQTGSVLXYQGEQPPIWAPKSPPWGRKPSGVSGQKSKT

SEQ ID NO: 58529 - DNA, 686 bp, Zea mays
  misc_feature: Ceres CLONE 1512102
  misc_feature: Encodes the peptide sequence at SEQ ID NO. 58530
  misc_feature (531)..(531): n is a, c, t, g, unknown, or other
  misc_feature (552)..(552): n is a, c, t, g, unknown, or other
aaagctggagctccccgcggtggcggccgctctagaactagtggatcccccgggctgcaggaattcgtctcacccctagaaaaattcgctcctcccgcccgccgccgtcgccgcctcctctccccagcacccggagctcgcccgaccgccgctcaccatgatcatccccaagaagaaccgcaatgagatctgcaagtacctcttcaaggagggcgtgctgtatgccaagaaggactacaacctggcgaagcacccgcagatcgatgtgcccaacctccaggtgatcaagctcatgcagagctttaagtccaaggagtatgttagggagaccttctcctggcagtactactactggtatctcaccaacgatggcattgagcacctacgcaactacctgaacctcccgtctgagatcgtgcctgccacgctcaagaagtctgccaagccacctggccgcccatttggctctggccctcctggtgaccgcccagggggcccaggtcgttttgaccgcgacaggcaagggtttgntgacagggatgggtaccgtgngggccctccgggtgctcctggggactttgggggcaaaaaaagggagctcctgcttagttccagcatctttcaggaggcctggctttgggcctgggggggggaaggggtttcgggcaaggcccaaccttcttttt

SEQ ID NO: 58530 - protein, 176 aa, Zea mays
  misc_feature: Ceres CLONE 1512102
  misc_feature (3)..(98): Pfam Name: S10_plectin Pfam Description: Plectin/S10 domain
  misc_feature (125)..(125): Xaa is any aa, unknown, or other
  misc_feature (132)..(132): Xaa is any aa, unknown, or other
MIIPKKNRNEICKYLFKEGVLYAKKDYNLAKHPQIDVPNLQVIKLMQSFKSKEYVRETFSWQYYYWYLTNDGIEHLRNYLNLPSEIVPATLKKSAKPPGRPFGSGPPGDRPGGPGRFDRDRQGFXDRDGYRXGPPGAPGDFGGKKRELLLSSSIFQEAWLWAWGGEGVSGKAQPSF

SEQ ID NO: 58531 - DNA, 623 bp, Zea mays
  misc_feature: Ceres CLONE 1512104
  misc_feature: Encodes the peptide sequence at SEQ ID NO. 58532
tggagctccccgcggtggcggccgctctagactagtggatcccccgggctgcaggaattcgtctcacccctagttaatttcacgcacctagggttttcgcgccgccgccgccgccgccgccgcagccgcaacaatgccgtcgcacaagaccttccggatcaagaagaagctggcgaagaagatgcgccagaaccgccccatcccctactggatccgcatgcgcactgacaataccatcaggtacaacgccaagcgcaggcactggcgccgcaccaagctcggcttctgagcgtcgggattggccggctgctgcgtcggaaggctagggtctaagagctatcttccttctgttttatcaatgtgtcagtttttctgtaagctagcaagtgttgctatgacgctcttattaagattctggtgagcggtgatgttaagagaaaattggcactactgtggtgtaccccaagattccttgcagcattgctatgctaagtaaagaaccctttcacttattataaagggggaaaaaaaagggaaaataaattgtgggggggtgaaaaaatagggagcgggggaaaggggagggggaggggggggggagaaggcgtgcggatgaaagggtg

SEQ ID NO: 58532 - protein, 51 aa, Zea mays; identical to SEQ ID NO: 2355
  misc_feature: Ceres CLONE 1512104
  misc_feature (9)..(51): Pfam Name: Ribosomal_L39 Pfam Description: Ribosomal L39 protein

SEQ ID NO: 58533 - DNA, 643 bp, Zea mays
  misc_feature: Ceres CLONE 1512113
  misc_feature (216)..(216): n is a, c, t, g, unknown, or other
  misc_feature (217)..(217): n is a, c, t, g, unknown, or other
  misc_feature (218)..(218): n is a, c, t, g, unknown, or other
  misc_feature (219)..(219): n is a, c, t, g, unknown, or other
  misc_feature (220)..(220): n is a, c, t, g, unknown, or other
  misc_feature (221)..(221): n is a, c, t, g, unknown, or other
  misc_feature (306)..(306): n is a, c, t, g, unknown, or other
  misc_feature (308)..(308): n is a, c, t, g, unknown, or other
aaagctggagctcaccgcggtggcggccgctctagaactagtggatgcccagggctgcaggtattcgtctcacccctagttattgcggctgcaacaataaaataataagtctcgtgcaggcgaaggacgtacgacgacgcggacgcaccgtcaaagtctacaggctgcgcaatccctttctccctcttatccccaaggcgaggagctgaggggggnnnnnncccttctgctgctgttcttgtttccccgctctccatgatgtcgtccccgagcatgcgccgcgtgttggaccttaagaagctgatnancaccccctcccacgccgaaatgctaaacaatgggatgcaggaattcttctttcacccccccgcgcggggggggggggggcccatggcctcctctccaccccccccccggtacggcgggatggttccccgccacacccccggccccccgccctcccaaccaaatttatcccccgcccggcgacccaaatcctctcgcccctttcgccacaaccctcccaaccccccccgccgcccctcacgcccgcaacgccgggaacgcgccttccaagcaccccctctccgcgggcccggttgccatgctcgtgccccgctcatgccctcccccggcgcgcgcg

SEQ ID NO: 58534 - DNA, 869 bp, Zea mays
  misc_feature: Ceres CLONE 1512122
  misc_feature: Translation starting site: 16
  misc_feature (39)..(39): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (349)..(349): n is a, c, t, g, unknown, or other
  misc_feature (350)..(350): n is a, c, t, g, unknown, or other
  misc_feature (505)..(505): n is a, c, t, g, unknown, or other
  misc_feature (506)..(506): n is a, c, t, g, unknown, or other
  misc_feature (513)..(513): n is a, c, t, g, unknown, or other
  misc_feature (593)..(593): n is a, c, t, g, unknown, or other
tcactcgcggacacaatgggggggatttctttccctggncnnnnnnnaaaaannnnnaaaaattgggactccccgcggtggcggccgctctatactagtggatcccccgggctgcaggaattcgtctcacccctagaaaaaagcaaataagacgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggaaacgagcaccggcgcgcaaggcatccttcggcatcgagagtggcccccgaaaaaaaaaaaanncacacaaaaaacaaccaaacccccccccccccaaattcttgctaagggctgcgcgaccgtttggggggatcagggagaactattttttttcccccccccccccggcggtgggggggggggggggggctttcttttttgtttttaattcataaaanntacacanaatggggtggccccacccacgagaaaatatgggggggttcgggggggggcgacgcaaagagagtatctcggagaaggaanacacaaagtcgggcagttgaaacggcgtaggtataggtggatactgcgcggtcgaggaggtagatcctgggttgcggcgtagagggcagagcggcggggggagcgacccgcggagctggagcgagcccgtggggtaaacgcagcgggcgcggcggccggttgccatgtatgttgggtggggggggaggaacagaaagcagccgcacggcgtcgcacacgagatagggtagatgacggggcgggggcgcagcgcctcggggcggtactctggaggcg

SEQ ID NO: 58535 - DNA, 688 bp, Zea mays
  misc_feature: Ceres CLONE 1512123
ccccgcggtggcggccgctctagaactagtggatcccccgggctgcaggaattcgtctcacccctagaaaaatcctcgcgccgcatatctgtttgttctacagctagtacacaccccagaacaatgtaatcgtcgccctggctgattgtatctcacgtgtgccataccaccgttactatctcgttcgctggtttgctctcccatctgatctctgtaagtacatgtacgagaacctgcttatttgaatgaatggcgagctgtgtcgtcttctgcacacttcgggcgagcaagccttgcatgtgtctatcgaggtgcaactgtgtgtaggtctgtgaatgcgacaagacataccctggactggaggatacgagcacagacactgttgccatgatcgaccaccgcgaggcccctgagaagacagctgaccatatgtctctaggcctcgcggagtccagcgatgcgcacaacctgcggtgctgtatgactgacaagcgacccctgcactgctgatctttcgagtcggaacgaggacccgattatatcgatcgatgtggggtggcgctgacaattctaactaagcggacctggcgccttactcgggattggtaggttgggggacaaaaaaaaaaaaaaaaccttaaagttggaggttcccattttggcctttaggggagccaattttggcgcc

SEQ ID NO: 58536 - DNA, 705 bp, Zea mays
  misc_feature: Ceres CLONE 1512127
  misc_feature: Encodes the peptide sequence at SEQ ID NO. 58537
  misc_feature (476)..(476): n is a, c, t, g, unknown, or other
gctctagaactagtggatcccccgggctgcaggaattcgtctcacccctagaaaaagagcagcttaggaagaggaggccgacgccgtactgctagcacaagccaagaaatgggcgcgctctgcctgctctacccatccacgccgccgccctgcccatgcggcgcccgcgcggacgcgcccgcggccttcgcgccttcccctttcctctcatcatgtgctgccaccggtgcacaaacaaggctgcagctctgcggcaggacccagaggcgcgccggcgtggcgcgggtaggtggcggcggcggtgggggcaagggggagagtggcaagagcggcgcggcggcgttctttgatgaggacggggtggtggacaacatggacgggtacctcaactacctgtccctcgagtacgactctgtctgggacaccaagcctgcctggtgtcagccttggacaatattgcttacgggaactggtgncgttgcctgtatttgggtgcttatcccatctgctgtattactgctggggtttctttggaatatgcgcatggtggtacatatttctctactcctaccctaaagcataccccgagatgatagccgagagaagaagaaatgtacccagtggagctgaaaatactacgggatggagaaatccgttgaaatctccggcggccctgctgaaaagcgcaaaatcccttgggtgggt

SEQ ID NO: 58537 - protein, 155 aa, Zea mays
  misc_feature: Ceres CLONE 1512127
  misc_feature (123)..(123): Xaa is any aa, unknown, or other
MGALCLLYPSTPPPCPCGARADAPAAFAPSPFLSSCAATGAQTRLQLCGRTQRRAGVARVGGGGGGGKGESGKSGAAAFFDEDGVVDNMDGYLNYLSLEYDSVWDTKPAWCQPWTILLTGTGXVACIWVLIPSAVLLLGFLWNMRMVVHISLLLP

SEQ ID NO: 58538 - DNA, 740 bp, Zea mays
  misc_feature: Ceres CLONE 1512130
  misc_feature (740)..(740): n is a, c, t, g, unknown, or other
caagctggagctccccgcggtggcggccgctctataactagtggatcccccgggctgcaggaattcgtctcacccctagaaaaaggaagtttcggcggcgccggcgtgctcgtgatctcaaccaaggcgtgtatctgctccggtcacccgtcactccacgcgaacatgtctgaggaggaagaccagggagcccaacgacgagaacgtccctccttggatccagtgtccgtgaaggagagcctgtccatggtatcgatctctgcttgtctccttgaatgaggccctcattcatatcgccgatttcgccgggaaggaaactctggttccggatcctcgagtgactgaacgtaaaggctgacaggtacaagtagtcatcatacgcggcctgataccaactcaagaacctttacccccccctaaggagtttggccttgctgccttggactctttagcttccgcacacggcaccgaccttgcccaaaatccccatgactgggtgcccccttcggcccctccgaggccccgctctctcctgggaggggaaatacctaccatcttaggaaaatcttctaccgggctcctcctgacgtcatccctcaacaaccgcccggttactaaccttaaagcatacctgaagggacaacctcccttgttctattacgcaccgccctaccacctctttatctttcatgctgtgcccctcggaactttttttttcgctgcacgcgcgcaatctttcn

SEQ ID NO: 58539 - DNA, 704 bp, Zea mays
  misc_feature: Ceres CLONE 1512131
  misc_feature: Encodes the peptide sequence at SEQ ID NO. 58540
  misc_feature (77)..(77): n is a, c, t, g, unknown, or other
  misc_feature (266)..(266): n is a, c, t, g, unknown, or other
  misc_feature (380)..(380): n is a, c, t, g, unknown, or other
  misc_feature (381)..(381): n is a, c, t, g, unknown, or other
  misc_feature (382)..(382): n is a, c, t, g, unknown, or other
  misc_feature (388)..(388): n is a, c, t, g, unknown, or other
  misc_feature (389)..(389): n is a, c, t, g, unknown, or other
  misc_feature (400)..(400): n is a, c, t, g, unknown, or other
  misc_feature (443)..(443): n is a, c, t, g, unknown, or other
  misc_feature (510)..(510): n is a, c, t, g, unknown, or other
  misc_feature (511)..(511): n is a, c, t, g, unknown, or other
  misc_feature (514)..(514): n is a, c, t, g, unknown, or other
  misc_feature (579)..(579): n is a, c, t, g, unknown, or other
  misc_feature (615)..(615): n is a, c, t, g, unknown, or other
  misc_feature (660)..(660): n is a, c, t, g, unknown, or other
  misc_feature (661)..(661): n is a, c, t, g, unknown, or other
acagctggagctccccgcggtggcggccgctctagactagtggatttcttgggctgcaggattcgtctcttcttagngagggcaacccccaacagcgccactgtccagtgcgcgcgtcaagcttgcttagctagccgccatggcctccctcgccgccgtctccgtgaagcccgtggccatcaagggtctcgccggcagctctatctccggaaggaagctcgccgtcgccaggccgtcggcccgctccatccgcaggccccgcgcanccgccgtggtggccaagaacggggacaagagcgtctacttcgacctcgatgacatccggaacaccaccggacagtgggacctctacttctctcaccccccgggggggggggccnnnacaaannaatttcttccnaaccttttggggttccgttgaccagagaggccgtctgttccanttcctcttcctggggcccgtctcacttctgggccacggcacgcggtcggggacccccgagccccctnnccnatacaaaagggagccttgggggccccccccgggctggcgctggtccgaaaaaactcaatctcggntccggtgcgcggtccctagcggacgggggagccctnacttgcgccccccaagccgcgcgggcaaacgcccccgccacttgnngtagggggacgtgggtgggggactccgcggggggaagggggca

SEQ ID NO: 58540 - protein, 93 aa, Zea mays
  misc_feature: Ceres CLONE 1512131
  misc_feature (5)..(94): Pfam Name: PSI_PsaH Pfam Description: Photosystem I reaction centre subunit VI
  misc_feature (43)..(43): Xaa is any aa, unknown, or other
  misc_feature (81)..(81): Xaa is any aa, unknown, or other
  misc_feature (83)..(83): Xaa is any aa, unknown, or other
  misc_feature (84)..(84): Xaa is any aa, unknown, or other
MASLAAVSVKPVAIKGLAGSSISGRKLAVARPSARSIRRPRAXAVVAKNGDKSVYFDLDDIRNTTGQWDLYFSHPPGGGAXTXXFLPNLLGFR

SEQ ID NO: 58541 - DNA, 699 bp, Zea mays
  misc_feature: Ceres CLONE 1512135
  misc_feature: Encodes the peptide sequence at SEQ ID NO. 58542
  misc_feature (1)..(1): n is a, c, t, g, unknown, or other
  misc_feature (124)..(124): n is a, c, t, g, unknown, or other
  misc_feature (315)..(315): n is a, c, t, g, unknown, or other
naaaagctggagctcacgcggtggcggccgctctagactagtggatccccgcgctgcaggaatccgtctcacccctagaaaaaaaaacgaggacacgcgacgactgacaaggcgaggggagcantcggcgggcgatggtcggcggcggcgcacatggcgggcccacctacaaaggctaccccatcccacacaacaggcgctggcacaccgtcgccggcaaggggcctgtagccctgtgatgggggttccgggtcttccgcaaggcttagccaggatggtgcctcctttctaggaaataaaaaaaaccaagggaanccccaccaataaccccgggcaagcccacagggcatagcttaggggcctttttttcccccccccccccccaagggggggggggggggggtttttttataaccgccgctttaccccccccctcttagggggggccctcaaccgacgggtgggcccgggcccggggcccacccgtcgcgggcatgacacgggggatacccacgggcggggagacaaccgcgggggcgacaatttcgtcggctcacccgaggcggggcccccacacaggcccgcgaccctactacgaaggattttatgattgtggtgagaggaaagaaccgccgagaaaacggtgggacccacccgccctagaggggggaacccctccccccgcccgacccacgcgag

SEQ ID NO: 58542 - protein, 34 aa, Zea mays
  misc_feature: Ceres CLONE 1512135
MVGGGAHGGPTYKGYPIPHNRRWHTVAGKGPVAL

SEQ ID NO: 58543 - DNA, 708 bp, Zea mays
  misc_feature: Ceres CLONE 1512144
  misc_feature: Encodes the peptide sequence at SEQ ID NO. 58544
  misc_feature (50)..(50): n is a, c, t, g, unknown, or other
  misc_feature (78)..(78): n is a, c, t, g, unknown, or other
  misc_feature (409)..(409): n is a, c, t, g, unknown, or other
  misc_feature (410)..(410): n is a, c, t, g, unknown, or other
  misc_feature (614)..(614): n is a, c, t, g, unknown, or other
aacgctggagctcaccgcggtggcggccgctctagactagtggatttctntggctgcaggaattcgtctcacccctanggagcccactcctgcagtccttctccacctagctcccccgcgccaagaacacgccagctagcaagcgcgctcgatcgaataccgttaccgtgtcgccatggccgccaccgcgtctctatcagccgtcggggcgccgctgtcggtgcccgggctcaggaagccgctcggcgtgtcgtcgctccggcccctgcagccgagggcggcgaggatgacgacgacggccgtgcgggcgtcggcgtctccctcgtccacgtccatcaaggagaaggctgcggccgggctgaccgcggccgccctgacgccctcgcttgtgctgccggaagacacccannccgcgcagcccggggggttcacgtcggtcgccaagagcttcctcctcgccctctgttcggtggggccccgctcattgcattcgctggggccccctcccctcctcgcaccggtaccccgttaaggggggcccgcgcgggagtcgatcctaccggaccgggcccccccgggttcccgtccccgggcctggagcgcggcccccctcnttcccggcggcggctgagtcccccccgccgtgcctgcccgagatgccccgcggcacttctccccccaccgtttgaatcgagaaatgacgcgccg

SEQ ID NO: 58544 - protein, 118 aa, Zea mays
  misc_feature: Ceres CLONE 1512144
  misc_feature (78)..(78): Xaa is any aa, unknown, or other
  misc_feature (79)..(79): Xaa is any aa, unknown, or other
MAATASLSAVGAPLSVPGLRKPLGVSSLRPLQPRAARMTTTAVRASASPSSTSIKEKAAAGLTAAALTPSLVLPEDTXXAQPGGFTSVAKSFLLALCSVGPRSLHSLGPPPLLAPVPR

SEQ ID NO: 58545 - DNA, 693 bp, Zea mays
  misc_feature: Ceres CLONE 1512147
  misc_feature: Encodes the peptide sequence at SEQ ID NO. 58546
  misc_feature (563)..(563): n is a, c, t, g, unknown, or other
agagctggagctccccgcggtggcggccgctctagaactagtggatcccccgggctgcaggaattcgtctcacccctagaaaaactgatagcttgctccaggacgtacgtacgtacgtagatcgatccatcgatcgctagctagctgacgaccatggcgtccctctcctctgccgccatcaccgccccttccttcacggccgcgcccgctcgcgcagtggtcagcaggaggtccttcaccgtgcgtgcctctctccgcaaggccactgccaccgccgccgtggccgttgccgccagcgtcctgcttgccggcggcggcgccatggcccaggaggtgctgctgggcgcaggcgacggcgggctcgtcttcgagcccagccagttcaccgtcaaggccggcgacaccatcacctttcagaaacacgccggctttcccgcacacgtcgtgttcgacgaagacgaggtgccgaagcgcgtcaacgcctccagatctcgcaggaagagtacttccacgcgcccagcaagacctacttcgtcaccctaaccggtgccgggacctacggntttctactggcaaccccaccaagaaccaagaatgtccgcaaaatcccagtcaactaaagctagctaatcctttcatggcaccccaattggaaggaccccgcccccccaaagaagaaccccccccctccat

SEQ ID NO: 58546 - protein, 129 aa, Zea mays
  misc_feature: Ceres CLONE 1512147
  misc_feature (59)..(129): Pfam Name: Copper-bind Pfam Description: Copper binding proteins, plastocyanin/azurin family
MASLSSAAITAPSFTAAPARAVVSRRSFTVRASLRKATATAAVAVAASVLLAGGGAMAQEVLLGAGDGGLVFEPSQFTVKAGDTITFQKHAGFPAHVVFDEDEVPKRVNASRSRRKSTSTRPARPTSSP

SEQ ID NO: 58547 - DNA, 711 bp, Zea mays
  misc_feature: Ceres CLONE 1512148
  misc_feature: Encodes the peptide sequence at SEQ ID NO. 58548
caaagctggagctccccgcggtggcggccgctctagaactagtggatcccccgggctgcaggaattcgtctcacccctagaaaaaattcactcacccacctagctagtcatcactagtcacgttcgtccaccagagacaacaatggccatggagacatgcttcagagcgtgggcgctgcacgcccccgctggcagaaaggacaggctcctcgtcggccacctggtgctgccgtcaaagcgggcgctcgcgcctctgtccgtgggccgagtcgccacgcgccggccacggcacgtctgccaatccaaaaacgcactgcacgaacttgtggtggcgtaccagaagaactgcgacgggttggtgatggcgtgccagactcctgtgctggtggacttctgggctccttgttgcgggccgtgccggatgatcgcacctgagatcgacgagctggccaaggactacgcctgcaagatcacctgctgctaggtgaacacggactacagccccaacgtggcttctacctactgcatccgcagcatccccaccgtgctcatcatcaagggctgcaagaagacagagagcgtactcggcgccgaccctaatccacgctcaccacctcgtcgaaagtacatcagtagttcatgagcatgccatgtcatgccatgctacatgcatcgacgactaaacgcatacctgtatctctagtatccttt

SEQ ID NO: 58548 - protein, 113 aa, Zea mays
  misc_feature: Ceres CLONE 1512148
  misc_feature: SWISSPROT Homolog: EC 1.8.1.9 Thioredoxin-disulfide reductase
MAMETCFRAWALHAPAGRKDRLLVGHLVLPSKRALAPLSVGRVATRRPRHVCQSKNALHELVVAYQKNCDGLVMACQTPVLVDFWAPCCGPCRMIAPEIDELAKDYACKITCC

SEQ ID NO: 58549 - DNA, 656 bp, Zea mays
  misc_feature: Ceres CLONE 1512151
  misc_feature: Encodes the peptide sequence at SEQ ID NO. 58550
  misc_feature (504)..(504): n is a, c, t, g, unknown, or other
aaagctggagctccccgcggtggcggccgctctagaactagtggatcccccgggctgcaggaattcgtctcacccctagaaaaatttttccctgccacagtcatcagccgccgtagggagcaggagtgagggagcgcgatggcggagaagaagcagcgcccaggagggtccaggaaggacgaggtggttacccgcgagtacaccatcaacctccacaagcgcctccacggatgcaccttcaagaagaaagcccccaatgctatcaaggaaatcaggaagtttgcacagaaggcaatgggcaccactgacatcaggattgatgtgaaactcaacaagcacatctggagcagtggtatccggagtgtgccgaggcgtgtccgtgtcaggatcgcacgcaagaggaacgatgaggaagacgccaaggaagagctttactctcttgttaccgttgctgagatccccccagaagcctgaaggtctgggtaccaagtttgtgagacgacnatagatctgcctggtactgatctggtcactgtcaatcatttttttggtgttttgagtttgtagcccctaattgatagctttgggaaaaaatgagttttcggatgcccccttgttctcgctggtttaaccttttgaaaaccctgcccagtttg

SEQ ID NO: 58550 - protein, 111 aa, Zea mays
  misc_feature: Ceres CLONE 1512151
  misc_feature (12)..(106): Pfam Name: Ribosomal_L31e Pfam Description: Ribosomal protein L31e
MAEKKQRPGGSRKDEVVTREYTINLHKRLHGCTFKKKAPNAIKEIRKFAQKAMGTTDIRIDVKLNKHIWSSGIRSVPRRVRVRIARKRNDEEDAKEELYSLVTVAEIPPEA

SEQ ID NO: 58551 - DNA, 710 bp, Zea mays
  misc_feature: Ceres CLONE 1512152
  misc_feature: Encodes the peptide sequence at SEQ ID NO. 58552
aaagctggagctccccgcggtggcggccgctctagaactagtggatcccccgggctgcaggaattcgtctcacccctagaaaaaacgccgcctctcaggaccacgccgtgcctccgcctggaaccctttatacgagcggaccaaggaaagagatgggaaacggtacgggcagcttcggtcagcgccggaccgagacaacgcgctctgcgtcggctgcggccgccgcaccttccacctccagaacaacactctgatgctcctgtggctaccccgccggccgaatccgccagtataacctggactgtgaaagccatccggcataagacaactggccctccgaatgatgatgtacatgcgacacgtgcctcgccatttccagagcaacttccgacaacggactgaggctgccccacagaacggtgtagctgctgccaactaactgtggtcttgctgccatcaacaaccgctagaacttgacactttgtgattgaattgtacttctgaactatttagcccataatactatgcttgaattaatttcagacgccctgcagaggtatatgcatctttttggtgagaatggttcactacgctctagccttgacggccggatcatcgatcgtcgacatgatgatatctatcgagacgctcgaggtacccaatgcgccctatagtgagtcgtattacgcgcgctcactggctgtccttgt

SEQ ID NO: 58552 - protein, 32 aa, Zea mays
  misc_feature: Ceres CLONE 1512152
MMMYMRHVPRHFQSNFRQRTEAAPQNGVAAAN

SEQ ID NO: 58553 - DNA, 783 bp, Zea mays
  misc_feature: Ceres CLONE 1512156
  misc_feature (49)..(49): n is a, c, t, g, unknown, or other
  misc_feature (81)..(81): n is a, c, t, g, unknown, or other
  misc_feature (567)..(567): n is a, c, t, g, unknown, or other
cgcgctggagctcaccgcggtggcggccgctctagactagtggattctntggctgcaggaatcgtctcattccctaggagngcagtccttctccacctagctcccccgcgccaagaacacgccagctagcaagcgcgctcgatcgaataccgttaccgtgtcgccatggccgccaccgcgtctctatcagccgtcggggcgccgctgtcggtgcccgggctcaggaagtcgctcggcgtgtcttccctccggcccctgcagccgagggcggctaggatgacgacaacgggccgggcgggccttcggcgtctcccctcgtccaagtcccatccaggcagaaggttgccggcccgggttgaatgtgggcggcctctggccggcggcccttggtgtctccccgaacgcccaacagaaagcgcccccccagcctcggccgggctcgccctcgctcgggccccgcaagccgcgcttcccttggacccagcggggctcccgcgtgggcggcccgatgccaccgaccgcggtacttggccgtgggtcccccccactcccgcctacggttcaaanttttcccccctctcacccacaaagggccccgtatatgtgaaatctcgcggggcgctcttctatgattccccgcgggtagcaaccgtatacggggccgggaagcgggtgctgcgacgtccccgggtcggtcccctcgcttacgccacgggtgggcgcgtgccggtgcgggcggatattagtcggaccccgggcgttcgccctccccggtaagctcgg

SEQ ID NO: 58554 - DNA, 697 bp, Zea mays
  misc_feature: Ceres CLONE 1512168
  misc_feature: Encodes the peptide sequence at SEQ ID NO. 58555
caaagctggagctccccgcggtggcggccgctctagaactagtggatcccccgggctgcaggaattcgtctcacccctagaaaaagttcttcctctccttttcccaaaggcaaccaaaccatctcgactcgtggggaagtttcgctctcgcccgcgtcgacttcctagggttcgaggaacgtccgtccgtccgtccggggaaggagcaggagggaggcggagatgatcgaggtggtgctcaacgaccgcctggggaagaaggtgcgggtcaagtgcaacgaggacgacaccatcggcgacctcaagaagctggtggcggcgcagacggggacgcgccccgagaagatccgcatccagaagtggtacaacatctacaaggaccacatcaccctcaaggactacgaggtccacgacggcatgggcctcgagctctactacaactgagccgccgcccctctctccctctcgtcaggttggtctgaattctgaagtcatgggtgcaattcgcttcgcggtgatctcttaagctcatcacatatataaaagcaacctcagttggctatgtaagacatggcgtgccaaactatcagtgaccactgccagctttgcaatacgttgttgtatggtcaacctgcaaacttggtgtactgctactcgtactataaataacatagggttttaaccttggttgtgctaa

SEQ ID NO: 58555 - protein, 73 aa, Zea mays
  misc_feature: Ceres CLONE 1512168
MIEVVLNDRLGKKVRVKCNEDDTIGDLKKLVAAQTGTRPEKIRIQKWYNIYKDHITLKDYEVHDGMGLELYYN

SEQ ID NO: 58556 - DNA, 644 bp, Zea mays
  misc_feature: Ceres CLONE 1512176
  misc_feature: Translation starting site: 160
ctccccgcggtggcggccgctctagaactagtggatcccccgggctgcaggaattcgtctcacccctagaaaaaaaccgagacaccgcgtgcgaaccaagcagaccccagcagaagaagcgaagtcgtcgccggagcaggaggaagagcgagcagcaagatgtcgtggcaggcgtacgtcgatgaccacctgctgtgcgacatcgaaggccagcacctcagcgccgccgccatcgtcggccacgacggcagcgtctgggcacagtccgagaacttccccgagttaaagcctgaggaggttgctgggatgataaaggactttgatgaacctggaactcttgcaccaactggtctttttgttggaggtacgaagtacatggtgatccaaggtgaaacctggagttgtcatccgagggaaagaaggcactggaggcattactatcaagaaaactggcatgtccttgattatcgggatctatgatgagccaatgactccaggcaatgcaatatgggtgggtggagaggctcggcgattacctgatcgaacaagggcttctaaagttgtcataatgcctattttggtcattggggcactaaagtttgcacctcatttggttcctgtaatatgtggggcttgtgcatctc

SEQ ID NO: 58557 - DNA, 687 bp, Zea mays
  misc_feature: Ceres CLONE 1512178
  misc_feature: Encodes the peptide sequence at SEQ ID NO. 58558
  misc_feature (414)..(414): n is a, c, t, g, unknown, or other
gctctagaactagtggatcccccgggctgcaggaattcgtctcacccctagaaaaaaccaatcccacaatattcgtggttcgacgatctccggcggcggcaggaacgcctcccgattactacggccgaactagatagcgatggcgctgactaacttcatcgtgacggtggtcgtggttggcgcgggggtgcttctctttaccacctacatccgcaggtctggcgccctcttccgccgcaacgcgcgccagctccggctgtgtctcgaggaggacacggcctccgccgcgtccaagtctgcaaaaaaagcaactccaaagaaactcgactcttttgtcccctcggagaagggggagaggagagccactgattggagctgtttataccaccccccataacccctatttgaagacgnccaaggtctgttttctacagttgctgcgatggaaacttgtagctctcaagtaggtgcacggtcaagtcggctagagtatgtttcccttttgacatcttttctctgttgaacagcctagcctgaaggttggtattatgctcccgtgccttatttgtatccgaaagcacttccactaaatctacaccgtagtctcaaatctttgtttggtggccgaaaaaaaaaaaaacataataccgaggactcctcatgaggttactccagatttccccccta

SEQ ID NO: 58558 - protein, 85 aa, Zea mays
  misc_feature: Ceres CLONE 1512178
MALTNFIVTVVVVGAGVLLFTTYIRRSGALFRRNARQLRLCLEEDTASAASKSAKKATPKKLDSFVPSEKGERRATDWSCLYHPP

SEQ ID NO: 58559 - DNA, 707 bp, Zea mays
  misc_feature: Ceres CLONE 1512179
  misc_feature (522)..(522): n is a, c, t, g, unknown, or other
  misc_feature (524)..(524): n is a, c, t, g, unknown, or other
  misc_feature (526)..(526): n is a, c, t, g, unknown, or other
  misc_feature (527)..(527): n is a, c, t, g, unknown, or other
  misc_feature (587)..(587): n is a, c, t, g, unknown, or other
tggcggccgctctagaactagtggatcccccgggctgcaggaattcgtctcacccctagaaaaaactctctcttgtctcccagtttctaaccctagccgccaaggccaagctccctcccaagtccaaagtcccaaactgctcgtatgcggtgcaaggctgcaggcatccacctccatcaggcgctgacccagtttccgccatccaccaggcgtcctcataatacggtgcagggctgccaagcagcgagcagcaagccgccgagcagcgagcactgaggaccgtcgagcagccgagcaccgagcagcgagcagaggacagcgaccgtcgagcaaccgagtcgcgagtcttctctggtaaattaaacaagcttggatgaattagtgtttcgatttagagttttggacagattacttgtatggatttgagaagattacttgtatgaaacgttgacattgttgtttgctgcttacaatattattgggatgctgttggaatgttaatttgtgataaatttctgctangnanngaaaggggataggacgggaagaggaacacgactgcttaccacttagactatccaaccggnccgggccgctcgacgtacccaattcgccctatagtgagtcttattacacgcgctcaactgcccgtcattttacaacgtcgtgactggggaaacccctggcgttacccacttaatcgcctg

SEQ ID NO: 58560 - DNA, 627 bp, Zea mays
  misc_feature: Ceres CLONE 1512182
  misc_feature: Encodes the peptide sequence at SEQ ID NO. 58561
ctccccgcggtggcggccgctctagaactagtggatcccccgggctgcaggaattcgtctcacccctagaaaaacaaacgaggggttcactttttccgtccagttcccaaggaatatcttcattctgcagaattaagagacatcatgcaatttggtagcagcaatactgctgttttctttaaaatgcgagttgctggtgtccttcatatctttcaatttgaaacaaagcagggcgaggaaatatgtgtagcacttcaaacacatataaatgacgtcatgctccgcagatattcaaaagcacgctgtgctaatagtgtgacatcgcaaaatgatgttaaccatgcatataagccaccaaatattgaaatgtatgagaaacatgtccaagaactgacaaaaacacctgaggaatctcagaagcaagcagatcagttgcgagaagatctaccgttgaagaccaacaagaaacacagatgcaagaagagttggaaaggctaaaaaacaccttgcaatccgaacgacaaagttccaaagaactaaaaaatgagcttgataaactaaaatccctatgggatgaaaaaaaactgcctttcaaggctgccctgaaggaaaaacagtaaccttgaa

SEQ ID NO: 58561 - protein, 117 aa, Zea mays
  misc_feature: Ceres CLONE 1512182
MQFGSSNTAVFFKMRVAGVLHIFQFETKQGEEICVALQTHINDVMLRRYSKARCANSVTSQNDVNHAYKPPNIEMYEKHVQELTKTPEESQKQADQLREDLPLKTNKKHRCKKSWKG

SEQ ID NO: 58562 - DNA, 737 bp, Zea mays
  misc_feature: Ceres CLONE 1512186
  misc_feature: Encodes the peptide sequence at SEQ ID NO. 58563
  misc_feature (452)..(452): n is a, c, t, g, unknown, or other
  misc_feature (468)..(468): n is a, c, t, g, unknown, or other
acccgcggtggcggccgctctagaactagtggatcccccgggctgcaggaattcgtctcacccctagaaaaactaaggcaaacgatgatacgaagaaacagcaaagaccatttctcatgcaattcttctcaccaattttcataaaggcattttctattacattctttggtgagtggggtgacaagagccagattgctactattggcttggctgctgatgaaaacccatttggtgttgtcctgggtggaatcatagcgcaagcactctgcactactgctgctgttcttggtggaaagagcctagcctcccagatatccgagaagatggtcgaactgtcaagcggagtgctcttcctgctgttcggtatcatgtcattgctctctggaccaggagaattgcaacccctgcttgaacccttttcagctggctgattgacatctctctctccttanaactatctttatttcntagatgaatgatggcgacaaaagccatccattcattatggcgaaccgggatggggattccatagttaagcccaacacttcggaaacatttccctcccccctttcctaaaaaaataacgtgttaacaaaaatcctagcgaatttccttccggttgggggtccacccgggggaaaagtccgtcttttttaaaaaaaaaaaaaaaaaccgaaacccctccagggacccccaatttccgccctaatagggagagccgaattaacccccgcctt

SEQ ID NO: 58563 - protein, 104 aa, Zea mays
  misc_feature: Ceres CLONE 1512186
  misc_feature (8)..(83): Pfam Name: UPF0016 Pfam Description: Uncharacterized protein family UPF0016
MQFFSPIFIKAFSITFFGEWGDKSQIATIGLAADENPFGVVLGGIIAQALCTTAAVLGGKSLASQISEKMVELSSGVLFLLFGIMSLLSGPGELQPLLEPFSAG

SEQ ID NO: 58564 - DNA, 681 bp, Zea mays
  misc_feature: Ceres CLONE 1512188
  misc_feature: Encodes the peptide sequence at SEQ ID NO. 58565
caaagctggagctccccgcggtggcggccgctctagaactagtggatcccccgggctgcaggaattcgtctcacccctagaaaaaagcagcagcacagtcatccacactaacgaacgaactgaggtcgacgacgactgatcgagcagcgacgatggcggctgtgctgaacagcaggaagacgccgcaggtggttgccgtgctggtggcggcggcgctgctggcgtcgtccgcttcggcggcgatcacctgcgggcaggtggggtcgtcgctggctccgtgcatcccgtacgcgacggggagggccagcgcgctccccgcgtcgtgctgcagcggcgtcaagagcctcaacagcgcggcgcggaccagcgcggaccgccaggcggcgtgccgctgccctcagagcctcgcctacagcgtcaagagcgtcaacatgggcaccgtcgccaccatccccggcaagtgcggcgtctccgtcggatttcccatcagcatgtccaccgactgcaacaagatcagctaagttatacgacgaccaagcctataaggcctaccgaacgtacacgtacgtcccgcgcgcttgaccagtgatgaagccagggaaaaattaaattaagctacctgttttgcagggaccacttgcaaaatccatctaaatataaccggaccggagacccctttat

SEQ ID NO: 58565 - protein, 122 aa, Zea mays
  misc_feature: Ceres CLONE 1512188
  misc_feature (33)..(118): Pfam Name: Tryp_alpha_amyl Pfam Description: Protease inhibitor/seed storage/LTP family
MAAVLNSRKTPQVVAVLVAAALLASSASAAITCGQVGSSLAPCIPYATGRASALPASCCSGVKSLNSAARTSADRQAACRCPQSLAYSVKSVNMGTVATIPGKCGVSVGFPISMSTDCNKIS

SEQ ID NO: 58566 - DNA, 670 bp, Zea mays
  misc_feature: Ceres CLONE 1512191
  misc_feature (495)..(495): n is a, c, t, g, unknown, or other
  misc_feature (499)..(499): n is a, c, t, g, unknown, or other
  misc_feature (507)..(507): n is a, c, t, g, unknown, or other
  misc_feature (545)..(545): n is a, c, t, g, unknown, or other
  misc_feature (622)..(622): n is a, c, t, g, unknown, or other
  misc_feature (661)..(661): n is a, c, t, g, unknown, or other
aaagctggagctcaccgcggtggcggccgctctagactagtggatcccccgggctgcaggaattcgtctcacccctagaaaaaaaaatcacttatatccgtagaagccaaagatggagacatcaacaagaggatagatcgggccttcaaggtgtatgaactgttggagaagcgaatagatagcttcaagatgcttcctgctgcaaacaagaaaccattaacccaggcagagcaggagttcaaatcacagcttgatcggttcgcagatgtggaagctggatgttttgcggtttcctccattgccggccctgagtgctaggaatgaaaacgtttttgctccaacaaatccccggggcagaggccggtctaacaccaagaaaatggcccccccattggccaaggcccccccagaggggctcttttaaatccataaccctcctttattcccccccccccccccccccccaaaaaatatgccccccccctcccgctaagnaagnaagcgctnccccccccccccgggaaaacaaaaacccctcacccccncgcggtccacccctccgctcaacccacacaacaacacccgccccccccaccacaaaccgcccgcaccacgcacctcncgaccgctcacgctaacctcggaccagcccccaccctgnacaccctcc

SEQ ID NO: 58567 - DNA, 566 bp, Zea mays
  misc_feature: Ceres CLONE 1512192
  misc_feature: Encodes the peptide sequence at SEQ ID NO. 58568
  misc_feature (393)..(393): n is a, c, t, g, unknown, or other
  misc_feature (428)..(428): n is a, c, t, g, unknown, or other
gctctagaactagtggatcccccgggctgcaggaattcgtctcacccctagaaaaagacggcatttgcatctgagttcctgattgttgtattccagtttcttctgtgagttttgtgggatcgcgaggaagaactagaaggatgtcgtgctgcggaggcaactgcgggtgcggcgccggctgcaagtgcggcagcggctgcggagggtgcaagatgtacccggacatggctgagcaggtgaccaccactacccagactctcatcatgggtgttgcacccgtccagggcgggttcgaggcggccgccggagctgagaacggcgggtgcaagtgcggcgccaactgcacctgcgacccctgcaccctgcagtgagacgacggcgatgacgctgcanggcgtcatgggatcggaaggactcttttatcttangctctagtatatattctagcagtgtcgtttgtgttttgttcgagtcagtcaaacagtcagccgcgtgccctggggccatggaataacatggccttttgcctcccttcaattgggtcccaatccccttttttttcccaa

SEQ ID NO: 58568 - protein, 76 aa, Zea mays
  misc_feature: Ceres CLONE 1512192
  misc_feature (1)..(75): Pfam Name: Metallothio_2 Pfam Description: Metallothionein
MSCCGGNCGCGAGCKCGSGCGGCKMYPDMAEQVTTTTQTLIMGVAPVQGGFEAAAGAENGGCKCGANCTCDPCTLQ

SEQ ID NO: 58569 - DNA, 633 bp, Zea mays
  misc_feature: Ceres CLONE 1512193
  misc_feature: Encodes the peptide sequence at SEQ ID NO. 58570
ctggagctccccgcggtggcggccgctctagaactagtggatcccccgggctgcaggaattcgtctcacccctagaaaaacttgccgccagccagcccattaaccctcgttcctgtcgcgcagccacgacctccacttccacatctcccccggcgtcggcgcggtcagttgaaccatggcggactccaaggccacctcggtggtcaccctccgcacccgcaagttcatgaccaaccgcctcctggcccgcaagcaattcgtgcttgaggtgatccaccccggccgcgccaacgtctccaaggaggagttgaaagagaggcttgccaacgcgtacgaggtgaaggaccccaacaccatctttgccttcaagttccgcacccacttcggaggaggaaagtccactggattcggcctcatctacgacaacctcgaggctgccaagaagttcgagccgaaataccgcctcatcaggaatggtcttgctactaaagttgagaagtcccgcaagctaatgaaagagcggaagaacagggcccagaagatccctggtgtcaagaagaccaaagctggcgacgccaagacgaagtaaacgttcgtttacatgtgtattactgctctgggctctgggcggtc

SEQ ID NO: 58570 - protein, 137 aa, Zea mays
  misc_feature: Ceres CLONE 1512193
  misc_feature (28)..(111): Pfam Name: Ribosomal_S24e Pfam Description: Ribosomal protein S24e
MADSKATSVVTLRTRKFMTNRLLARKQFVLEVIHPGRANVSKEELKERLANAYEVKDPNTIFAFKFRTHFGGGKSTGFGLIYDNLEAAKKFEPKYRLIRNGLATKVEKSRKLMKERKNRAQKIPGVKKTKAGDAKTK

SEQ ID NO: 58571 - DNA, 629 bp, Zea mays
  misc_feature: Ceres CLONE 1512198
  misc_feature: Encodes the peptide sequence at SEQ ID NO. 58572
ggagctccccgcggtggcggccgctctagaactagtggatcccccgggctgcaggaattcgtctcacccctagaaaaaatccaacccatcagtacccaaccttcccctacaccagaaaaatgccccagttctttggtccgcgtcagagaggcggcggcgatgtctgggcgcggcaagggcggcaagggtctgggcaagggcggcgcgaagcgccaccggaaggtgctccgcgacaacatccagggcatcaccaagcccgcgatccggaggctggctaggaggggtggcgtgaatcgcatctcggggctcatctacgaagagacccgcggcgtgctcaagatctttctcgagaacgtcatccgcgacgccgtcacctacaccgagcacgcgcgccgcaagaccgtgaccgccatgaacgtcgtctacgcgctcaagcgccagggccgcaccctctacagcttcagaggctaggctaggcgcctcttcgtagtcggggactggttaggggacatgtctctgtgtgatgctttctgaggcagtattgctgcaatagctgtgtaatccatcgcttctgcaatgaagcgctttgaagcatgctacggatgttgccgtctgtgggggattgtatt

SEQ ID NO: 58572 - protein, 103 aa, Zea mays
  misc_feature: Ceres CLONE 1512198
  misc_feature (25)..(94): Pfam Name: Histone Pfam Description: Core histone H2A/H2B/H3/H4
MSGRGKGGKGLGKGGAKRHRKVLRDNIQGITKPAIRRLARRGGVNRISGLIYEETRGVLKIFLENVIRDAVTYTEHARRKTVTAMNVVYALKRQGRTLYSFRG

SEQ ID NO: 58573 - DNA, 646 bp, Zea mays
  misc_feature: Ceres CLONE 1512202
aagctggagctccccgcggtggcggccgctctagactagtggatcccccgggctgcaggaattcgtctcacccctagaaaaaaaatggcggcggtcgctcgtgcccgtgcctgcccgcgtcgaaccctagtgcaactaccagatccggaggatcccgcgcgggcgcgggcgggacaccaagcttctgactcaactcagtccccgcacctgccaatgccagcccgtcggcgctgatccgatgccatggcctccgacactatccggaccgactcatggattcggacaaggactgtctccagaagctgcatgcgcgggacaaggacaaagagctggtcgcctagacggcagcgccagggtcgcccaccgatggcgccgggaagtgggagagtatcgacgccccggccggggaggtggcgcttcctacgccacccagcagaggggggctgtggcaaaacagggcttctttgagcccctcaatgtcggaggggaaatttcttcccgggacgcagggaagaaccttttgattcttggagatgacaccttcccaaatgcctaggtttctcaaataataacccgaaccattttttcttgaatcaaaaaaaaaacactttaggaccccccaaagatacccaaatggcgccctaaa

SEQ ID NO: 58574 - DNA, 863 bp, Zea mays
  misc_feature: Ceres CLONE 1512210
  misc_feature (35)..(35): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (343)..(343): n is a, c, t, g, unknown, or other
cgcccccggcagcgcgccgccgcgacaccgccgcngcggcgnnnnnncccgggggggggttcaaactggagctccccgcggtggcggccgctctagaactagtggatcccccgggctgcaggaattcgtctcacccctagaaaaaaaccctagtctcagagcagccgcatccacaacctgcctctctcgtcccctggcggcgtccgcggcaggatggcggaatctacggcgaggacggtgaaggatgtcaacccgcacgagttcgtcaaggcctactccgcccacctctagcgctccggcaagagggagctccctgagtgggttgaaattgtgaagactgganaagttcaaaagaatcttcctccctaaggatcctggacgggggtcttgcgccgggggctggcatcccattggcgcggaagtatccttcctaatgggccaaggcaacccgggggggggggagggggtttgtcagaaaaaaccctgaggggtgcgcccccaccccacaagggaagagggggtaccgccgcccccatcccataagcttttcctggcgcaggaggcccccgtcgttgttgacggggtgtttgcaacggcgacaagccagtccgctgttcctgccacacctgcgctatgagattttttggtgggttcactacttctcagtagggtctagagaaccgccggggggggggtgaggacgcgcacggccagtgtcaccatattttcggggcgggatagtcgctgggtcttcctgcgacaccccatccggctgtcgtggaagggggcccttcattactcgtaaaacccattggactctcatacatgattggctgtgccgcgtcatcacccagcgcagcccc

SEQ ID NO: 58575 - DNA, 640 bp, Zea mays
  misc_feature: Ceres CLONE 1512228
  misc_feature: Translation starting site: 100
  misc_feature (358)..(358): n is a, c, t, g, unknown, or other
atagctggagctccccgcggtggcggccgctctagaactagtggatcccccgggctgcaggaattcgtctcacccctagaaaaaactgacgagctcgccatggcctccctctcctctgccgccgtcaccgccccttccttcgccgcaccagcgccagcccgcgccgtggtcagaaggaggtccttcaccgtgcgcgcctctctccgcaaggccaccggcaccgccgccgtggcaatggctgccagcgccctgcttgccggcggagccatgacccaagacgagctgctggacgctggcgactgagggctcgtcttctagcccagccagttcaccgtcaaaggcggcgacacctcacatntatagacaacgacggcttcccgcacatcgtctgcttcgacgaagactaagcgcctagcggcggcgactccacccctatcccgcaggaggagtacatcaacgcgtcacggcgagacctacatcgtcaccctcaccaagcccggaacctacggctgctactgcgagccgcatcatggagcccgtatggccggcaagatcaccggacactaattaagctatgctatcgatcgatatccattcatgtagtagctgctgcattctgccttgatctcccgcgatctgg

SEQ ID NO: 58576 - DNA, 783 bp, Zea mays
  misc_feature: Ceres CLONE 1512229
  misc_feature: Encodes the peptide sequence at SEQ ID NO. 58577
  misc_feature (1)..(1): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (64)..(64): n is a, c, t, g, unknown, or other
  misc_feature (76)..(76): n is a, c, t, g, unknown, or other
  misc_feature (187)..(187): n is a, c, t, g, unknown, or other
  misc_feature (190)..(190): n is a, c, t, g, unknown, or other
  misc_feature (224)..(224): n is a, c, t, g, unknown, or other
  misc_feature (439)..(439): n is a, c, t, g, unknown, or other
  misc_feature (484)..(484): n is a, c, t, g, unknown, or other
  misc_feature (503)..(503): n is a, c, t, g, unknown, or other
  misc_feature (523)..(523): n is a, c, t, g, unknown, or other
  misc_feature (575)..(575): n is a, c, t, g, unknown, or other
  misc_feature (576)..(576): n is a, c, t, g, unknown, or other
  misc_feature (578)..(578): n is a, c, t, g, unknown, or other
  misc_feature (691)..(691): n is a, c, t, g, unknown, or other
  misc_feature (700)..(700): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
nggtcctnnnttgcagctgtagctcaccgcggtggcggccgctctagactagtggatccccggnctgcaggaatcntctcacccctagaaaaactctccgtgctttctcagaggtgggttggcttctcctccccaccggttcgtgttcaggttctggttcgtgggcgagagggaagagatggcgccntcngacgttgagtaccgttgcttcgttggcggcctcncctgggccaccgacgaccactccctcaacaacgccttcaggacctacggggaggtccttctattcctatttcccccccgaatggggaggaccccaccccccccggtctttctgcttcagtcggctgtcgccccggggaggaacggaattttttttccccccccccccccggggggggggggggggggggggttctctcttatccccccacccccncggggggtgtggggggcggaaacgcaccaccattccacccggttnttccccgcggtgggccggncgcgccacccaccgcggggnggcgcctgcgccacggtggcggggggagcgaccgccgctcacggcgcacggnngntggggcgtgcccccgacgctaccgcgccagcgctcacgtaacctcacctacccgctagcgagggtgcacgcgagggtaagcgctccgtcctcccctcgctctctccgctagtntggcgcaangaggtgcgggacacgccgccgcagacgtccgtctcgtgtgcgtcgggacgaggnnnactgccgcgcggcggaggctcgccgcg

SEQ ID NO: 58577 - protein, 146 aa, Zea mays
  misc_feature: Ceres CLONE 1512229
  misc_feature (16)..(16): Xaa is any aa, unknown, or other
  misc_feature (102)..(102): Xaa is any aa, unknown, or other
  misc_feature (109)..(109): Xaa is any aa, unknown, or other
  misc_feature (133)..(133): Xaa is any aa, unknown, or other
  misc_feature (134)..(134): Xaa is any aa, unknown, or other
MAPSDVEYRCFVGGLXWATDDHSLNNAFRTYGEVLLFLFPPRMGRTPPPPVFLLQSAVAPGRNGIFFPPPPPGGGGGGGFSLIPPPPRGVWGAETHHHSTRXFPAVGRXRHPPRGGACATVAGGATAAHGARXXGRAPDATAPALT

SEQ ID NO: 58578 - DNA, 591 bp, Zea mays
  misc_feature: Ceres CLONE 1512231
  misc_feature: Encodes the peptide sequence at SEQ ID NO. 58579
  misc_feature (124)..(124): n is a, c, t, g, unknown, or other
  misc_feature (326)..(326): n is a, c, t, g, unknown, or other
  misc_feature (417)..(417): n is a, c, t, g, unknown, or other
aaactggagctccccgcggtggcggccgctctagaactagtggatcccccgggctgcaggattcgtctcacccctagaaataccagccgcccgcaacccgcaaagctgcgttcctcggactagnctagggtttcgtctacgccgcttgatctagtcctctctcccggcacgcgagggcgcagcgttgatggcggccgcaccggcggacgctaaggcggaggccgccaatatggacctcctcgaggacgatgacgagttcaaagagtccgagatcgaccaagaatgggatgaaccaggaagaaggcaacggaagccgtcccagccantcggaggaagaattggatgacgatcacgtgaacgatgatttcctcccgcggcctagggaaaacccggaccgaagccacggcataaaacccnaactattattcctccccctcaaaaaataatttcacaccggaggttccttttcgaaacccctaaccacccttggggaagggaaagtttttggaacacccgccggaaatttgacggcacctggccccgttattctcccccctaaaaattttcccctccgcgaaacccgacaaaccg

SEQ ID NO: 58579 - protein, 52 aa, Zea mays
  misc_feature: Ceres CLONE 1512231
  misc_feature (47)..(47): Xaa is any aa, unknown, or other
MAAAPADAKAEAANMDLLEDDDEFKESEIDQEWDEPGRRQRKPSQPXGGRIG

SEQ ID NO: 58580 - DNA, 612 bp, Zea mays
  misc_feature: Ceres CLONE 1512232
  misc_feature: Encodes the peptide sequence at SEQ ID NO. 58581
  misc_feature (431)..(431): n is a, c, t, g, unknown, or other
tatctggagctccccgcggtggcggccgctctagaactagtggatcccccgggctgcaggaattcgtctcacccctagaaaaaaagcaaataagacgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacgcctgcggctgcggtagcagctgcaagtgcgacccctgcaactgctgatcacatcgatcgacgaccatggatatgattattatctatctagcttngtggtggtggttgaacaataataagcgtagccgagctggctgcatacataagtatttgtgtggtgtgtgagaaaagagagagaaacagaagttcttcagtttgctatctctcctctctgcatgtttgggcgccagtctttgtgctccatgtacgtgtgtctacatggatggtttgtttgat

SEQ ID NO: 58581 - protein, 76 aa, Zea mays; identical to SEQ ID NO: 42649
  misc_feature: Ceres CLONE 1512232
  misc_feature (1)..(76): Pfam Name: Metallothio_2 Pfam Description: Metallothionein

SEQ ID NO: 58582 - DNA, 628 bp, Zea mays
  misc_feature: Ceres CLONE 1512243
atagctggagctccccgcggtggcggccgctctagaactagtggatcccccgggctgcaggaattcgtctcacccctagaaaaaaattttgccgtgtcaattgtacccgtgtttctgttgattcgtctcgttttctcccttcccctgcgggctggagagcggcggcgaacgagacaaggtcaccggtgacgctcctcacctactccctaccgcctttcgctttccggcccggcctgccgcaagctcgcgcgccgcctacatcgacccctccccgcgccgcaggccgcctcccacagacgcggggcagccacgtcgcccggctcggagggattcggttcggcccgtcgtgctcccctccgcactcttctattggcctggagagcagcggagatccaccagcaatttggattgcttctcctttttcttggatatacttggtctcctcggtgttggctaggcaatccagctttccaaagtgtgatcggacaggtttattttggttctgagatggctgaatgagactcatccgacttcaccttctgcaggggtgatcagagaaatggcactagtgcgtagtggtcctaaggcacgatagtaatgaaaaaaaaaaaaaaaacgagacgctcga

SEQ ID NO: 58583 - DNA, 656 bp, Zea mays
  misc_feature: Ceres CLONE 1512249
  misc_feature: Encodes the peptide sequence at SEQ ID NO. 58584
  misc_feature (600)..(600): n is a, c, t, g, unknown, or other
aaagctggagctccccgcggtggcggccgctctagaactagtggatcccccgggctgcaggaattcgtctcacccctagaaaaagcttctcttcgacagaaaactagggttttgctcttggaatctctctccccgctgccgccgccgccggacagtgcaccgacgatacgacctcctccttcctccgatctggcctttttaatccgcggatcccgtacaagatgcttcccctctcgctcctcaagaccgcccaggggcacccaatgctcgtggagctgaagaatggtgagacgtacaacgggcatctggtcaattgcgacacgtggatgaacatccaccttagggaggttatttgcacctcaaaggatggtgacaagttttggaggatgccagagtgttacattcgtggggacaccattaagtatcttccagttcctgatgaggtgattgacaaggttcaggaagaaacttccaaaagccggtcagataggaaagccaccaggtgttggccgcggaaagaggaaggggggacctttggtgcttaacctgggaggcaaaggcctccggaagtgggccaaaaattattggaggtagaaggcngtgggtggcccaaagaaaaggggttgggaattggtcgcccaaaagggggtaaccaa

SEQ ID NO: 58584 - protein, 107 aa, Zea mays
  misc_feature: Ceres CLONE 1512249
  misc_feature (5)..(71): Pfam Name: LSM Pfam Description: LSM domain
MLPLSLLKTAQGHPMLVELKNGETYNGHLVNCDTWMNIHLREVICTSKDGDKFWRMPECYIRGDTIKYLPVPDEVIDKVQEETSKSRSDRKATRCWPRKEEGGTFGA

SEQ ID NO: 58585 - DNA, 703 bp, Zea mays
  misc_feature: Ceres CLONE 1512359
  misc_feature: Encodes the peptide sequence at SEQ ID NO. 58586
  misc_feature (405)..(405): n is a, c, t, g, unknown, or other
aaagctggagctccccgcggtggcggccgctctagaactagtggatcccccgggctgcaggaattcgtctcacccctagaaaaaccggcccagatagatctttcccccgtcctccctcgccttcgccttcgccggcaggagatttccaccaccaccgccgaaccgccccgaccctcctcccctctcgcgctatggcccagactgttgtgctcaaggttggcatgtcctgtgagggctgtgttggagctgtcaagcgggtcctcggcaagatggaaggcgtcgagtcctacgacgtagacatcatggaacagaaggtcaccgtgaagggcaatgtgacacctgacgccgtcctgcaaactgtttccaagactggcaagaagacttcgttctgggaggctgaggccntgacaacccaatccgccacacctgccggtgccaccgcctgacaggttcgatgatctggaaagtgccccggcaggcggcaaagaaaaaaaatgtggaatgtatttagcttggaatctgttacaaataattgcaaactgctagctcggtctgtacattttacagtgcctatccgtgtcctgggatgttctcgtaagtttgggggagagataaaccaatatttggtttgaaacaaaaaccccctaaagaacagaaaaccagaccctccaggtccccaattcccccctaaagggggccgatg

SEQ ID NO: 58586 - protein, 84 aa, Zea mays
  misc_feature: Ceres CLONE 1512359
  misc_feature (5)..(66): Pfam Name: HMA Pfam Description: Heavy-metal-associated domain
  misc_feature: SWISSPROT Homolog: EC 3.6.3.4 Copper-exporting ATPase
  misc_feature (72)..(72): Xaa is any aa, unknown, or other
MAQTVVLKVGMSCEGCVGAVKRVLGKMEGVESYDVDIMEQKVTVKGNVTPDAVLQTVSKTGKKTSFWEAEAXTTQSATPAGATA

SEQ ID NO: 58587 - DNA, 649 bp, Zea mays
  misc_feature: Ceres CLONE 1512360
  misc_feature: Encodes the peptide sequence at SEQ ID NO. 58588
  misc_feature (493)..(493): n is a, c, t, g, unknown, or other
tccccgcggtggcggccgctctagaactagtggatcccccgggctgcaggaattcgtctcacccctagaaaaaccgccgcccgcactaccacgcccccgctcctctcgtctctatcttcgcctcttccatcgcaggattcagcggccatgggcggcggcaacgcccagaagtccaagatggcgcgcgagaggaacgccgagaagaacaagggcggcaaaggcagccagctggaggccgacaagaaggccatgaacatccagtgcaagatctgcatgcagaccttcatctgcaccacctccgaggccaagtgcaaagaacatgcggaggcgaggcatcccaagaacgacctctaccagtgcttcccccacctcaagaactagtaagcaggcgaaagcatatgctctgctcagctaaaagacagtactacttaatatttatatacgctgtgtgtcaataaaggggttctaggctgctgctgatgccgctgcttcnttcgtgttgcccccgtctgataatggactggaaacccttgggttggcccccgggtggggctaaaaaacccttggggtccgggggggggataaaaaaaaaaaaaaaaaaaaaaaaaaaagcggggggccctcccagggggccccccattttcccccc

SEQ ID NO: 58588 - protein, 77 aa, Zea mays
  misc_feature: Ceres CLONE 1512360
  misc_feature (4)..(73): Pfam Name: DUF1909 Pfam Description: Domain of unknown function (DUF1909)
MGGGNAQKSKMARERNAEKNKGGKGSQLEADKKAMNIQCKICMQTFICTTSEAKCKEHAEARHPKNDLYQCFPHLKN

SEQ ID NO: 58589 - DNA, 725 bp, Zea mays
  misc_feature: Ceres CLONE 1512364
  misc_feature: Encodes the peptide sequence at SEQ ID NO. 58590
  misc_feature (483)..(483): n is a, c, t, g, unknown, or other
  misc_feature (484)..(484): n is a, c, t, g, unknown, or other
ctggagctccccgcggtggcggccgctctagaactagtggatcccccgggctgcaggaattcgtctcacccctagaaaaatcctgcttgcacgcaagccactccgaggccaagtctagggtttgggaatctgtaggaggggagaggggagcgcgctcagggtcagggaggcgaagatgatcgaggtggtgctgaacgaccgcctggggaagaaggtgcgggtgaagtgcaacgaggacgacaccatcggcgacctcaagaagctggtggcggcgcagacggggacgcgccccgagaagatccgcatccagaagtggtacaacatctacaaggaccacatcacgctcaaggactacgagatccacgacgggatggggctcgagctctactacaactaggcgccctgaccccaaccgtgcccctgatgtaggttaatccgaattctgaagtcatgggtgcgcttccagtcgcagcgtctttagcnntacagctcgcatacatatagggcacttgagtgagctatgtagtacggatattggttgtgtgggcaactgccaatgactattgacatccttgcatatattgacatgtgacaaggatcaccctgcaaaactggtgccctgctactcgcaaacttattactttaaatacacaggtgtgtgtttttcaattatgtgaaactttggcacggtctcagcgtccccttcgtgctccaattctgatctt

SEQ ID NO: 58590 - protein, 73 aa, Zea mays; identical to SEQ ID NO: 39404
  misc_feature: Ceres CLONE 1512364

SEQ ID NO: 58591 - DNA, 710 bp, Zea mays
  misc_feature: Ceres CLONE 1512365
  misc_feature: Translation starting site: 177
  misc_feature (150)..(150): n is a, c, t, g, unknown, or other
  misc_feature (173)..(173): n is a, c, t, g, unknown, or other
  misc_feature (203)..(203): n is a, c, t, g, unknown, or other
  misc_feature (386)..(386): n is a, c, t, g, unknown, or other
  misc_feature (406)..(406): n is a, c, t, g, unknown, or other
  misc_feature (407)..(407): n is a, c, t, g, unknown, or other
  misc_feature (435)..(435): n is a, c, t, g, unknown, or other
  misc_feature (486)..(486): n is a, c, t, g, unknown, or other
  misc_feature (497)..(497): n is a, c, t, g, unknown, or other
  misc_feature (520)..(520): n is a, c, t, g, unknown, or other
tggagctccccgcggtggcggccgctctagaactagtggatcccccgggctgcaggaattcgtctcacccctagaaaaaatgccttccaccttcgggtccgggttcaccccttccatgtccttcgtatcaacaagatgctttcgtgtgcntggggctgataggctccagactnggaatgaggggtgcctttggcaagcctcanggcacctgtgctagggtggacattggtcaggtcctcctttctgttcgatgcaaggacaacaatgctgcacatgccagtgaagctctgcgtcgcgccaagttcaagttccctggccgccaaaagattattgagagcagaaagtggggcttcaccaagttcagccgtgccgactacctgaagtancagagtgagggtagaattgnnttcctgatgtgtcaacgcaaagctgctncgtaaccatggaagacttgagaagcgtgctccctggaaggctttcctcgangccgttgcttnagtccatctacagttggaatgcnaatccagacgttttggtttaaccctatctttattttgcttttgtgcacatggaattttaggtgtatgggggtattaacagtgctttggggggaccctgcttaacctcggggctgaacatcgttattgcatgaaagtaccttacctttttgttccgcaaaaaatttaaaagtttctggcaactaaaataat

SEQ ID NO: 58592 - DNA, 677 bp, Zea mays
  misc_feature: Ceres CLONE 1512368
  misc_feature: Encodes the peptide sequence at SEQ ID NO. 58593
ctccccgcggtggcggccgctctagaactagtggatcccccgggctgcaggaattcgtctcacccctagagagtctccacgcagcgcgctcctcgatccccaacaggcaacagcccagccgctgtcgccctcgttccgtagtacggcgccgccagatcgtcagtcaccatgatcatctccaagaagaaccgccgcgagatctgcaaatacctcttccatgagggggtcttgtacgccaagaaggactacaacctggccaagcaccccaagcttgatgtgcccaacttggaggtgattaagctcatgcagagcttcaagtcgaaggagtatgtgagggaaaccttctcatggcagtactactactggtacctcaccaacgatggcattgagcacctccgcagcttcctcaacctgccatcagagggtgtgcctaataccctcaagaagtcttccaagcccccgtctcgcccctttcgggtctggcccacctgggggaccgcccccgggggccctcctccgttatgaaggtgacagggctaggtttgggggatagggaatggttacaaaaagagggccacgaggggcgctcccggggaactttgggggggaaaaaggggggggggctccggcggaatttcccaacacatttttaaaggggaaaccaaaaccgggctttg

SEQ ID NO: 58593 - protein, 118 aa, Zea mays
  misc_feature: Ceres CLONE 1512368
  misc_feature (3)..(98): Pfam Name: S10_plectin Pfam Description: Plectin/S10 domain
MIISKKNRREICKYLFHEGVLYAKKDYNLAKHPKLDVPNLEVIKLMQSFKSKEYVRETFSWQYYYWYLTNDGIEHLRSFLNLPSEGVPNTLKKSSKPPSRPFRVWPTWGTAPGGPPPL

SEQ ID NO: 58594 - DNA, 711 bp, Zea mays
  misc_feature: Ceres CLONE 1512369
  misc_feature: Encodes the peptide sequence at SEQ ID NO. 58595
  misc_feature (711)..(711): n is a, c, t, g, unknown, or other
aaaagctggagctcaccgcggtggcggccgctctagactagtgaatcccccgggctgcaggaattcgtctcacccctaaggaggggccacttacctgcagtcaccactcccaagccagtacccacagtcctacgagcagtcgcacgcaagtgtcaagagacaaaacggtcgacatggctcgcacgcaatctgccgtagcggtcgccgtggtggccgcggtgctgctgctggcagcggcggcgacgacctcggaggccgccatcacctgcgggcaggtgagctccgccatcgcgccctgcctctcctacgcccgcggcacggggtccggcccctccgcgtcctgctgtagcggcgtcaggaacctcaagagcgccgccagcaccgccgccgacaggcgcgccgcctgcaactgcctcaagaacgccgccaggggcgtcagcggcctcaacgccggcaacgccgccagcatcccctccaagtggggggtcagcatccccctaaacatcagcaccttccaccgactgctccaggggtgaactaaaaccctagaccacgcgccgacaacggcccccctgaccgattcaaaccaaccatttccccccgtcgccgcccgggccggaataaatccattccgccggcctgaggaaaatcctatccaatcctacgcggtgatagatctcagtggccacctttgccaccctgcgcacagan

SEQ ID NO: 58595 - protein, 120 aa, Zea mays
  misc_feature: Ceres CLONE 1512369
  misc_feature (32)..(113): Pfam Name: Tryp_alpha_amyl Pfam Description: Protease inhibitor/seed storage/LTP family
MARTQSAVAVAVVAAVLLLAAAATTSEAAITCGQVSSAIAPCLSYARGTGSGPSASCCSGVRNLKSAASTAADRRAACNCLKNAARGVSGLNAGNAASIPSKWGVSIPLNISTFHRLLQG

SEQ ID NO: 58596 - DNA, 696 bp, Zea mays
  misc_feature: Ceres CLONE 1512374
  misc_feature: Translation starting site: 161
  misc_feature: Pfam Name: Ribosomal_L31 Pfam Description: Ribosomal protein L31
  misc_feature (301)..(301): n is a, c, t, g, unknown, or other
  misc_feature (337)..(337): n is a, c, t, g, unknown, or other
  misc_feature (373)..(373): n is a, c, t, g, unknown, or other
  misc_feature (453)..(453): n is a, c, t, g, unknown, or other
  misc_feature (472)..(472): n is a, c, t, g, unknown, or other
  misc_feature (661)..(661): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
ctggagctccccgcggtggcggccgctctagaactagtggatcccccgggctgcaggaattcgtctcacccctagaaaaaattagcaaggcgatagataagaggaaggaaagaacataggcagccgaagcgactgtcgcgaggcaaggccatcgtccgccatgacgctctccctctccacctctttcctccccatccccgccgccgcgaggaccaccgcccgcaccctacgctccgtcgtcccctcccaggggatgcgctgctcgatgcgcaagaaggggttgcacccggagatctacganggacgcgaaggtgtactgcaacggcgagctggtgcntggtgacggggggcaccaagccggagtacaccggtngggacgtgttggtcccggaaaccacccccctactacggtcggcgacacctttcgggcgctcgtgggtcatgaacagcccnatttccagagttcccgcangaagtggggcaccatccaaggaatactggcccccaggaccaatgggagggagatggcacccgaacgggggacccggaatttcgagtctaagggggaccactgattgaatgggtccccgtcttttcttaaccccggggggtgggtcccccggtccagttttacttttgcccccccccttgaggggaaatnannnntttaaaatcccttttccggttccccaaatt

SEQ ID NO: 58597 - DNA, 711 bp, Zea mays
  misc_feature: Ceres CLONE 1512375
  misc_feature (248)..(248): n is a, c, t, g, unknown, or other
  misc_feature (328)..(328): n is a, c, t, g, unknown, or other
  misc_feature (379)..(379): n is a, c, t, g, unknown, or other
  misc_feature (384)..(384): n is a, c, t, g, unknown, or other
  misc_feature (388)..(388): n is a, c, t, g, unknown, or other
  misc_feature (429)..(429): n is a, c, t, g, unknown, or other
  misc_feature (505)..(505): n is a, c, t, g, unknown, or other
tccccgcggtggcggccgctctagaactagtggatttcttgggctgcaggaattcgtctcacccttagaaagatctcacggctagctagcacaagcatagtgcaggggcttgccacctaagtaaggcccgcctgagagccatggcatccaaggccgtcctcttcttggctctcaacctcctgttcttcacggtggccaacgcctgcggcaactgcccgacccccacgcccccggttgagccaccgccnccgtcctcctgctgctaccccaccccccccgacgaggggcaagtgcccgttgaaccccttctatttcgcgcgggcccccnatgtgctaggctttttttttccccccccgcggggaaagctagggggccctnctttncccnccccccccccctttttgtgattataagccacacgtcctccntgtccgccgcgcccgccgccctaaccctcccttttttcccccccctattttcccccctcctcccccgttcgtttcnctccctgcctttccctttagccccccccccccctggtacctgcccttacccttctttccccctccactccccttttacatctcttccccctctcatttcgacagcttgtatggccgccccttcctccgattcgcccgtgtctcctccacatcaccccgcctttagaggcgtggcctcttcctcgcgattgtccccctgtcctcccg

SEQ ID NO: 58598 - DNA, 707 bp, Zea mays
  misc_feature: Ceres CLONE 1512378
  misc_feature: Encodes the peptide sequence at SEQ ID NO. 58599
  misc_feature (392)..(392): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (680)..(680): n is a, c, t, g, unknown, or other
aaagctggagctccccgcggtggcggccgctctagaactagtggatcccccgggctgcaggaattcgtctcacccctagaaaaaacctcaacacagcaccaccaaccaagcaacctcactcgctacaaacaagaaacaacaagcgaaagttttctctcgagagaggaggagaagaccaacaccgggaggagatggcagcagcagcagcgacgaaggcgtcgtcgtggatggtggccatgagcgtgggcgccgtggaagcgctcaaggaccagggaggcctctgccgctggaactacgcgctgcggtccgtctaccggaccgccaaggccaacgtgcgcagcggcagcagaagcttcgccgcgcagcgggacaaggacctggccccggcggcngaaaaggggcggcaagacaaggccgccgcggaggagggcttgaggaccgtcatgtacctcagctgctggggacccaattaactagcctttccgatcttaagctggcctttggcctccttcagcgacccccagctcgcgagctgattattggaaatataccacaatgatccgaagatgaaggatgacaaaaagctctggcccccttcccgtaaacnnnnacccaaagcggcatcccgcgcaggtggaaagtcccaactacgagagtgcccactgagaaacaaatcctgntggagagagggggcgtacttccctgag

SEQ ID NO: 58599 - protein, 93 aa, Zea mays
  misc_feature: Ceres CLONE 1512378
MAAAAATKASSWMVAMSVGAVEALKDQGGLCRWNYALRSVYRTAKANVRSGSRSFAAQRDKDLAPAAEKGRQDKAAAEEGLRTVMYLSCWGPN

SEQ ID NO: 58600 - DNA, 706 bp, Zea mays
  misc_feature: Ceres CLONE 1512380
  misc_feature: Encodes the peptide sequence at SEQ ID NO. 58601
atagctggagctcaccgcggtggcggccgctctagactagtggatcccccgggctgcaggaattcgtctcacccctagaaaaaaaaccctagccgcctgtcttgctgaagctgaactgctgatccgtcttccaagctgtggtgtcatcccctgagttctgatccaagatgtatctccagtattacatcaatgagaagggggacaaggtctacaccaccaagaaggagtcacctcttggggtgccgacgcagtctgctcacccagctcgcttctcaccagatgacaagtactctcgccagcggtacctgttgaagaagagatttggacttctgccaacgcagaagccagcactgaagtactgaagcttcaactttccaaccatggatgtgcaatttgtgtcaatgcttgaccccccccccccccgaatgtagaataggtatctgaggaaacatatcaaacactgctaggcactactatgaaatttcaccgcattccggcactatatgtaatgctatttggtttgacaagtcttggttcttattaatgaacttgggggtgtgggcccaaagcatcggttttgggcgttcctccaaaaaaaaaaaaaaagaacaaaaacgttcgaaggaccccaatttccccccacagtggaatccctaattaccccctcccccactgggcctgtcttttttaaaaacgatccgggaat

SEQ ID NO: 58601 - protein, 64 aa, Zea mays; identical to SEQ ID NO: 18459
  misc_feature: Ceres CLONE 1512380
  misc_feature (3)..(53): Pfam Name: Nop10p Pfam Description: Nucleolar RNA-binding protein, Nop10p family

SEQ ID NO: 58602 - DNA, 708 bp, Zea mays
  misc_feature: Ceres CLONE 1512381
  misc_feature: Encodes the peptide sequence at SEQ ID NO. 58603
  misc_feature (302)..(302): n is a, c, t, g, unknown, or other
  misc_feature (391)..(391): n is a, c, t, g, unknown, or other
  misc_feature (529)..(529): n is a, c, t, g, unknown, or other
ccccgcggtggcggccgctctagaactagtggatcccccgggctgcaggaattcgtctcacccctagaaaaaacgggaggattccatggccaacaacaccgggacgttggtgggcggcatcgacgacgtgccggggagcgagaacgaccttcacctcgaggagctggcccgcttcgccgtcaatgagcacaacaagatcgccaatgctcttctggggttcgagaagcttgtgaaggccaagacacaagtggttgctggcacaatgtactatctcactattgaagtgaaggatggcgaagtcnagacgctctacgaccctaacgtatgtgataatcatgcgagaactacactgacctgcaggaattcggacgtgttgaacagggtgctagcngataatgatgtctgcttcatcatgtgcgagactgacactcacatgcaagtgcagaacaaggagcaatgctcctttgtgcatttcataacactatcaccttgatagagcttgttcggtgggtcagtatcaaagggaatngcaggggatcaatgttccatctattcaaaaaaagggcttttaacggctgccatgctcttcatgccacctgaccaagaaagccctaaattgacatcctacttaacggagcgggtgaattccgggaaaaattttggctttctggttcccggaaaaacctttaaagcggacccccccggggc

SEQ ID NO: 58603 - protein, 135 aa, Zea mays
  misc_feature: Ceres CLONE 1512381
  misc_feature (10)..(99): Pfam Name: Cystatin Pfam Description: Cystatin domain
  misc_feature (73)..(73): Xaa is any aa, unknown, or other
MANNTGTLVGGIDDVPGSENDLHLEELARFAVNEHNKIANALLGFEKLVKAKTQVVAGTMYYLTIEVKDGEVXTLYDPNVCDNHARTTLTCRNSDVLNRVLADNDVCFIMCETDTHMQVQNKEQCSFVHFITLSP

SEQ ID NO: 58604 - DNA, 712 bp, Zea mays
  misc_feature: Ceres CLONE 1512382
  misc_feature: Encodes the peptide sequence at SEQ ID NO. 58605
  misc_feature (475)..(475): n is a, c, t, g, unknown, or other
  misc_feature (678)..(678): n is a, c, t, g, unknown, or other
  misc_feature (680)..(680): n is a, c, t, g, unknown, or other
  misc_feature (694)..(694): n is a, c, t, g, unknown, or other
  misc_feature (696)..(696): n is a, c, t, g, unknown, or other
  misc_feature (702)..(702): n is a, c, t, g, unknown, or other
  misc_feature (703)..(703): n is a, c, t, g, unknown, or other
ccccgcggtggcggccgctctagaactagtggatcccccgggctgcaggaattcgtctcacccctagaaaaaactggttgctagtgctaccaagaacaggaaggaaacaccgccgccgccgcgccttccattccagtactcgcggaggaaaggaacaccagccagcgccatggtcacgtcgacgaccgccgccgccgtgctgtccccgccgtccgtggccgggcttcgcctggcgccgtctccccgggcgcgcgtggcgttccgcgcggcgccggcgcggcggtccgtggcggcgcgcgcggagctgagcccgtcgctggtgatcagcctgagcacgggcgtgtcgctcttcctgggccgcttcgtcttcttcaacttccagcgggagaacgtggcgaagcaggtgcccgagcagaacggcaagacgcacttcgacgccggcgacgagcgcgccaaggagttctcgggcctgctncagtccaacgaccccgtgggctttcacctcgtcgacgtcctcgcctggggctcgctcggccacatcgtcgcctactacatcctcgccacctccagcacggatacgacccccacttcttctgagcggccggctgcgggcatgttcttgagcctgctgtattctactcgtgtgtggtgagcatatatctgatgctcagggatggntnatttgaaaaaaaantnaataannaaaaaaaaa

SEQ ID NO: 58605 - protein, 160 aa, Zea mays
  misc_feature: Ceres CLONE 1512382
  misc_feature (45)..(139): Pfam Name: PSI_PSAK Pfam Description: Photosystem I psaG / psaK
MVTSTTAAAVLSPPSVAGLRLAPSPRARVAFRAAPARRSVAARAELSPSLVISLSTGVSLFLGRFVFFNFQRENVAKQVPEQNGKTHFDAGDERAKEFSGLLQSNDPVGFHLVDVLAWGSLGHIVAYYILATSSTDTTPTSSERPAAGMFLSLLYSTRVW

SEQ ID NO: 58606 - DNA, 750 bp, Zea mays
  misc_feature: Ceres CLONE 1512383
  misc_feature: Encodes the peptide sequence at SEQ ID NO. 58607
  misc_feature (264)..(264): n is a, c, t, g, unknown, or other
caaagctggagctccccgcggtggcggccgctctagaactagtggatcccccgggctgcaggaattcgtctcacccctagaaaaaagccacggagagcaaaggcagcacactcagctatccagcaaaagagatcgagaggcaggagtcatggccaccgtcagcgccgccgtggtgaccaccatcgttgcccgcgccgcgatcgccaggcccaatgctctagggctgcctgcgctgagggcgaggagcgagagggtgcggtgcanctacgccaaggacgcggccccagtcagcaccaagggcgcaggcgcgtcgctgctcgccgcagcgggcgcggtgaccgcgtcggcggggcccgcgctggcgctcgtggacgagcgcatgtccacggaaggcaacagggcttaaacctccggcccccccccacaacctgctgggggaggatcctccctgggggtctttcggccctcattctggccccccctacacccatcttccaccttttaaccttcgacgagggacaaaggagtcccgggtggcctccccccttctaaaaaccccccctccctctcccggttaaatgaatctgcaatgtaaaactatggggggccggcccacccctgttaaaatttaagaccttgggccttatttgccatccaaaaaaaccctcccctctccccggttaaataaaaggtttgggaggacattcgttaccgcccctgaaggccaataacgcaaccttttggccagaa

SEQ ID NO: 58607 - protein, 85 aa, Zea mays
  misc_feature: Ceres CLONE 1512383
  misc_feature (39)..(39): Xaa is any aa, unknown, or other
MATVSAAVVTTIVARAAIARPNALGLPALRARSERVRCXYAKDAAPVSTKGAGASLLAAAGAVTASAGPALALVDERMSTEGNRA

SEQ ID NO: 58608 - DNA, 700 bp, Zea mays
  misc_feature: Ceres CLONE 1512386
  misc_feature: Translation starting site: 190
  misc_feature (387)..(387): n is a, c, t, g, unknown, or other
  misc_feature (395)..(395): n is a, c, t, g, unknown, or other
  misc_feature (399)..(399): n is a, c, t, g, unknown, or other
aaagctggagctccccgcggtggcggccgctctagaactagtggatcccccgggctgcaggaattcgtctcacccctagaaaaaaaaaccctacccgactccgccgccgctccgccgccgctccgcctcagcgcatcgccctccgccacagcgtaccgcgacctcatcgatcaccttcaactttcaatcatggcggacgtcgatgtcgaaccggaggttgccgccggcgctcccaagaagaggacgttccgcaagtacagctaccgcggcgtcgacctagatgcgcttctcgacatgtccacggacgacctcgtccagctcttccccgcgcgcgccaggagaaggttccagaggggtctgaagaggaagcccatggcactcatcaanaaactgcncaangccaaacacacatgctcctgctggtgagaagccagagccggtcaagacacatctccgtaacttgatcattggccctgagaagatggggagcattgtttggggtctacaacggccagacattcgacccggttgagatccagcctgaagatgaccggcccccacccttgcttaagtctcccaccccccaaaaacccgggcaagcaggggcagggcccgggattcagtggcccccccactccccgccgggtttattccaccgggaaaggggggcgggccgccgccctggggtgggatccccagg

SEQ ID NO: 58609 - DNA, 674 bp, Zea mays
  misc_feature: Ceres CLONE 1512392
  misc_feature: Encodes the peptide sequence at SEQ ID NO. 58610
  misc_feature (276)..(276): n is a, c, t, g, unknown, or other
  misc_feature (342)..(342): n is a, c, t, g, unknown, or other
  misc_feature (372)..(372): n is a, c, t, g, unknown, or other
  misc_feature (487)..(487): n is a, c, t, g, unknown, or other
  misc_feature (504)..(504): n is a, c, t, g, unknown, or other
acccgcggtggcggccgctctagaactagtggatcccccgggctgcaggaattcgtctcacccctagaaaaaatccaattccattccaaatccgcagtccgcagacgagagtggaagcggggcacagacagagaagccaatggcgctgtccctctccctcgcgcgccccgcgcccctcgccgtttccgccggcgcaggagccaggaagctacccgcagccagcctcgcattcccggcgaaatccttcttcggcgcgccgctggccgccaccgcggncctccgtcgcgtcgccgctcccgcgcaagccggccacctccaccacctcggctcgaggtccgtcgnccggcgggggagagggctacaaatgagacngcacatgcgcggcgagcgtttttccgggttgacgggagggggcagatttcgtgcggcgtgcgccggggagcagcacttgctcgcccgaagaacaccagcgcaagaagagctcctncgagatgggcagttcancagatgactacgaaatttgttacgggtgcactgcccctacccccagggaataggaaaaagaaactgagaagcttcccggggcttcaaaaaaaaccctttaagtttcccctcccccccacaaatgggggaaaattttttgggggggggaaggaaatttcccccccgtgggt

SEQ ID NO: 58610 - protein, 123 aa, Zea mays
  misc_feature: Ceres CLONE 1512392
  misc_feature (46)..(46): Xaa is any aa, unknown, or other
  misc_feature (68)..(68): Xaa is any aa, unknown, or other
  misc_feature (78)..(78): Xaa is any aa, unknown, or other
  misc_feature (122)..(122): Xaa is any aa, unknown, or other
MALSLSLARPAPLAVSAGAGARKLPAASLAFPAKSFFGAPLAATAXLRRVAAPAQAGHLHHLGSRSVXRRGRGLQMRXHMRGERFSGLTGGGRFRAACAGEQHLLARRTPAQEELLRDGQFXR

SEQ ID NO: 58611 - DNA, 707 bp, Zea mays
  misc_feature: Ceres CLONE 1512393
  misc_feature: Encodes the peptide sequence at SEQ ID NO. 58612
aaagctggagctccccgcggtggcggccgctctagaactagtggatcccccgggctgcaggaattcgtctcacccctagaaaaaaccgccgcgctcttcggcggcaactactgttggatcgtagggcgaaggaaggaaggaagggtagccatgggaaacgcgtcgtccatgctgacccaggacgacatcgaggaggtgcatgagcactgcggctacctcttctcgcagcaggagatcgtgtcgctgtacgagcgcttctgccagttggaccgcagcgccaagggcttcatctccgaggacgagttcctctccatccccgagttctccctcaacccgctctccaagaggttgctccgtatggttgatgggttgaacttcaaggatttcgttgcgtttctttctacattcaccgcatatgccagccttcgtcagaagatcgagtttatattcgaggtttatgacatccatggcaagggaaaaattaccttcaaagatctgctagaggttttacgggacctaacatggtcattcatgtccgaggaacaaagagagcaagtggctactgaagttctggaataagcagggtacacgagggattactcattctcgcttgagattttatccagatcatcgaccatcctggccttaagatggagggtgcagtgtcaatcgactagtgagatgtggaatacaagcttctggtttgt

SEQ ID NO: 58612 - protein, 142 aa, Zea mays
  misc_feature: Ceres CLONE 1512393
  misc_feature (95)..(123): Pfam Name: efhand Pfam Description: EF hand
  misc_feature: SWISSPROT Homolog: EC 1.6.3.1 NAD(P)H oxidase
MGNASSMLTQDDIEEVHEHCGYLFSQQEIVSLYERFCQLDRSAKGFISEDEFLSIPEFSLNPLSKRLLRMVDGLNFKDFVAFLSTFTAYASLRQKIEFIFEVYDIHGKGKITFKDLLEVLRDLTWSFMSEEQREQVATEVLE

SEQ ID NO: 58613 - DNA, 738 bp, Zea mays
  misc_feature: Ceres CLONE 1512394
  misc_feature (354)..(354): n is a, c, t, g, unknown, or other
  misc_feature (399)..(399): n is a, c, t, g, unknown, or other
ggagctccccgcggtggcggccgctctagaactagtggatcccccgggctgcaggaattcgtctcacccctagaaaaacccatcgcacgcactcctcatcttatcccccgcctcctccggacctcccgccgctgttgctcacttctgagtcccgacgcacgagctcccaagagctagccatggcgtccaccaccctctcctccgccttcatgctcctatgccgcccctccacctccccgtgccacgccgcctcatgcccgaggtgctcccacgccgggccgcaaatgagccgggggagccgctccgtcgcgtagggagaacttccatccagtcccccgggatgctggaggtggnggactccccccccgggctcaggctcgaggaagacctgattcctcntacaacaccccccaagagagggtaggggggaacagacggagaattgcagccggacactggctttccccccccccggaagggggggaggggctcccgccaatgggttggccccccaaaaaaaaagagaaaccaaatcgtggtttaaaattgggcctgcgttcacggtggaaaacccctgaaaagaggggccctgcctttttaatttggggttccaagggggaaatggctttttgggggggtttcccccaagaaaaaaaagaaaacccgagagggcggggggcccgattcccccacaaagtggggggaaaggcgcgccccccaggggttcccccggataaa

SEQ ID NO: 58614 - DNA, 633 bp, Zea mays
  misc_feature: Ceres CLONE 1512395
  misc_feature (52)..(52): n is a, c, t, g, unknown, or other
aaagctggagctcaccgcggtggcggccgctctagaactagtgattcttggnctgcaggattcgtctcaccctagggaggccttgccatcacctcctcgcctagcctgccactgccagcaggtgccaccgccatctctgctctgctctcgcaacgcaagcacacgcccggccgcctgccacagttgccatggcgaccatagccacgatggcgctgctgaaagcccgccccaagggcgcggccccgtcccggccccttccaatcccaggcgcaactcctccctcccccgccgggacggggcaaggccgccaaaaaaggttggggggcccgaccccccgttttcccagatgggggggggccctttttttcgcggggcaggggccccgaacccaaaactaattcatgcgggaaaccccccccccccgtgtgggaaaaccccccctaaaacaacccgtcctataccctccaaagagaagagagagggggccccgcgcccccgagggcggggcttccccaacaaaacccccatattcggggggggaggggatcccccgatctaaaacatctccaaccacctgccttgagtggagggcgctcccctatgagacttcccccagatcacccccccccgaac

SEQ ID NO: 58615 - DNA, 694 bp, Zea mays
  misc_feature: Ceres CLONE 1512397
  misc_feature: Translation starting site: 138
  misc_feature: SWISSPROT Homolog: EC 4.1.1.39 Ribulose-bisphosphate carboxylase
ggagctccccgcggtggcggccgctctagaactagtggatcccccgggctgcaggaattcgtctcacccctagaaaagagacgacccaagcaagcaagcaagcagcgagtacatacatactaggcagccaggcagccatggcgcccaccgtgatgatggcctcgtcggccaccgccgtcgctccgttccaggggctcaagtccaccgccagcctccccgtcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaaggtcggcttcgtgtaccgcgagaactccacctccccgtgctactacgacggccgttactggaccatgtggaagctgcccatgttcggctgcaaccactccacccaggtgtaccaagagcttcaggaaggcattcaatcctaacccggacgcctttccaccgcgtcttcggcctctcacaacattcaagcagaacccagtggcgtcagctttcatcccccttacaagccccccgggaagcgaactaaaccggggcccggccggtcgccctcccccccggg

SEQ ID NO: 58616 - DNA, 689 bp, Zea mays
  misc_feature: Ceres CLONE 1512401
  misc_feature: Encodes the peptide sequence at SEQ ID NO. 58617
  misc_feature (346)..(346): n is a, c, t, g, unknown, or other
  misc_feature (401)..(401): n is a, c, t, g, unknown, or other
  misc_feature (493)..(493): n is a, c, t, g, unknown, or other
  misc_feature (575)..(575): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (616)..(616): n is a, c, t, g, unknown, or other
  misc_feature (617)..(617): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (656)..(656): n is a, c, t, g, unknown, or other
  misc_feature (657)..(657): n is a, c, t, g, unknown, or other
aagctggagctccccgcggtggcggccgctctagaactagtggatcccccgggctgcaggaattcgtctcacccctagaaaaacttgctcgctgcgccgccgcctccgacatcgtcccttcgtccccacgagcaaccgataatccgccggcgttgagatgttggtttatcaggatctcctatctggcgacgagctcctgtcggattcattcacctacaaggagctcgagaacggcgtcctgtgggaggtcgagggatagtgggtcacccaaggtcctgttgatgtggacattggtgccaatccatccgccgaggggtgggtgaggacaaaaagcctttgattgacncagcttggtgaaagggggggttgaaaaatttgggttaaaacccctttttccgggnttggggggggaggaagcccccttttttaaaaaaaaaaccccccttggggttttttgattttaaaaaaaaaatattttcaaaaaatttctccntggtgtgggggggtgggagaaccccccccccaaaaaagggggggggaggaggttctcctttctcccgggggggggggggggnagnnnannnnnaggagccannnnnaaaagaaccctccttannggnnnagagggtaatgtttcatactcccctcccccaacnnagaagagggagaagaagagttcgttatggggc

SEQ ID NO: 58617 - protein, 33 aa, Zea mays
  misc_feature: Ceres CLONE 1512401
MLVYQDLLSGDELLSDSFTYKELENGVLWEVEG

SEQ ID NO: 58618 - DNA, 708 bp, Zea mays
  misc_feature: Ceres CLONE 1512404
  misc_feature: Translation starting site: 157
  misc_feature (636)..(636): n is a, c, t, g, unknown, or other
ccccgcggtggcggccgctctagaactagtggatcccccgggctgcaggaattcgtctcacccctagaaaaaatccactctctcttcctgattcgttccaactcctgagcactttctcctcgtctccgactagtcaatcatatcctacataccgtcatggactccaccggctccggagcggggggtaaggggaagaatgcagcgcccggtcccaaggtccgcatgcccaagattaactctgtgtttacgtgcctgttcggcggcctccagttccccgtcggccgcctcaattcgcttcttgaatatgagccgctacacgctacttgtgtcagtccctgcgcccccgtctacctcgcctgctgtcgtccatatacctcgcctactgatgttctggagctcacgtgttgatgctgcctgagactaccagaacagtcgcattattccacgacacgtgcttctggccttccccaacgacgagaagcttgtgaatctgctgggcgtcgtgagcatcgctctcggcgatgggctccccaatatcacccctgttctgctgcccaacatactgctgacaggtctccagtgtgcggctcatcgtagcctgtcgcactacaagccgccgtgctctcataatgctanactgatgtctggaatgtctgatctatactagacttagcaccatgtgtgtgatgctatctgtaatggtcgaaa

SEQ ID NO: 58619 - DNA, 718 bp, Zea mays
  misc_feature: Ceres CLONE 1512405
  misc_feature: Encodes the peptide sequence at SEQ ID NO. 58620
  misc_feature (439)..(439): n is a, c, t, g, unknown, or other
  misc_feature (510)..(510): n is a, c, t, g, unknown, or other
aaagctggagctccccgcggtggcggccgctctagaactagtggatcccccgggctgcaggaattcgtctcacccctagaaaaagcctaataaaattccccattccaatacacagatctcgcacccgtaagtggcgacgaatctcgcggtgcggaggcgcgacagaggcggtgtcgactccgacggactcgcagccaccggtggagacgccccaccggcgcactcctccaacgttcatagtttaagggcttgatttggataattagtcatcaacagaagtgataaaaaatggtggttcttgcagcatcaatcgtttcaaagtcgggaaaagcacttgtttcaagacagtttgttgacatgtctcgcataaaaattgaaggattacttgctgcgttcccgaaactggttggaactggggagcagcacacttatgtcgaanctgaaaatgtgcgatatgttttatcaccctagtgagggttatatcttctacttatcacaaacaagcagagncatattcttgaagatctgggacactttgaggcttctctccaggctcggggcctggaatcctcccccttcattgggagggggggggggggttttttttttaaaaaaaaccccctttttgggagaaaaatattattttttttttttttttttaaaaaaagaaaaaacctttctttttttttttggggagaaaaaaaaaaattatttccta

SEQ ID NO: 58620 - protein, 60 aa, Zea mays
  misc_feature: Ceres CLONE 1512405
  misc_feature (51)..(51): Xaa is any aa, unknown, or other
MVVLAASIVSKSGKALVSRQFVDMSRIKIEGLLAAFPKLVGTGEQHTYVEXENVRYVLSP

SEQ ID NO: 58621 - DNA, 837 bp, Zea mays
  misc_feature: Ceres CLONE 1512406
  misc_feature: Encodes the peptide sequence at SEQ ID NO. 58622
  misc_feature (336)..(336): n is a, c, t, g, unknown, or other
  misc_feature (637)..(637): n is a, c, t, g, unknown, or other
aaagctggagctccccgcggtggcggccgctctagaactagtggatcccccgggctgcaggaattcgtctcacccctagaaaaacgagcagccagcccgggtctgcctcgctccagatctcccttcgcagccggccagggaccccttcacagcccgatagatggctgatcaggaggccccagttgcagttgaggctccagccccagttcttggagagccaatggacttgatgactgctctgccgctggtgaacagagaatcaagtgctcatgatgggacttgtgaaggggcttaccgaggctgccgagggcattgaaaaacaggaagatcaagctnaccttcttgccgaagacccgggaccactcccacccaatccgagggtgggtgaaactctgtttgggtggtttaaaccccccccccggtggttgtgggcgggttccccgggggcaaagaaaccccggggccatgccgcccggggtctcttcgagaattacctccgaggggctcctgtgggggcgagggttgcttaaggcttcctcccgcaggttagttgttctaaggccccccccggggaataccatttgatacgcccctttgaaggtccagcggagcggcttaggcggcagtctccatctanttcgtgtgaaacgtggtgtagcgacgagaacccagccagtctagtggaaccccggggctatataacgatgccccccgggccgtccttgttggcttcccgtgcggctatttatggagcaatttttcgcccgcgtgggcccccagtgagaggtccgcctcgcccgtcttttgggagaactccaaaaagcggctctcgcgtgg

SEQ ID NO: 58622 - protein, 51 aa, Zea mays
  misc_feature: Ceres CLONE 1512406
MADQEAPVAVEAPAPVLGEPMDLMTALPLVNRESSAHDGTCEGAYRGCRGH

SEQ ID NO: 58623 - DNA, 695 bp, Zea mays
  misc_feature: Ceres CLONE 1512407
  misc_feature: Encodes the peptide sequence at SEQ ID NO. 58624
aagctggagctcaccgcggtggcggccgctctagactagtggattctcgggctgcaggattcgtctccccctagaaaaaagtcccagctcgtccgctgagatggacagtagcagcctcaaatccgcgcagctcctggagctgatgcgccagcacctggccaccgatgccggcaaggaggtcaccaagaaggtcggcctcgtctaccagctcaacatcgcccccaagaagatcggcgttgatgaggagatcttcgtggtcgacctcaagaagggcgaggtcaccaaagggccgtaccagggaaagccggatgccactttctccttcacggacaacgatttccttggaatcgccaccggcaagaccaatccgcagattgcattcatccgaggggcgatgaacacccacgggagcatcagtgcggcgcagaagtttacccctgacatcttccccaagcctgccaaggtgtaaaaggttagattgcattacttggtcgaggtgaataataaatgtttgcaagcttccattactatgtacgagatacaatgagtgacacatgaaaagcacgttcctcggggggacatccggatatggttgaacttcccctttaaatcaagccctattggtcgtttctccgcgattaaaagcgcggcaaaaggcaaactaatgtaactaggtccaggcacactaaatcccg

SEQ ID NO: 58624 - protein, 122 aa, Zea mays
  misc_feature: Ceres CLONE 1512407
  misc_feature (12)..(117): Pfam Name: SCP2 Pfam Description: SCP-2 sterol transfer family
  misc_feature: SWISSPROT Homolog: EC 2.3.1.176 Propanoyl-CoA C-acyltransferase
MDSSSLKSAQLLELMRQHLATDAGKEVTKKVGLVYQLNIAPKKIGVDEEIFVVDLKKGEVTKGPYQGKPDATFSFTDNDFLGIATGKTNPQIAFIRGAMNTHGSISAAQKFTPDIFPKPAKV

SEQ ID NO: 58625 - DNA, 673 bp, Zea mays
  misc_feature: Ceres CLONE 1512411
  misc_feature: Encodes the peptide sequence at SEQ ID NO. 58626
aaagctggagctccccgcggtggcggccgctctagaactagtggatcccccgggctgcaggaattcgtctcacccctagaaaaacttcctcatccagtgttctgtcctagcgccgccgccgccccagctcgccttgcgtgactgagagctcgtcggcttccgtccacgcgtgaagcgagagcatggacacccaggtgaagcttgctgttgtggtgaaggtgatgggcaggaccggctccaggggtcaggtgacccaggtcagagtgaagtttttggatgaccagaaccggcccatcatgaggaatgtcaaggggcccgttcgcgagggtgacatcctcaccctgctcgagtccgagagggaggccaggaggctgcgctgaagccctagcgttcttggtgggctcttgtatggtctttggtgtcttggaatttgtgctatgtttgaacttctgtgaccctgttttaagagtagtaagcctggttataagattgcagttttgtttatcttggttgaaagtgcaattggtgttgagacatggttatccttgctatattatctataaaacgacgcatgcattgaatactaaaaaaaaaaaaaaaaacgagacgctcgaggtacccaattcgccctatagtgagtcgtattacgcgcgctcactggccgtcgttttac

SEQ ID NO: 58626 - protein, 65 aa, Zea mays
  misc_feature: Ceres CLONE 1512411
  misc_feature (1)..(65): Pfam Name: Ribosomal_S28e Pfam Description: Ribosomal protein S28e
MDTQVKLAVVVKVMGRTGSRGQVTQVRVKFLDDQNRPIMRNVKGPVREGDILTLLESEREARRLR

SEQ ID NO: 58627 - DNA, 706 bp, Zea mays
  misc_feature: Ceres CLONE 1512413
  misc_feature: Translation starting site: 164
  misc_feature (411)..(411): n is a, c, t, g, unknown, or other
  misc_feature (549)..(549): n is a, c, t, g, unknown, or other
ctccccgcggtggcggccgctctagaactagtggatcccccgggctgcaggaattcgtctcacccctagaaaaagacctgcagccaaccatctaccagcgactcagcgagcgagagcagcacacactgcacgcagctagctaggagcagcagcagcggcggcgatggcggcctccatgatctcctcgtcagctctggcggtggcgcctcagggcctgccgcccctcggccgccgcgcctcctccttcgccgtcgtctgctccaagaagaaatcaagaccgacaagccctacgggattgggggtggcctgaccgtcgacgtcgacgccaacgggagaaagggcaagggcaagggcgtgtaccagttcgtcgacaagtacggcgcgaacgtcgacggatacagcccaatctancacgaggatgactggtctcccaccggcgacgtctacgtcggtggaaccactgggcttctgatctggggcgtcaccctcgctggggatctcggcggcggcgccctcctcgtctacacaccagcgccctctccggctaanggatatcaatgcatgcgcttcttgcggatcgtcatgaaaaatcagggtgtctgtctataatctagcctccatggatgctcaaccttcgtcatggaacaattaacagggctacccctccctaactaatttttgatgcaatatatatttccccctcccc

SEQ ID NO: 58628 - DNA, 806 bp, Zea mays
  misc_feature: Ceres CLONE 1512414
  misc_feature: Encodes the peptide sequence at SEQ ID NO. 58629
  misc_feature (49)..(49): n is a, c, t, g, unknown, or other
  misc_feature (406)..(406): n is a, c, t, g, unknown, or other
aaactggagctccccgcggtggcggccgctctagactagtggatttctntggctgcaggaattcgtctcacccctagaaaaagcataccgaccttgcattttctcaataccttgagcacctaagcaagtccaatgtctcatgcccagccccttcgtttacaggcccagtggaaacacgtcgatattcaggataaccaagccaatgctatgaaggaaccaggaaccagtggtgggtatggctccccaatgaaagatgacaggaacaaggatgtggatacaatttcttccaacttcagcaagcttagccacagggcttgggcactccagaaaagcacaaccatggaccaacctttccttttaaccccctccccaagggggggggggggaccccatcttatttatattnaacccccccccgtgtgtatagtgtccgtagtttacaaataccgcaatatctgcgctgcgccccgttgaaaagttttctcgaatgaaaaaacgatcgtccgcacaggtctacccgattaacgccatttagtggtcaagctccctcgcgggatggtgtaaattcctatcgcgacgtacgattcatctgtaacgaaaaaatgtaatccggcccggtctcctccccgtaattaaatgaaaggcgaacgccatcatgtgtgccttccacaggggccatcccatcgcccacccgtatttccgtccgaccgcgtttcacctgctccacgacgactcacacccgcgctttcagttccacatctaccgtatacccagttgacacacttcgcccccgtgccgcagccttc

SEQ ID NO: 58629 - protein, 113 aa, Zea mays
  misc_feature: Ceres CLONE 1512414
  misc_feature (92)..(92): Xaa is any aa, unknown, or other
MSHAQPLRLQAQWKHVDIQDNQANAMKEPGTSGGYGSPMKDDRNKDVDTISSNFSKLSHRAWALQKSTTMDQPFLLTPSPRGGGGPHLIYIXPPPVCIVSVVYKYRNICAAPR

SEQ ID NO: 58630 - DNA, 695 bp, Zea mays
  misc_feature: Ceres CLONE 1512415
  misc_feature: Encodes the peptide sequence at SEQ ID NO. 58631
  misc_feature (409)..(409): n is a, c, t, g, unknown, or other
  misc_feature (424)..(424): n is a, c, t, g, unknown, or other
cagagctggagctccccgcggtggcggccgctctagaactagtggatcccccgggctgcaggaattcgtctcacccctagaaaaagacgaaggtaagatgttcctgcggaggatcctgaccggcgggggcggcctggcggccctgagggcggcgcgcgccgtgaaggagacgacggggatcgtgggccttgaggtggtgcctaacgcgcgagaggttctggtagggctctacgagcgcacgctcaaagagatcaaggccgtccccgaagacgagggttaccgcaaggccgttgaatccttcaccggtcaccgcctccagatctgccaggaggaggaggactggaagcgcatcgaggaccgaatcggatgccggcaggtcgaggagctcatcgaggaagccaaggacaanctcaagctcatcgcntaaatgattgaatgggatccatggggtgttcccgatgactacgaatgtgaggtgattgagaccacacccccatttcctaaaccatgttcctcagcaccggcctggtgctcttcctgaggagtccttcaggccctaaatctttcaaatctgatcctgcccttcagggaatgcttctcctcagtgaaggcgaaaggatggctgttcccgggtaacctcctttcaattttccccccggggggaaggaacggttttctttggttttttgcaccaa

SEQ ID NO: 58631 - protein, 109 aa, Zea mays
  misc_feature: Ceres CLONE 1512415
  misc_feature (35)..(91): Pfam Name: ETC_C1_NDUFA5 Pfam Description: ETC complex I subunit conserved region
  misc_feature (104)..(104): Xaa is any aa, unknown, or other
MFLRRILTGGGGLAALRAARAVKETTGIVGLEVVPNAREVLVGLYERTLKEIKAVPEDEGYRKAVESFTGHRLQICQEEEDWKRIEDRIGCRQVEELIEEAKDXLKLIA

SEQ ID NO: 58632 - DNA, 682 bp, Zea mays
  misc_feature: Ceres CLONE 1512416
  misc_feature: Encodes the peptide sequence at SEQ ID NO. 58633
  misc_feature (390)..(390): n is a, c, t, g, unknown, or other
  misc_feature (452)..(452): n is a, c, t, g, unknown, or other
ctccccgcggtggcggccgctctagaactagtggatcccccgggctgcaggaattcgtctcacccctagaaaaatttgttgtgtagccgccactagtacgaagccctcagtcctccctcacacaccgaaccgagcgcaccatgtcgtcggcggctggaggagtggaggagacggtgcgggcgtcgcacatcctcatcaagcacgagggttcccgccgcaaggcctcctggaaggaccctgacggccgcatcatctccgccaccacgcgcggcgacgccgcagcgcgcctcctggacctccgcaaccagattctctccggccaggccaacttcgccgacctcgccgctcggcactccgactgctcgtccgcgcgacgcggtggggacttangtacctttgggagggagcagatgcagaaacccttcgagggacgcacatatgcccctcagggntggtgagctcagcgacatcgtggacactgacagtggggttcacatcatccttgcgactgcctgaggaggggatcacactgtcctctcaggctttcaagtagtgcttatgggcgtcctgtttagacctggtatttgaattctggctgggagcctgaaattctttcggtgcaagataaatcatgggtgacaacacgtttgcaacagcatttaggctaacctgcattaaggag

SEQ ID NO: 58633 - protein, 105 aa, Zea mays
  misc_feature: Ceres CLONE 1512416
  misc_feature (16)..(100): Pfam Name: Rotamase Pfam Description: PPIC-type PPIASE domain
  misc_feature: SWISSPROT Homolog: EC 5.2.1.8 Peptidylprolyl isomerase
  misc_feature (84)..(84): Xaa is any aa, unknown, or other
MSSAAGGVEETVRASHILIKHEGSRRKASWKDPDGRIISATTRGDAAARLLDLRNQILSGQANFADLAARHSDCSSARRGGDLXTFGREQMQKPFEGRTYAPQGW

SEQ ID NO: 58634 - DNA, 712 bp, Zea mays
  misc_feature: Ceres CLONE 1512417
  misc_feature: Encodes the peptide sequence at SEQ ID NO. 58635
  misc_feature (47)..(47): n is a, c, t, g, unknown, or other
  misc_feature (385)..(385): n is a, c, t, g, unknown, or other
  misc_feature (386)..(386): n is a, c, t, g, unknown, or other
  misc_feature (387)..(387): n is a, c, t, g, unknown, or other
  misc_feature (391)..(391): n is a, c, t, g, unknown, or other
  misc_feature (392)..(392): n is a, c, t, g, unknown, or other
  misc_feature (393)..(393): n is a, c, t, g, unknown, or other
  misc_feature (679)..(679): n is a, c, t, g, unknown, or other
  misc_feature (712)..(712): n is a, c, t, g, unknown, or other
ggagctccccgcggtggcggccgctctagactagtggatctctgggnctgcaggaattcgtctcacccctagaaaggcaactcaacaccgaagcagccgaacctgctagaagcctatacacggccaaggtccaccgttcccaaatctacgacttgagcaaaaaccacagctatagccatggtaaaggcaggggcaacggccgtgctggtgaccgtcctggttgtcctggcggcgtccgccgagatggcgcacggcgtctgcaacctgtcgagcgccggcatccgcgcgagccagcccgcggcagccatccgcaacccgacagaccagccgtcgtctgagtgctgcgcctcgcttttctcccccccaccgggggggggggggggcnnnccannnaacccccccccccccccggttgaggttttacaggagcgacatcaaccggcgccatggggcttgcccggcaagttgcgccctttcccatgccccccaactcgctgaagtggctcaattccgcccccaacgggagggcattgccgggtaggggtggcccccccctttttaattacacgtggcgtgtgggggacgtggttttcatggctatgaaagcgccaaggtatctaatccacggagccaaaggggtgagcgccgcccgccgacgtgcccctttgcaacctcagangtatctttttttttttatctttgtagcgctccn

SEQ ID NO: 58635 - protein, 106 aa, Zea mays
  misc_feature: Ceres CLONE 1512417
  misc_feature (70)..(70): Xaa is any aa, unknown, or other
  misc_feature (72)..(72): Xaa is any aa, unknown, or other
MVKAGATAVLVTVLVVLAASAEMAHGVCNLSSAGIRASQPAAAIRNPTDQPSSECCASLFSPPPGGGGGXPXNPPPPPVEVLQERHQPAPWGLPGKLRPFPCPPTR

SEQ ID NO: 58636 - DNA, 724 bp, Zea mays
  misc_feature: Ceres CLONE 1512418
  misc_feature: Encodes the peptide sequence at SEQ ID NO. 58637
  misc_feature (421)..(421): n is a, c, t, g, unknown, or other
  misc_feature (453)..(453): n is a, c, t, g, unknown, or other
  misc_feature (454)..(454): n is a, c, t, g, unknown, or other
aagctggagctccccgcggtggcggccgctctagaactagtggatcccccgggctgcaggaattcgtctcacccctagaaaaatctccgttgagtcgaggcggctccaactccggctcgtggcctcgcggaccaacatggccgccccttcgccctcgccggtggaggctaccctaccgcctgaggccgcggctgccgccgaggaagaccagtgggatgctgacggatatgtcattcctaatttgcccactcaagataatgatgtggctgagcctagtgtccccaaagaaaaagatcctgagcctctacagggcaacgatgagaaaatatacttggggacctcatggagctccaccatctcaagcaaagcaccaggagctgaacaccgttggccgcaagcagcggttcccggaacagctganggaacagataggaaatcccccggcatgctcanngagacaaggtggagaccctagggagctgatgggtgctaaaggtggtaccaccctgccaagagctctcctcgtgattggctccaccgcactggcatgaatctgatttcaccgaaaaccaactagatgaccggcaacgatggcccggggtttaacctgaagttaatttccctgaacccctggggcaaggggttttccccaataacaaatcttttgggtggaccggacctttttgttccccggggcggaaaaaccctttaattctgggtgggg

SEQ ID NO: 58637 - protein, 112 aa, Zea mays
  misc_feature: Ceres CLONE 1512418
  misc_feature (95)..(95): Xaa is any aa, unknown, or other
  misc_feature (106)..(106): Xaa is any aa, unknown, or other
MAAPSPSPVEATLPPEAAAAAEEDQWDADGYVIPNLPTQDNDVAEPSVPKEKDPEPLQGNDEKIYLGTSWSSTISSKAPGAEHRWPQAAVPGTAXGTDRKSPGMLXETRWRP

SEQ ID NO: 58638 - DNA, 771 bp, Zea mays
  misc_feature: Ceres CLONE 1512419
  misc_feature: Encodes the peptide sequence at SEQ ID NO. 58639
  misc_feature (399)..(399): n is a, c, t, g, unknown, or other
  misc_feature (406)..(406): n is a, c, t, g, unknown, or other
atgctggagctccccgcggtggcggccgctctagaactagtggatcccccgggctgcaggaattcgtctcacccctagaaaaaatccggacaggtgctcggcgtccggcagctcggcgcgcgtggaggaggccaaggagcggttccaggagatccagggcgcctactccgtgctctccgactccaacaagcggctcctctacgacgtcggcgtctacgacagcgaggacgacgacgctgacctgtcggggatgggcgacttcctcggagagatggccgacatgatgagccaggccacgccaacggagagcttcgaggagctgcagcagctgttcgtggacaggttccaggacaacctgaacggccccggccccttcggggggggtggggagagccgcantgcccanggccccacccccacctcgttgccaccgtcgacgtcgcctttgcggccgacgcctcctgcaaaaagtaagggtgcgccaacaccctccgtcgttaaacggcgctggggaggcggggttcgaacgcgaaacgggccaagaaccggttggggttggcctggaacccgagactgggcctcctcgggattccggtttctgggggagcacagccaaagaagaggcccgggggcttgggcgtgcgccccccacatgaaccaagagagacccgtcatccctgacaaacgcttgggccaccaacgccccggacggttctcgaggtccccgggggcagggcacaccccccccctccccccgcgctagaacctaaa

SEQ ID NO: 58639 - protein, 170 aa, Zea mays
  misc_feature: Ceres CLONE 1512419
  misc_feature (50)..(50): Xaa is any aa, unknown, or other
  misc_feature (52)..(52): Xaa is any aa, unknown, or other
MGDFLGEMADMMSQATPTESFEELQQLFVDRFQDNLNGPGPFGGGGESRXAXGPTPTSLPPSTSPLRPTPPAKSKGAPTPSVVKRRWGGGVRTRNGPRTGWGWPGTRDWASSGFRFLGEHSQRRGPGAWACAPHMNQERPVIPDKRLGHQRPGRFSRSPGAGHTPPLPPR

SEQ ID NO: 58640 - DNA, 723 bp, Zea mays
  misc_feature: Ceres CLONE 1512425
  misc_feature: Pfam Name: E1_DerP2_DerF2 Pfam Description: ML domain
  misc_feature: SWISSPROT Homolog: EC 2.7.7.6 DNA-directed RNA polymerase
  misc_feature (382)..(382): n is a, c, t, g, unknown, or other
ggagctccccgcggtggcggccgctctagactagtggattcttgggctgcaggaatcgtctcaccctagagagagtcagagtcctcgcaccgcacgcaacaagtacgcaggcagcgcagcctcgagccgtcgccatggcgagcaagcacctcgtcctcgccgcatgcctcctcctcctgcccaccgcctcggtcgccaccgacgtcgactactgcagtaagaaggactacccggtgaaggtgagcggggtgcaaatcgtgcccgatccggtcgaacccggcaagcccgccactttcaagatctccgcttctactgataaaaccatcgagaaggggaagctggttttttttttcccctactcccgcggggggggggggggtcnaaaaccccccaacatctcccccccacactttcttgcccaaagaaccgggcgactttccgggtggccccgccaccagacgcttgcccggggtttctctcccccggggctccctaccgcaaccttacttgagagaatctcccgggtaccacccccacggaagcttgactttcgcccctcggtcccgggtccagccacccgcttttgcctccgcctccgctttatacctcctcccgcgcggggggacttataatgcccccccgcgccccgtcttttcccccccccctgggacccgtcctctggtttctcccgttcccccccgatgtttttactctcccccgccg

SEQ ID NO: 58641 - DNA, 749 bp, Zea mays
  misc_feature: Ceres CLONE 1512426
  misc_feature: Translation starting site: 203
  misc_feature (380)..(380): n is a, c, t, g, unknown, or other
  misc_feature (381)..(381): n is a, c, t, g, unknown, or other
  misc_feature (382)..(382): n is a, c, t, g, unknown, or other
ccccgcggtggcggcgctctagactagtggattcttgggctgcaggattcgtctcgtcgtaggagagcacgcgattcctttccttccgcgtccgcatccttctcggctgtctgtgcagttgtgctcgcttgctccccacgcccacgtcattccccgtccgctgcggctcacctccagcctcctggtcccgcgaccgctcgctatggccgacgcgtactggaggtacgctgccgccgccccgcgccagcagcatcagcagcagccttcgccgcccttcggggggtgggggcctcttgtattctttgcaggccctgtccggcccacctcagaatggcccccttttttttccccccccccgggggggggaggagggggggggnnnctctaacaaaaccccccccccccccccgcgctttatcgaggcatgatacttcgtgacctcgccccacccggccgcgttcccctctctactccccccacgcttcggcgcccccacgccctcaaataacagacccgttcccaagcggcacgccgcgtaaaaacccgtccccccccccgacccctttgagtccggcgggccgcgccccccggcggagccactattacggcggtctcttccaccctctttagtctccctgggagtgccgtcgttgtcctctccccctactaaacatcttctccccccccccgcgagacccgtggcgagtgttacggagaccgccgcgcgcgcccccgggtgcccccctttg

SEQ ID NO: 58642 - DNA, 702 bp, Zea mays
  misc_feature: Ceres CLONE 1512428
  misc_feature: Encodes the peptide sequence at SEQ ID NO. 58643
  misc_feature (616)..(616): n is a, c, t, g, unknown, or other
gcggtggcggccgctctagaactagtggatcccccgggctgcaggaattcgtctcacccctagaaaaaagcacagcacaaggagaggccgagaagcgctttagccgtagccgtagcgataagagtgagctagctggtgcacaccggcatggcggccacggcgtactccgtggcgctcctcggcggcgcgcgcctccccgccgctccgcgctccgccctcctccctcggcgcagcgtctgccagcttcgcttccaagatgcaccgaggctctccctgctccgtgcgaaggccgcttccgaggacacatcggcctccggcgacgagttgatcgaggacctcaaagcgaagtgtgacgccgttgatgactagcccaccgtcctcttgtactgcggcggcgccgtcgtcgccctatggctgacgtccgtggtcgtgggcgccatcacgccgtgccgctgctccccaagatcctggagctcgtttggctcggctacacgggctggttcgtgtacgcctaccttctcttaaagaaagcaggaaagagttggccgccgaccttgaaacccttgaaaaaaaaatacctggaacaaaataacgctcatggaaagttttaaagcgncctttcctctttggaaaaagacttttcaatcggagaaccaatatgcacctacttgatacctttattgcccatggaattggggcctt

SEQ ID NO: 58643 - protein, 73 aa, Zea mays
  misc_feature: Ceres CLONE 1512428
MAATAYSVALLGGARLPAAPRSALLPRRSVCQLRFQDAPRLSLLRAKAASEDTSASGDELIEDLKAKCDAVDD

SEQ ID NO: 58644 - DNA, 730 bp, Zea mays
  misc_feature: Ceres CLONE 1512432
  misc_feature: Encodes the peptide sequence at SEQ ID NO. 58645
  misc_feature (516)..(516): n is a, c, t, g, unknown, or other
  misc_feature (571)..(571): n is a, c, t, g, unknown, or other
  misc_feature (664)..(664): n is a, c, t, g, unknown, or other
  misc_feature (730)..(730): n is a, c, t, g, unknown, or other
aagctggagctccccgcggtggcggccgctctagaactagtggatcccccgggctgcaggaattcgtctcacccctagaaaaaacccacccacgccgacgagcaaaccctagcgagcgagagagcccggagccgagagaccagccagccatggcgctgcgtgccctgtacaacgagatccggagcatgaaggtccgcgacgtgccggcttacctgaagccgcgcttgacctgggacaacgtcaagaagagcgccgaccaggccgtcgaccgctacatcgagaagtacatcgacacgagctcgccggaccctctctaccacgtctgcatcggagggatgatcttctcctacttcgtcaatctgccctgggagcgcgcccacctcgcccacctcgaggagatggagaggaccggtgggaagcactagatccgctgccccgtccctcgccggcagcgcgggaggacgggtgactttcatggggtccattcaggctgatggcttctgttttcttctgctngtgagctactggagtcatgttactttgggtcgtggggtttgtacccagacagcangaaactgtccagcttattgtcttggtcctcgcgtcttgtcataagtacttcaaaacaagagtgcatgcattgtgataaaaacgttttcagcanttgagtacgaatattctctttctaaaaaaaaaaaaaaacgagacgctcgaggtacccattcccctn

SEQ ID NO: 58645 - protein, 91 aa, Zea mays; identical to SEQ ID NO: 44946
  misc_feature: Ceres CLONE 1512432

SEQ ID NO: 58646 - DNA, 615 bp, Zea mays
  misc_feature: Ceres CLONE 1512433
  misc_feature: Encodes the peptide sequence at SEQ ID NO. 58647
  misc_feature (24)..(24): n is a, c, t, g, unknown, or other
tctaagaaactagtggatcccccngggctgcaggaattcgtctcacccctagaaaaaaaaaggaaccgatcagagagagagagagagcgcatagtcgatcatgaagggtggcaagaaggaagtggccggtgcggtggtggccatactgctggttctgcagctcatggcagctccaccgacggccatggccgcccgctcgccgcacggaagccgtgccgggatggctcccctcgcacgacgcccaaggtgacgatgctgtcggccacgctgtgctacacggggggagacatgcaaataacatggctgcctcaatcctgctggctctggactaaaagggatcggctatgctacatcaaattttacccccggttggcttggagggcctttccccgaagccccaactctttaaatggttgggccggcccaaaaaaaaaccttcctttccgggagattctttgttaaaaggagccgggtttcaggggcccccggggggcttttttgaaataaaaaaaccccatataataaatacccccggttcgggaaaccccggaaaaaaaggggggggttttttttttttacaccccccgggggggaaaaaaaaaaaaagaaaaaaaa

SEQ ID NO: 58647 - protein, 49 aa, Zea mays
  misc_feature: Ceres CLONE 1512433
MKGGKKEVAGAVVAILLVLQLMAAPPTAMAARSPHGSRAGMAPLARRPR

SEQ ID NO: 58648 - DNA, 751 bp, Zea mays
  misc_feature: Ceres CLONE 1512437
  misc_feature (382)..(382): n is a, c, t, g, unknown, or other
  misc_feature (400)..(400): n is a, c, t, g, unknown, or other
aaagctggagctccccgcggtggcggccgctctagactagtggattcttgggctgcaggattcgtctccccctagaaaaattccaaatccgcagtccgcagacgagagtggaagcggggcacagacagagaagccaatggcgctgtccctctccctcgcgcgccccgcgcccctcgccgtttccgccggcgcaggagccaggaagctacccgcagccagcctcgcattcccggcgaaatccttcttcggcgcgccgctggccgccaccgcggcctccgtcgcgtcgccgctcccgcgcaagccggccacctctaccacctcgctcgaggtcgtcgcggcggggaagaatggctaccccccccaagacgggcggggggggccnccaaaccggttccctgtncaccccccaccccccaggatcgtggggggcggggggcccgggaagccacccctttgtccttctaaaaaaaaccccccatgctgccagaaacgaggttcccctaggatggggcgccctggcctcccccggtgtgccctcccccccacggtgtccgggggtccgcggcgcccccccccccacaagggggaggcgggcacccccgcctgggtgcgcccccgtgtggccctccgaagaaggcgccttaggcgggtttttctcccactgcggcgttgttccgttctccccggttgtttcccccggcgggttgtcttcgttctcccagcagggatcttcgcgcgccccggctggatc

SEQ ID NO: 58649 - DNA, 668 bp, Zea mays
  misc_feature: Ceres CLONE 1512440
  misc_feature: Encodes the peptide sequence at SEQ ID NO. 58650
  misc_feature (541)..(541): n is a, c, t, g, unknown, or other
aaagctggagctccccgcggtggcggccgctctagaactagtggatcccccgggctgcaggaattcgtctcacccctagaaaaagagagcacgagacgcccctctgcttccttttctctgtcgctcaaaagttgctggagccctcttctctctctcctctccgagccccaaccatggatgaggcgcaagttgtagagtcaaaggatggaaccatctcagttgcttctgcatttgttgctcatcaggaagctgtacaagacagggatcacaaattcttgacaaaagcagtggaagaagcataccgaggagtcgattgcggcgatggaggtccatttggagcagttgtcgtccgtaatgatgaagtggttgttagctgccataacatggttctgaagcacactgaccctactgcgcatgctgaagtaactgcaattagagaggcttgcaaaaagctcgggaaaatcgagctctctgactgcgaaatttacgcgtcctgcgagccatgcccaatgtgctttggtgcagttcatctctcccgaantcagaggctggtttaatggggccaaggcggaggctgccatcgccattgggtttgacgacttcatggcagatgctctgaggagcactgggttctaccagaaggctacattgagatcaagaaggcgaag

SEQ ID NO: 58650 - protein, 127 aa, Zea mays
  misc_feature: Ceres CLONE 1512440
  misc_feature (28)..(127): Pfam Name: dCMP_cyt_deam_1 Pfam Description: Cytidine and deoxycytidylate deaminase zinc-binding region
  misc_feature: SWISSPROT Homolog: EC 3.5.4.3 Guanine deaminase
  misc_feature (123)..(123): Xaa is any aa, unknown, or other
MDEAQVVESKDGTISVASAFVAHQEAVQDRDHKFLTKAVEEAYRGVDCGDGGPFGAVVVRNDEVVVSCHNMVLKHTDPTAHAEVTAIREACKKLGKIELSDCEIYASCEPCPMCFGAVHLSRXQRLV

SEQ ID NO: 58651 - DNA, 662 bp, Zea mays
  misc_feature: Ceres CLONE 1512442
  misc_feature: Encodes the peptide sequence at SEQ ID NO. 58652
ggagctccccgcggtggcggccgctctagaactagtggatcccccgggctgcaggaattcgtctcacccctagaaaacgcatccacggagccaggcgaccgccgccgcttccctactcacccttggccggcgacgacgagcgccaccacggcaggatgacgacgctgaggaacctcaagatcaagacgtcgacgtgcaagaggatcgtgaaggagctgcgctcgtacgagaaggaggtggggaaggaggcggccaagaccgccgacatgaaggagaagggcgctgatccctacgacctcaaacagcaggagaatgttttggctgagtcaaggatgatggtcccagactgccacaaacgacttgaaactgcactggctgacttgaaagcaacactggctgaactgaaagagtcaaatgagcaaggtgccgagattggagaagctgagagtacaatcgcagaagtttgagcaggtgtcaaggtagcagaagattaaactaaaaaaactcttggtttggctgaactggtagcgcacatcctattttcgcatattgagcccctggtgagcttattacgagatgtttgaggccttgaaatcctgtaccattatcatccccttctattttggaaatttgagtttctcgttccccaagttttaaagggg

SEQ ID NO: 58652 - protein, 103 aa, Zea mays
  misc_feature: Ceres CLONE 1512442
  misc_feature (6)..(99): Pfam Name: TBCA Pfam Description: Tubulin binding cofactor A
MTTLRNLKIKTSTCKRIVKELRSYEKEVGKEAAKTADMKEKGADPYDLKQQENVLAESRMMVPDCHKRLETALADLKATLAELKESNEQGAEIGEAESTIAEV

SEQ ID NO: 58653 - DNA, 753 bp, Zea mays
  misc_feature: Ceres CLONE 1512443
  misc_feature (51)..(51): n is a, c, t, g, unknown, or other
  misc_feature (75)..(75): n is a, c, t, g, unknown, or other
agtgctgagctcaccgcggtggcggccgctctagactagtggattcttggnctgcaggaatcgtctcaccctagnaaatccactcgccctcccacaagaaaaccctagccgccgccaccgaagcggcctcccaggtaagcaggagcgtccaccccgccgccgtcatgaagggcaatccccgcgtcacgagctcccgccggaagtgccgcaaggcgtactttatcgccctctcctccgtcgccgcgtgctcatgtcttccgggctgcggtcggagtttcttcccccgtgagaggggtgcggcctcctcatctcgaaggacaactaggtgctgggcgctgggcggcacctattttttttttttatgtcaagggggggggggggggaaccccccccataaaaaatttttttcccccccccggggtatttcgttcgggagtgacccgactcccccgcgggggtattggagttcagtcgtttgggggagggtggtttcccttctgcaacggctttcccgcttgccctgggggtcaccccggggtgctggcttttttatgggggtttttccccgccattggccacccgggggtccattggtcttggccgtttcatcctccatcccctgcgcccccgcccgagcagattcgcgcgggcggcggagacgtatacggccggccccggttaacgcggtttttgtgtgttcgtgtcgcacccatgcgcgtgcgcaaacgttatattggtgtgtttcggggtgag

SEQ ID NO: 58654 - DNA, 716 bp, Zea mays
  misc_feature: Ceres CLONE 1512444
  misc_feature: Encodes the peptide sequence at SEQ ID NO. 58655
  misc_feature (424)..(424): n is a, c, t, g, unknown, or other
  misc_feature (440)..(440): n is a, c, t, g, unknown, or other
  misc_feature (505)..(505): n is a, c, t, g, unknown, or other
ctccccgcggtggcggccgctctagaactagtggatcccccgggctgcaggaattcgtctcacccctagaaaaaattcctcatctgcttcgcttccccccaaatcgaatcctcatcgctccgtctatggcgactctaaccatgcagccgatcggtcccacccctgctccggctgcgcagcaagacccaagcaagggagagaatcctcctaccgtggatggtaccgatctgggtgacatcgactcgggctgggttatcctcaagaactcggatgtcgtttccgcggatttggcagccgccgccgtctgtggcggtcagcgtctaggctcttctacgattcctagctgggcacggtgggttctcggaggtgtggtttacacgctcgtgccgtttctacacagaagtaggcatctcgaagacgagancgtgggattcgtgganaatgctgtggaggttgtggagcatttagctgaattacagaagagctagctgcgaatgtggctaancacttcctgaagatgggtctctgcaaaagcagtggaaaaggttgaacctttgctgaagtaatggatgatgatccgaaaagggtgaaaacatccctgaaaaaatcacaaggccgtgatgaaattgatgctgcttggaacccggcctcccggacttgaaaaggaatccattaaaaccaaccccaaaaatgggtttgacccaaaatttgtcacc

SEQ ID NO: 58655 - protein, 120 aa, Zea mays
  misc_feature: Ceres CLONE 1512444
  misc_feature (100)..(100): Xaa is any aa, unknown, or other
  misc_feature (105)..(105): Xaa is any aa, unknown, or other
MATLTMQPIGPTPAPAAQQDPSKGENPPTVDGTDLGDIDSGWVILKNSDVVSADLAAAAVCGGQRLGSSTIPSWARWVLGGVVYTLVPFLHRSRHLEDEXVGFVXNAVEVVEHLAELQKS

SEQ ID NO: 58656 - DNA, 684 bp, Zea mays
  misc_feature: Ceres CLONE 1512445
  misc_feature: Encodes the peptide sequence at SEQ ID NO. 58657
aagctggagctccccgcggtggcggccgctctagaactagtggatcccccgggctgcaggaattcgtctcacccctagaaaaactcctaccactacactaccaccgtttcactgctatacgatacgattttcttttgacggccatgaaaccccctcagctgccggccggggagcgctcctgggctcacgaggtcaagcaggccctccgtgagaaactccggcgctcctacggcgccgcctccgccacaccggcggccggtgaacccagccattggcgccgactgccgtggctcggccgccgaggaccccataatgagagtcatgttcttggctccctggggccacacataagacacacacgccgatcaggacttgcgagagcatggctgcatctgcacagaactgctcaaccatacttaagatgaactggagcttgtcatgtcaactatggatcatgctgcttgcaccacgatcatgaacgcgtggctgggtcactaggtacatatatgggtgtggatcggaggatgaatcaatacactgcgtttgtagtccaccgacgtctctgatcttggatggagaggcatgagatcttggaatgcttcatgcatgggcctggggttgggctgaaaactctgaacttttttaaaccatcaccttgttttccaaaaaccctgttaataaggg

SEQ ID NO: 58657 - protein, 93 aa, Zea mays
  misc_feature: Ceres CLONE 1512445
MKPPQLPAGERSWAHEVKQALREKLRRSYGAASATPAAGEPSHWRRLPWLGRRGPHNESHVLGSLGPHIRHTRRSGLARAWLHLHRTAQPYLR

SEQ ID NO: 58658 - DNA, 739 bp, Zea mays
  misc_feature: Ceres CLONE 1512447
  misc_feature: Encodes the peptide sequence at SEQ ID NO. 58659
  misc_feature (428)..(428): n is a, c, t, g, unknown, or other
  misc_feature (513)..(513): n is a, c, t, g, unknown, or other
  misc_feature (561)..(561): n is a, c, t, g, unknown, or other
  misc_feature (562)..(562): n is a, c, t, g, unknown, or other
ggagctccccgcggtggcggccgctctagaactagtggatcccccgggctgcaggaattcgtctcacccctagaaatatcccctgaccagtcgccccgatttttttctgttccaggtcgcttctctctgttccgcgtgcgatcgagtagatcaaaaggaggaggaggatggcgaggagttcgttcaagttggagcaccccttcgaaaggaggcaagctgaggctaaccgcatcagggagaaataccctgacagaatccctgtcattgttgagaaggccgagaggagtgacatcccagacattgacaagaaaaagtaccttgttcctgccgacctcacagtcggacagtttgtgtatgtggtacggaagcggatcaagctaagcgctgagaaggcaatcttcatctttcgtaagaacacccctcccacnacagggtaccggacagtagttccctttctgtgtcataccagtggttggggaaaaataaaacaaaacctaccacgggtgcccccgncccgtaacgttgttgtccctgcagctgctctgatgcctgccatctacnnagaggacaaggacgaggacccttcttctacttgacgtacagcggcaagaaaccctttcgggttgttctggagtggccccccctatggatccccaatggggcaatggcccccggaaaacccaaacgtggctccaaagaatcgggggccaaaaggaaactgggcttggctgggcggggt

SEQ ID NO: 58659 - protein, 142 aa, Zea mays
  misc_feature: Ceres CLONE 1512447
  misc_feature (14)..(104): Pfam Name: MAP1_LC3 Pfam Description: Microtubule associated protein 1A/1B, light chain 3
  misc_feature (116)..(116): Xaa is any aa, unknown, or other
  misc_feature (132)..(132): Xaa is any aa, unknown, or other
MARSSFKLEHPFERRQAEANRIREKYPDRIPVIVEKAERSDIPDIDKKKYLVPADLTVGQFVYVVRKRIKLSAEKAIFIFRKNTPPTTGYRTVVPFLCHTSGWGKIKQNLPRVPPXRNVVVPAAALMPAIYXEDKDEDPSST

SEQ ID NO: 58660 - DNA, 704 bp, Zea mays
  misc_feature: Ceres CLONE 1512449
  misc_feature: Encodes the peptide sequence at SEQ ID NO. 58661
  misc_feature (295)..(295): n is a, c, t, g, unknown, or other
  misc_feature (322)..(322): n is a, c, t, g, unknown, or other
  misc_feature (331)..(331): n is a, c, t, g, unknown, or other
tggcggccgctctagaactagtggatcccccggcctgcaggaattcgtctcacccctagaaaaaacgagactgctcggccgacgaaataataaagcgcgcgcgcgcacgcggagaggctcggagagctgagtgagatggcacaaaccatggcgtccatgaccggcctctcgcagggcgttctgcccagcaggcgcgccgccaacagggccaggacggccgccgtcgtcagggcgtccgccgaggcgcaggcgggccgccgccccgtgctcggggtggtgggcactggcatcctcngggggcccttggcccagggggtgcacnccgagaccntccaaacattcccccccccaggcggggggggggcggtctggtggaatccccccaaatcccccccccggaccccgcggaggagttccaccctcccttggaggagacggttctcacttcgcgccgctgccccccgggggaggggcggtcaagggtgaaacatcggggcggagaaatccctacccccagacgcgcgcctcgcgggagaggggggggcgcggggcgcgaaacggcgtgccgcccccgcgcccgcgggctggcgccagaggcgcggaccgctgcgccgtgcccgcccgagggagaaaaacagcccgcgagccgccgccccggcatctcttgcggggcaggcgggatcggggcgcgggtggcaggttaa

SEQ ID NO: 58661 - protein, 112 aa, Zea mays
  misc_feature: Ceres CLONE 1512449
  misc_feature (50)..(50): Xaa is any aa, unknown, or other
  misc_feature (59)..(59): Xaa is any aa, unknown, or other
  misc_feature (62)..(62): Xaa is any aa, unknown, or other
MASMTGLSQGVLPSRRAANRARTAAVVRASAEAQAGRRPVLGVVGTGILXGPLAQGVHXETXQTFPPPGGGGAVWWNPPKSPPRTPRRSSTLPWRRRFSLRAAAPRGRGGQG

SEQ ID NO: 58662 - DNA, 680 bp, Zea mays
  misc_feature: Ceres CLONE 1512450
aagctggagctccccgcggtggcggccgctctagaactagtggatcccccgggctgcaggaattcgtctcacccctagaaaaaaaaccgcgaagcactacactacactacaccagcacgcacccgatgacgatcacacaggcataagatcgagttcgttcgatcgtgagtgtgggacgtgatactactgtctggccgagagaggagtcagagtggcggcttcgatggtggcgagactctctgtctcggtgacgacgacgagcttatcggagacggctgcagcgggaggcgcccacgtgctgatcggcgttccgaggagggcgggcgctgggcgcgtctggttccccgcggcggcgcgccgcggcggccgcagcgggcggttggtcgccatgcggtccagcgggccggccacgccaccggagatctccgacaggtgtcggagagctcaacatgcggaggaacgtgcgcggacgacaccaaggcgacgccgagtgcgcggctgcgtgggactaggtggaggagctcaaagcacatgccagccacgcgcgcgacagtctcgaggagaccaacgccgacgacccgctcgagaagtactgcaaggactacccggactccgaggagtgccgcatctacgacaactagcataggcgtatagctatatgggccatcgacatgaaggac

SEQ ID NO: 58663 - DNA, 724 bp, Zea mays
  misc_feature: Ceres CLONE 1512452
  misc_feature: Translation starting site: 121
  misc_feature (37)..(37): n is a, c, t, g, unknown, or other
  misc_feature (68)..(68): n is a, c, t, g, unknown, or other
  misc_feature (70)..(70): n is a, c, t, g, unknown, or other
cgcggtggcggccgctctagaactagtggatcccccngggctgcaggaattcgtctcacccctagaananaaaaaaaaaaaaaaaaaaaaaaaaggaccattaagcttcactggtttgggatggttggtggccaggacaagatcaggcccctgtggaggcactactttcagaacacacagggacttatttttgttgtagacagcaacgacagggaacgtgttgttgaggctagagatgagctccacaggatgctgaatgaggatgagctgcgtgacgctgtgctgcttgtatttgcaacaaacaagatcttcccaatgctatgaatgctgctgaaattactgacaagcttggtctgcattccctgcgacggcggcactggtacatccagagcacttgtgctacatctggtgaagggttgtatgaggggcttgactggctttccaacaacatcctcagcaagtcttgaagcttttcggcagggctcctaccgagaggatgtctgaacaacttatggctgctttttttttacctattattactaagaccccagctaccgcagatttagggcttggggaaaaaaaaaacttccgagctcctttggagggattgaaccaaaatgggattgggtttttggtttttgggccaaaaccaaccccctggtcggtcccccaaattgactggccaccaaatttacccatggccggagaatgggaggaaaattta

SEQ ID NO: 58664 - DNA, 798 bp, Zea mays
  misc_feature: Ceres CLONE 1512455
  misc_feature: Encodes the peptide sequence at SEQ ID NO. 58665
  misc_feature (354)..(354): n is a, c, t, g, unknown, or other
  misc_feature (388)..(388): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (392)..(392): n is a, c, t, g, unknown, or other
  misc_feature (411)..(411): n is a, c, t, g, unknown, or other
  misc_feature (423)..(423): n is a, c, t, g, unknown, or other
  misc_feature (426)..(426): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (502)..(502): n is a, c, t, g, unknown, or other
  misc_feature (503)..(503): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (532)..(532): n is a, c, t, g, unknown, or other
  misc_feature (534)..(534): n is a, c, t, g, unknown, or other
  misc_feature (559)..(559): n is a, c, t, g, unknown, or other
  misc_feature (561)..(561): n is a, c, t, g, unknown, or other
  misc_feature (599)..(599): n is a, c, t, g, unknown, or other
  misc_feature (600)..(600): n is a, c, t, g, unknown, or other
  misc_feature (602)..(602): n is a, c, t, g, unknown, or other
  misc_feature (608)..(608): n is a, c, t, g, unknown, or other
  misc_feature (609)..(609): n is a, c, t, g, unknown, or other
  misc_feature (611)..(611): n is a, c, t, g, unknown, or other
  misc_feature (612)..(612): n is a, c, t, g, unknown, or other
  misc_feature (620)..(620): n is a, c, t, g, unknown, or other
  misc_feature (622)..(622): n is a, c, t, g, unknown, or other
  misc_feature (640)..(640): n is a, c, t, g, unknown, or other
  misc_feature (698)..(698): n is a, c, t, g, unknown, or other
  misc_feature (722)..(722): n is a, c, t, g, unknown, or other
  misc_feature (723)..(723): n is a, c, t, g, unknown, or other
cacgctggagctcaccgcggtggcggccgctctagactagtggatttcttcggctgcaggaattcgtctcatctttagggaggtcagatcacactcgtagagagaaggaaaaatatccccaaaccctagctcccgatctcgatggggaaccctcgcgtcttcttcgacatgaccgtcggcggcgccccggcgggccggatcttgatggagctgtaccccaacgaggtgcccaagaccgcggagaacttccgcgcgctgtgcacgggcgagaagggcgtggtttaccccggggaggggggccactacaggggctcgggcttccgcggggtcctccccgagttcatgtcccacggnttttaacttcccctcggggggggggggggggggnnnnnaattccttttttttttaanaccccgggtccnacngtgaagatgnnnnntccggagggggcgagctgccggggggggggttctcccgtgtggcccnnnnnccagnnnnngnnggacatacgtgggnnnccgggaggtgtgngncttcctgggacgggggggaggggcngngggtgatggggcccacgccgagcgctcggcatgtcggnngngcgggnnanngattgggngngttaggtggcgcttgcgngtaggggggtagcagagatctgggtgggactgtgggggaactccagtcccgggtcgtnggccgtcgcggcgggccgcccgannagaaggaagaacaagaagcggggccggggcggcgccggggcgcgcgcgcgcgggtgtgtgcgagtgcaggcgagc

SEQ ID NO: 58665 - protein, 72 aa, Zea mays
  misc_feature: Ceres CLONE 1512455
  misc_feature (5)..(73): Pfam Name: Pro_isomerase Pfam Description: Cyclophilin type peptidyl-prolyl cis-trans isomerase/CLD
  misc_feature: SWISSPROT Homolog: EC 5.2.1.8 Peptidylprolyl isomerase
MGNPRVFFDMTVGGAPAGRILMELYPNEVPKTAENFRALCTGEKGVVYPGEGGHYRGSGFRGVLPEFMSHGF

SEQ ID NO: 58666 - DNA, 873 bp, Zea mays
  misc_feature: Ceres CLONE 1512457
  misc_feature: Encodes the peptide sequence at SEQ ID NO. 58667
  misc_feature (413)..(413): n is a, c, t, g, unknown, or other
  misc_feature (429)..(429): n is a, c, t, g, unknown, or other
  misc_feature (836)..(836): n is a, c, t, g, unknown, or other
acagctggagctccccgcggtggcggccgctctagaactagtggatcccccgggctgcaggaattcgtctcacccctagaaaaaagactgcacccccatcccgcagcagccaaaacctatctggccgccgccgcaggcggtcccccatcgtcgccaagatgcagatctttgtgaggactctgactgggaagaccatcactttccaggtggagtcctcggactcctttgacagggtgaaggccaagttccacgaccaggaggggcatcccctcccactctcccggttttctttttcgcagggagaggagccccgagcactgtcgttagtctctcccgaacgcctactttcccaagggggtgccccccctgttttttttttgttttcgtgaggagggggggggggtccctcttantcttataaaaaggaanaactggcgcccaccccccaattattttataatctcggtttgcgggcttaatgataagaggaggcgtatctttctctctggtacccttctgtatctctctctatgtaccattagtgatctcaagaatgcatattgcttgcgttttgcccggttaacgccgcgtggcttgtcatagcgcgccgctctcgccgacgcgtatgttctcgcggttgttgtgtctacgatccgcgcttcgctttctgtcccgcgcggctgtggatttgcgtggcggttccgtgttttttcattgtacctacgcgcatctcgcggtcggtcaattgtctttcttgtccgccccccgacttatacatttcgcgccccctctgcccgaggcaccgcatattattatattgtctcgcgcgcgcctcngaaggggagattagttacctccgcgtctgccccgtac

SEQ ID NO: 58667 - protein, 76 aa, Zea mays
  misc_feature: Ceres CLONE 1512457
MQIFVRTLTGKTITFQVESSDSFDRVKAKFHDQEGHPLPLSRFSFSQGEEPRALSLVSPERLLSQGGAPPVFFLFS

SEQ ID NO: 58668 - DNA, 762 bp, Zea mays
  misc_feature: Ceres CLONE 1512458
  misc_feature (65)..(65): n is a, c, t, g, unknown, or other
  misc_feature (115)..(115): n is a, c, t, g, unknown, or other
  misc_feature (400)..(400): n is a, c, t, g, unknown, or other
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
acagctggagctccccgcggtggcggccgctctagactagtggatctctgggctgcaggaattcntctcactcctagaaaaacgcaaaaaacaaacacactcgaaggcagcgaancccgagccttcccttccctccaatcgatcacccgctccgatccgctagcgagctagcagcgcgatggcttccctcaccgtgtccaccaacaccgcggcggccggcggtaacaagccccgctaggcccccaaggtcttcccgggcgccgaaccctgcccctctctctcccgcggagggggggggcgctggccccccctgtttgtttagatgcagatgcggcgggggtcaaaaccttttttttcccccccccccggggggaaagaaaggggaatatacaaatatccnannnacccccccggggggggcggaaaaacaataaccgtcccccattggcgggggggggggccccgcgggccgggggcgcatggtcgcgggtgtgccctagggccggttcagcgttttgcgcccgaacgcccgccctaatccgccgtcgcattgtgtggtacccgcccctggccggcggatgcgcccgcgcggcgccgcgcgcgggactcccggctgccgcggggcctggccgggcgcggggcgctcgttatgattcgcgcccccctcgatgctggcgcgcccgcgccccgttagaccctctttgtgtttgtcgatgagcgcgctcgccgtggcggatttttgtatccgctgggtgccgcatt

SEQ ID NO: 58669 - DNA, 693 bp, Zea mays
  misc_feature: Ceres CLONE 1512462
  misc_feature: Encodes the peptide sequence at SEQ ID NO. 58670
  misc_feature (374)..(374): n is a, c, t, g, unknown, or other
  misc_feature (488)..(488): n is a, c, t, g, unknown, or other
  misc_feature (494)..(494): n is a, c, t, g, unknown, or other
  misc_feature (550)..(550): n is a, c, t, g, unknown, or other
ctggagctccccgcggtggcggccgctctagaactagtggatcccccgggctgcaggaattcgtctcacccctagaaaaatacactgaaaaaactaaatgatgcagaacgagcaaagaaggagctggagcaacaagagtactatgacccaagaattgctgacgaggagcgagaaaaaggtaatgagttctttaagcagcagaaatatccagaagcagtgaaacattacaccgaagctctcaggagaaaccccaaggaccccagggtatacagcaatagggctgcctgttacaccaagctaggggcccttcctgaaggtctgaaagatgctgagaagtgcattgagctagatcccacattctccaagggatacancaggaaaggtgctatccagtttttcatgaaagaatatgacaaagcgctggaaacttatcaagctggcctaaagcatgacccgaaaaaccaggagttacttgatggtgtaaggangtgtgntgaacagatcacccaggcgagcagaggcgaactcggtgaggaggactgaaaaaganccgaaccaagccatgcagaacctggaatccaaaacatcctgactgatccaatcatgcagcaagtttttacggatctgcaagaaaaaccttggggttgccaaggcccccttaaaacccccgggggggggccaaaaatcccaact

SEQ ID NO: 58670 - protein, 47 aa, Zea mays
  misc_feature: Ceres CLONE 1512462
  misc_feature (30)..(30): Xaa is any aa, unknown, or other
  misc_feature (32)..(32): Xaa is any aa, unknown, or other
MKEYDKALETYQAGLKHDPKNQELLDGVRXCXEQITQASRGELGEED

SEQ ID NO: 58671 - DNA, 694 bp, Zea mays
  misc_feature: Ceres CLONE 1512466
  misc_feature: Encodes the peptide sequence at SEQ ID NO. 58672
ggagctccccgcggtggcggccgctctagaactagtggatcccccgggctgcaggaattcgtctcacccctagaaaaaacggagcatcaccaccgcggcagctaatctcggccccaagattcagaatcaccgaggcgcggcgaggcgacggcggttggcgacatgatggcctcggtgcccagccgtgttgcgctctccgcggcgagccgcctcccgaatctccacgccgtggcaggagatagatctttcatttacaagagaagatgtccaagtctttcaattcctatggctctgtcagcagctgcgccaggcaaaggtggcggtgtgcttgatcggccagtagagaaaattactcctggtcgtcagtccgaatttgatgtgaagaaatcccgcaaaatgacccctccattccgcgtcatcctgcacaatgacaaccacaacaggcgtgagtatgttgtccaggtcctgatgaaagtgatccctgggatgaccgtcgacaacgcgttgaacatcatgcaggaggcgcatgtgaatgggtttgtcgtggggattgtctgttcccattccaaggctgaggagcactgcccgtccctcagggggcaacggccttccgaaactcgattcaaccctccaattggtggcctgcttacggttctaaaaaatgggtggcatcctggttttgccccaagaataa

SEQ ID NO: 58672 - protein, 176 aa, Zea mays
  misc_feature: Ceres CLONE 1512466
  misc_feature (76)..(151): Pfam Name: ClpS Pfam Description: ATP-dependent Clp protease adaptor protein ClpS
MASVPSRVALSAASRLPNLHAVAGDRSFIYKRRCPSLSIPMALSAAAPGKGGGVLDRPVEKITPGRQSEFDVKKSRKMTPPFRVILHNDNHNRREYVVQVLMKVIPGMTVDNALNIMQEAHVNGFVVGIVCSHSKAEEHCPSLRGQRPSETRFNPPIGGLLTVLKNGWHPGFAPRI

SEQ ID NO: 58673 - DNA, 662 bp, Zea mays
  misc_feature: Ceres CLONE 1512469
  misc_feature: Translation starting site: 190
  misc_feature (432)..(432): n is a, c, t, g, unknown, or other
  misc_feature (481)..(481): n is a, c, t, g, unknown, or other
tggagctccccgcggtggcggccgctctagaactagtggatcccccgggctgcaggaattcgtctcacccctagaaaaaccatctccactcgctagcactagcatagccgtctctttcttttctgcttccagacattgtccacgagctggtgcactggtgtcgctcgcaaccaaattaaggactgagccatggcatccaagggcgtcctcttcttggctctcaacctcctgttcttcacagtggccaacgcctgcggcagctgcccgaccccaacgcccccggtcgagccaccgccgccgcctcctgctaccccacccccttcatcctccagtgggaagtgcccgctgaacgcgctcaagttcggcgtgtgcgtcaatgcgctcggcctcgtcaaaggcgaggctggcaaggtaccagctgagccatgctgncacctcatcaaaagcttgcagacttcgaggccgccgtctgcctctgcancgccatcaagggcacgtcctcggcgtcgtcttcgatgtccctatcaaagtcatgccctcgtcactactgtggcaagtgcgtgcccagggctacatggtgcgtaagctcgcgcgttacccctcgaagcggtcccgtgctattaacatgccctgctggccaacatgtattggcccctgctatc

SEQ ID NO: 58674 - DNA, 504 bp, Zea mays
  misc_feature: Ceres CLONE 1512471
  misc_feature (318)..(318): n is a, c, t, g, unknown, or other
  misc_feature (326)..(326): n is a, c, t, g, unknown, or other
tccccgcggtggcggccgctctagaactagtggatcccccgggctgcaggaattcgtctcacccctagaaaaaattattatccacaacactcatcgatctacacacatacatagtttcttctactacacgacgacaaacatggggaagcctgcgaagatcggagagtggggtggatacgccggcgatcgtcgggatctgagggctactccggacggctgatcgaggtgaggtcacggcgacacagcagctgcatccgctcatctcctcatctacatcggagccgatggcaaaccgtacgaggaggggcatggggttcngccatgcntgcacgagtacagattgatctgtgcaggttcaacaaaagcttgaccgagatcttcgggaccacgggccccagcctacaacttggacatctgggccaagtcccccaaattccttacccaaaaaaaccccttttacggaccttaacgggagggaccaaggggccccccctttccggggac

SEQ ID NO: 58675 - DNA, 702 bp, Zea mays
  misc_feature: Ceres CLONE 1512472
  misc_feature: Translation starting site: 170
ctccccgcggtggcggccgctctagaactagtggatcccccgggctgcaggaattcgtctcacccctagaaaaagtccgcatttcaaactgggctccataaagttctgtcgcctcgcctgtgacctgtagggtagcagcaggtagcggagggggagagagagagaggggatggattctcaagcgccgcttcgtcctcctctagctttcgcctgcttcatcttcctttgctcatccttctgcgcagcaaatgagatgtacgacagggttggtgcggcggcgtcagatggggagagcaggaggatgcggctgcacaccgacgggagccgcggcgacgcgcacgcgtggcctgcgtacctctacacccgagcagttggaagatgccccccccaattctcccaccacggagccgagccctggccccacatccgccccaaggaagccgctggtggccaaaggggttccggtcctaggtccctggaagcgctacgaggccgcgccctcaccctgctgggaagctacccttgacggaccccccaatgcccggggggccatccccttcggtgcaaatctctttgacacccgtggaggccgccccccttgtctccaacacccttatttttagcggagggggcttcctcttttcgcatcccccgtggaggtgcacggccccccgccgcttttgtccccgccctccttttccc

SEQ ID NO: 58676 - DNA, 754 bp, Zea mays
  misc_feature: Ceres CLONE 1512474
  misc_feature (254)..(254): n is a, c, t, g, unknown, or other
  misc_feature (290)..(290): n is a, c, t, g, unknown, or other
  misc_feature (298)..(298): n is a, c, t, g, unknown, or other
  misc_feature (307)..(307): n is a, c, t, g, unknown, or other
  misc_feature (321)..(321): n is a, c, t, g, unknown, or other
  misc_feature (322)..(322): n is a, c, t, g, unknown, or other
  misc_feature (325)..(325): n is a, c, t, g, unknown, or other
  misc_feature (334)..(334): n is a, c, t, g, unknown, or other
  misc_feature (335)..(335): n is a, c, t, g, unknown, or other
  misc_feature (338)..(338): n is a, c, t, g, unknown, or other
  misc_feature (339)..(339): n is a, c, t, g, unknown, or other
  misc_feature (340)..(340): n is a, c, t, g, unknown, or other
  misc_feature (345)..(345): n is a, c, t, g, unknown, or other
  misc_feature (353)..(353): n is a, c, t, g, unknown, or other
  misc_feature (357)..(357): n is a, c, t, g, unknown, or other
  misc_feature (359)..(359): n is a, c, t, g, unknown, or other
  misc_feature (360)..(360): n is a, c, t, g, unknown, or other
  misc_feature (361)..(361): n is a, c, t, g, unknown, or other
  misc_feature (362)..(362): n is a, c, t, g, unknown, or other
  misc_feature (363)..(363): n is a, c, t, g, unknown, or other
  misc_feature (391)..(391): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
  misc_feature (445)..(445): n is a, c, t, g, unknown, or other
  misc_feature (447)..(447): n is a, c, t, g, unknown, or other
  misc_feature (450)..(450): n is a, c, t, g, unknown, or other
  misc_feature (452)..(452): n is a, c, t, g, unknown, or other
  misc_feature (454)..(454): n is a, c, t, g, unknown, or other
  misc_feature (455)..(455): n is a, c, t, g, unknown, or other
  misc_feature (456)..(456): n is a, c, t, g, unknown, or other
  misc_feature (457)..(457): n is a, c, t, g, unknown, or other
  misc_feature (458)..(458): n is a, c, t, g, unknown, or other
  misc_feature (462)..(462): n is a, c, t, g, unknown, or other
  misc_feature (463)..(463): n is a, c, t, g, unknown, or other
  misc_feature (466)..(466): n is a, c, t, g, unknown, or other
  misc_feature (470)..(470): n is a, c, t, g, unknown, or other
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
  misc_feature (481)..(481): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (510)..(510): n is a, c, t, g, unknown, or other
aaagctggagctccccgcggtggcggccgctctagactagtggatcccctgggctgcaggaattcgtctcacccctagaaaaaaactaacataaccagagcattctaccgtccgtcgtagcagcgatgatggctgtgacgtctctgcagttgcgcccaacccctcgtctccttccggcgagaaatagctccacgggcactgggccgcggatggccgccttgagctgcagacacaaccagtccaccagtgtccanggacgaacagggctccgaagccccgtaacgacgcgnagagaggngcgggcgtncgggccacccgcgnntgntgggcgcgnnggnnnggggnggccgggngcgncnnnnntataaggggggggggggggggggggganaattttgtttttttttttttcccccccccnnnaaannnnnngggnnnnnnnngnanganancnnnnncccnnggngggnttgggnnnntnggnnnggtgnnnngggctggggggaggancccacaacccccccaactgctgatactaccctccccgcccgaggaactcccacaaaagaaattgagaagacaaagactgcccctacctctcttccccacggcacccccacccccccccacatactcgctatttttccccccacgacctccacgaacaaacacccgcccccccaccgccgcgtcccccacttatgtatgcccgcaagagacaaagactgactaccgcccccgccacccacccccg

SEQ ID NO: 58677 - DNA, 613 bp, Zea mays
  misc_feature: Ceres CLONE 1512478
  misc_feature: Encodes the peptide sequence at SEQ ID NO. 58678
ggagctccccgcggtggcggccgctctagaactagtggatcccccgggctgcaggaattcgtctcacccctagaaaaaaacggcgccacggcggcgacgagaagtggcgagccccgagagcgggtttagttagaggctacgggcggtcgggcgcggcggcggcggcggccatgagcagcgggagcgagagcactaccgccagcaggtggcccgagctggccacgctgcgcgccctggcgcgcgacgccgcggagcagctgcggctgccgcgggccggcacgtcggcgtcggcgtcggcgtcgtcgtcgccgtggcgcgggcgcgaggaccacctccacggccacggcaagacggccaaggtgatgcacctgctgctctggggacccaagtgaagcggcgagaggccaccgtaccgccggcgttgctcgttttgctctgccctgcatccgccccgcacggactgtactgtactgtacctatacacctatatactacgacgtgcacatgtacgagtctacgacgtgctgctggacatactaatacaaagggctgcggtccctggcttctgcttggcagtgccccaccactcccctttttttgctcaacacgacgg

SEQ ID NO: 58678 - protein, 73 aa, Zea mays
  misc_feature: Ceres CLONE 1512478
MSSGSESTTASRWPELATLRALARDAAEQLRLPRAGTSASASASSSPWRGREDHLHGHGKTAKVMHLLLWGPK

SEQ ID NO: 58679 - DNA, 689 bp, Zea mays
  misc_feature: Ceres CLONE 1512482
  misc_feature: Encodes the peptide sequence at SEQ ID NO. 58680
  misc_feature (98)..(98): n is a, c, t, g, unknown, or other
  misc_feature (100)..(100): n is a, c, t, g, unknown, or other
ctccccgcggtggcggccgctctagaactagtggatccccctgggctgcaggaattcgtctcacccctagaaaaaaaaaaaaaaaaaaaaaaaaaaananaaaaaaaaaaaaaaaggcgagcgagagagacgcacatctatctgtcaagcgacgccgcggcctcgatcagagtcggaggcgaacacccccatggcggcggctggcggcggcgcaggagggaaggtatccttcaagatcatcctcacctccgaccccaagctccctttcaaagtgttcagcgtgcccgaggcggcgccctttaccgcggtgctcaagtacgccgcggaggagttcaaggtcccgccccagaccagcgccatcatcaccaacgatggaattggcatcaacccccagcaaagtgcaggcaacgtgtttctgaaacatggttcggagctgcgtctcatccctcgcgatagggttggagctgtagtcatgtcttccggttagaggatatatacagtccaatgcataatgagcaaaacttgagagaaataaagctttgatgttggccttgcttggctggaggatgttgttacaaggataataagccgaaccttaccgtacatgtcctcaagttgaaggcctctcggtttggatgggggagagatttcctgaaagggaatccaggtattcggaatccacttcaaaa

SEQ ID NO: 58680 - protein, 98 aa, Zea mays; identical to SEQ ID NO: 10858
  misc_feature: Ceres CLONE 1512482
  misc_feature (10)..(85): Pfam Name: UPF0185 Pfam Description: Uncharacterised protein family (UPF0185)

SEQ ID NO: 58681 - DNA, 689 bp, Zea mays
  misc_feature: Ceres CLONE 1512485
aagctggagctccccgcggtggcggccgctctagaactagtggatcccccgggctgcaggaattcgtctcacccctagaaaaaaattactattggacctccaaaatggcaaggtcctgaagaacaggacagccgatggtttgagccaatcaaatggaagaactttgctcatgttagcacagcacccatagagtacactgaaacaaatattacggacctatctggtgtttatattgttacaggagcacagttgggagtgtgggattttggtgcaaagagtgttctccaccttaaacttttgttctccagggttcctgggtgcacaattagaagatcagtgtgggaccacagcccatcaagttcctcggtacatagaacagatgaatcttcgtcatcctcaagtgataatgctaaacttctgaggatcgttgacctgacagaaacattcaagggccacaagatgcgcctggccattgcctgatcacaggtgctaaagtgggtgtccaaaaaggcaggattgttttccttccaaaagactcctattgaaattataacccagggttaaaacctttcatcccccccgaaattgaacccctggtgttttaagaaaaaaaaaaaaaaaaaccgggcccccccgaggaccccaattcccccctaaaggaggccaaataacccccccccccctgcccc

SEQ ID NO: 58682 - DNA, 602 bp, Zea mays
  misc_feature: Ceres CLONE 1512488
  misc_feature: Encodes the peptide sequence at SEQ ID NO. 58683
  misc_feature (407)..(407): n is a, c, t, g, unknown, or other
  misc_feature (410)..(410): n is a, c, t, g, unknown, or other
tccccgcggtggcggccgctctagaactagtggatcccccgggctgcaggaattcgtctcacccctagaaaaacagtgccgcgctgccccgcagcctcagccgcatggctctcctcgcctccccacgccgttcggcgctgcagccatccgccgccgcgtcgccccgcttcctctcatccctgcaggcggtcgcgccgccctgcacgtggcccctcgcgcgcccgcggcggggtctcgtccccgcacgcaagcggcggcctccaaggaacgcgggacgcaataaaccgcccccgggcggggtccccgggccccccaacgtggaaccaaggaaacccgcggaagacggggaaccgccgccccaaatgggaaagggccccccccccgggggggccgcggggggggcccancgnggtgttttttgcttgtgaccccccccccccccggaggaaagctcgaattttcctgggaagggggcccccaaaaggggcgggaccctccgctgtcttttttcccggcccacgccacggggggggggcccccccgcagcgatctaccttatcgcaatccaatttggcgatcggggcggcccacctaccgtcggg

SEQ ID NO: 58683 - protein, 93 aa, Zea mays
  misc_feature: Ceres CLONE 1512488
PRGGGRSRTSGSPGLQEFVSPLEKQCRAAPQPQPHGSPRLPTPFGAAAIRRRVAPLPLIPAGGRAALHVAPRAPAAGSRPRTQAAASKERGTQ

SEQ ID NO: 58684 - DNA, 718 bp, Zea mays
  misc_feature: Ceres CLONE 1512489
  misc_feature: Encodes the peptide sequence at SEQ ID NO. 58685
  misc_feature (384)..(384): n is a, c, t, g, unknown, or other
  misc_feature (385)..(385): n is a, c, t, g, unknown, or other
  misc_feature (386)..(386): n is a, c, t, g, unknown, or other
  misc_feature (389)..(389): n is a, c, t, g, unknown, or other
  misc_feature (398)..(398): n is a, c, t, g, unknown, or other
acagctggagctccccgcggtggcggccgctctagaactagtggatcccccgggctgcaggaattcgtctcacccctagaagaatcacaggcaacaaggcaccacacctcttcctcctcttcctcctcctagcacagctagcgcctgctccccttcgtctgtgatcatgtcttgcagcagcggcaagtgcaactgcggctccagctgctcctgcggcagctcatgcaactgcatgtcccctgacgtggagaccgccgccgccagcagcatcaagaccatggtcctcgctgcgccgaccaccaaggccagcgccggcggcttcaaggcggccaccgagggcggcggctgctactgcaacaccccccactggggggggggggttcnnnctnctcctgctncaccccccaacctgagccggtcccgtcccggcccggcgatggccccccaagaggttaaaagaacaacaaaccacgaggcctatagaaatataaaccgccgccgtcctaaatgtaatatctcggccaactggccccccccgttttttgcgacccatggggggccccgcctgggggtcccgcggttcatccgggcgaagacgggggccccccggatatgcggcgctcccccgggccgggaaaattaaacgccaagcgggcccagcgtaggtgctcggtatccctctggcgcggtcgcacaacaaaaaggcggaatcccgata

SEQ ID NO: 58685 - protein, 158 aa, Zea mays
  misc_feature: Ceres CLONE 1512489
  misc_feature (1)..(65): Pfam Name: Metallothio_2 Pfam Description: Metallothionein
  misc_feature (73)..(73): Xaa is any aa, unknown, or other
  misc_feature (74)..(74): Xaa is any aa, unknown, or other
  misc_feature (75)..(75): Xaa is any aa, unknown, or other
  misc_feature (78)..(78): Xaa is any aa, unknown, or other
MSCSSGKCNCGSSCSCGSSCNCMSPDVETAAASSIKTMVLAAPTTKASAGGFKAATEGGGCYCNTPHWGGGVXXXPAXPPNLSRSRPGPAMAPQEVKRTTNHEAYRNINRRRPKCNISANWPPPFFATHGGPRLGVPRFIRAKTGAPRICGAPPGREN

SEQ ID NO: 58686 - DNA, 718 bp, Zea mays
  misc_feature: Ceres CLONE 1512490
  misc_feature: Encodes the peptide sequence at SEQ ID NO. 58687
tccccgcggtggcggccgctctagaactagtggatcccccgggctgcaggaattcgtctcacccctagaaaaagagacaccgcgtgcgaaccaagcagaccccagcagaagaagcgaagtcgtcgccggagcaggaggaagagcgaggagcaacatgtcgtggcaggcgtacgtcgatgaccacctgctgtgcgacatcgaaggccagcacctcagcgccgccgccatcgtcggccacgacggcagcgtctgggcacagtccgagaacttccccgagttaaagcctgaggaggttgctgggatgataaaggacttcgatgaacctggaactcttgcaccaactggtctttttgttggaggtacgaagtacatggtgatccaaggtgaacctggagttcccatccgaggaaagaagggcactggaggcattactatcaagaaaactggcatgtccttgattatcggtatctatgatgagcccatgactccagggcaatgcaatatggtggtggagaggctcggccatttcctgatcgaaccggggcttccaagggggtgtttggttttgaggaatcccttccatccaaaaatgggggggggggcatcctgggattccatttccctccaaatttgggggggaaaggacacccattcccttcaaatattaggacccaaatccaaccttaactattaccggcaattggcggtgggaatgatg

SEQ ID NO: 58687 - protein, 188 aa, Zea mays
  misc_feature: Ceres CLONE 1512490
  misc_feature (2)..(126): Pfam Name: Profilin Pfam Description: Profilin
MSWQAYVDDHLLCDIEGQHLSAAAIVGHDGSVWAQSENFPELKPEEVAGMIKDFDEPGTLAPTGLFVGGTKYMVIQGEPGVPIRGKKGTGGITIKKTGMSLIIGIYDEPMTPGQCNMVVERLGHFLIEPGLPRGCLVLRNPFHPKMGGGASWDSISLQIWGGKDTHSLQILGPKSNLNYYRQLAVGMM

SEQ ID NO: 58688 - DNA, 693 bp, Zea mays
  misc_feature: Ceres CLONE 1512492
  misc_feature: Encodes the peptide sequence at SEQ ID NO. 58689
aagctggagctccccgcggtggcggccgctctagaactagtggatcccccgggctgcaggaattcgtctcacccctagaaaaaattccaaatccgcagtccgcagacgagagtggaagcggggcacacacagagaagccaatggcgctgtccctctccctcgcgcgccccgcgcccctcgccgtttccgccggcgcaggagccaggaagctacccgcagccagcctcgcattcccggcgaaatccttcttcggcgcgccgctggccgccaccgcggcctccgtcgcgtccccgctcccgcgcaagccggccacctccaccacctcgctcgaggacgacgcggcgggaaagaagggctacaagatgaacacccacaacgcgtcggcgaaccgtctcctggtgacggacacgggcaagatcttgcggaggtgcgcctggaagcaacacttgctctccaagaagaacaccaagcgcatgaagaggctctcgaatatggtgcatgtcaacaagactgactacgacaatgttacgggtgcactgccctacctcacagtgcataggagagcacactgagagctacgtggtctatcaaaatcattaagtttccttccacagattgtaattgtgtgtatcttccactgtactttcgtctcaaaatactgaggcatcatttcacagcagcaaaagactactc

SEQ ID NO: 58689 - protein, 143 aa, Zea mays
  misc_feature: Ceres CLONE 1512492
  misc_feature (75)..(133): Pfam Name: Ribosomal_L35p Pfam Description: Ribosomal protein L35
MALSLSLARPAPLAVSAGAGARKLPAASLAFPAKSFFGAPLAATAASVASPLPRKPATSTTSLEDDAAGKKGYKMNTHNASANRLLVTDTGKILRRCAWKQHLLSKKNTKRMKRLSNMVHVNKTDYDNVTGALPYLTVHRRAH

SEQ ID NO: 58690 - DNA, 699 bp, Zea mays
  misc_feature: Ceres CLONE 1512493
  misc_feature: Translation starting site: 213
  misc_feature: Pfam Name: FeThRed_A Pfam Description: Ferredoxin thioredoxin reductase variable alpha chain
  misc_feature (525)..(525): n is a, c, t, g, unknown, or other
  misc_feature (620)..(620): n is a, c, t, g, unknown, or other
  misc_feature (679)..(679): n is a, c, t, g, unknown, or other
  misc_feature (699)..(699): n is a, c, t, g, unknown, or other
tggagctccccgcggtggcggccgctctagaactagtggatcccccgggctgcaggaattcgtctcacccctagaaaaaaactcgcagtcgcagcgaccgtccgctcgcttccgcctttcgtttgccccgccgcctctatcctttcctcgactcccccgcacccaccacctgttcttcgacccagcaccggagcccccagtccacccacccaatggcgaccgccaccgcggccgtagcgccgccgtccacctccacctccacggtcctcctgcgccgccgcctcccttccccggcgcccgcgtccgccgccttcccccggctccccggcccgcccccgccgcgcctccccctcctccaggtcgcgctcaccagcgaggtgggcctcggacgacgtggcggccgaggaggccgcggccgcgcccaagatcggcaggcgggtgcgcgtcacggcgccgctccgcgtccaccacgtcatcaaggcgcccgacctggacgtccagggcatggagggcgtcgtcaagcangtacgtcggcgtgtggaagggcaagcgcgtcaccgccaacctgccctttcaggtcgaggtcccagctcgcgtcgagggcagccccagcccgtccnggtcttcgtcccacctccgtgaggacgagttcgagttcgtcaatgaggagtgatgtgancggcgtcagtcagagcgcgn

SEQ ID NO: 58691 - DNA, 662 bp, Zea mays
  misc_feature: Ceres CLONE 1512495
  misc_feature: Encodes the peptide sequence at SEQ ID NO. 58692
  misc_feature (388)..(388): n is a, c, t, g, unknown, or other
  misc_feature (576)..(576): n is a, c, t, g, unknown, or other
  misc_feature (589)..(589): n is a, c, t, g, unknown, or other
agctccccgcggtggcggccgctctagaactagtggatcccccgggctgcaggaattcgtctcacccctagaaaaaaaactgcccctcctccgccttttcgcctctctccactttccccgtccttcgccgtcgcggccgcgtcctagtctgatggccagccgctgggtccgacccgaggtgtacccgctgttcgcggcgatgggagttgccgttggcatctgcgggtttcagctcttccggaacatcaccggcaacccggaagtcagggtaaacaaggcagggagggcagccggcgtgcttgagaaccatgaggaggggaggcgttacgccatgcatggcctcagaagctttgtgcacgacaagacccccgagatcatgccagctatncacaagttctttactgaccccaagtgaagcaaagcagctttggttggccgctgatgacgatggttctgctactagttgcccttggggatggtgtacccttttttatgcaattcgatatgtgaatgagttcgacggtccctggtttgttcctcgaactcacctgtcatggggatttgatgccccttcantgataaacctgtncagcaaacgttcattcaagtggaattttttcaacctggttttgaaaggaaaaagtatttggaatttttccagg

SEQ ID NO: 58692 - protein, 87 aa, Zea mays
  misc_feature: Ceres CLONE 1512495
  misc_feature (2)..(88): Pfam Name: B12D Pfam Description: B12D protein
  misc_feature (79)..(79): Xaa is any aa, unknown, or other
MASRWVRPEVYPLFAAMGVAVGICGFQLFRNITGNPEVRVNKAGRAAGVLENHEEGRRYAMHGLRSFVHDKTPEIMPAXHKFFTDPK

SEQ ID NO: 58693 - DNA, 705 bp, Zea mays
  misc_feature: Ceres CLONE 1512496
  misc_feature: Encodes the peptide sequence at SEQ ID NO. 58694
  misc_feature (402)..(402): n is a, c, t, g, unknown, or other
gtggcggccgctctagaactagtggatcccccgggctgcaggaattcgtctcacccctagaaaaagtgtggccgcccgtgtcgtgtagtgtgtagtcgcagcagctagcgcccggccggccagtcgagtgagtccatcctccatcgccatccaatggccgccaccgccctgagcatgagcatcctccgcgcgccgccgccctgcttctcgtccccactcaggctcagggtcgcggttgccaagccgctggcggcccccatgcggcgccagctgctgcgcgcgcaggccacctacaacgtgaagctgatcacgccggagggggaggtggagcttcttgtcccccccccgccggggggggggggagtccccaagaagaaaggtatcaaccccccccgggggccnccccaggcggggaccgagaaacctcctggcgccggggaagggcgggccctgggctcccgtgggaccacgccctaaccgaaggtttccttccacggaccagaccgagggggcccagagcgggggggagacatgtcccgagcaggcccggtaccacgccccccagccccctccctccgcgcccccataggggcaggaagaaacccccctgataaggggggcgcgacgagtacgctgaagcagcgggggggccgctcggacccgggggagggagacggataggcgaaccgcacaccagtccgctcg

SEQ ID NO: 58694 - protein, 107 aa, Zea mays
  misc_feature: Ceres CLONE 1512496
MAATALSMSILRAPPPCFSSPLRLRVAVAKPLAAPMRRQLLRAQATYNVKLITPEGEVELLVPPPPGGGGVPKKKGINPPRGPPQAGTEKPPGAGEGRALGSRGTTP

SEQ ID NO: 58695 - DNA, 668 bp, Zea mays
  misc_feature: Ceres CLONE 1512498
  misc_feature: Encodes the peptide sequence at SEQ ID NO. 58696
ctccccgcggtggcggccgctctagaactagtggatcccccgggctgcaggaattcgtctcacccctagaaaaaaatcagatagagagagcatagtcgatcatgaagggtggcaagaaggaagtggccggtgcgatggtggccatactgctggttctgcagctcatggcagctccaccgacggccatggccgcccgctcgccgcacggagccgtgccggatggctccctcgccacgacgcccaaggtgacgatgctgtcggccacgctgtgctacacgggggagacatgcaaatacattggctgcctcactcctgcttgctcctgcaactatagtgatcgtctatgctacatcatatttactcctgttgcttgaggccattccgcgaagccacaactcttacaatatgcatgcgccggccgacgacgacgcgcgctgcctctcgtgagcttctgttcaagtgatgcatgtttcaaggcatccatggatgctttacgtatatgcgtattaaatagccgtgtcaggaaacccgaacgaagggggtgttgttttatatttaccttcttccgggggacaaataaaagcgaaaataaaatgttggaaggtttcaaatgcaaaaaaaaaaaaaaaaaccaaaccctcgaggaaccccaattccccccaaaaggg

SEQ ID NO: 58696 - protein, 90 aa, Zea mays
  misc_feature: Ceres CLONE 1512498
MKGGKKEVAGAMVAILLVLQLMAAPPTAMAARSPHGAVPDGSLATTPKVTMLSATLCYTGETCKYIGCLTPACSCNYSDRLCYIIFTPVA

SEQ ID NO: 58697 - DNA, 702 bp, Zea mays
  misc_feature: Ceres CLONE 1512500
  misc_feature: Encodes the peptide sequence at SEQ ID NO. 58698
  misc_feature (393)..(393): n is a, c, t, g, unknown, or other
  misc_feature (491)..(491): n is a, c, t, g, unknown, or other
  misc_feature (551)..(551): n is a, c, t, g, unknown, or other
ctccccgcggtggcggccgctctagaactagtggatcccccgggctgcaggaattcgtctcacccctagaaaaactccgaacagaacgcaggcaggcggcggcggagacaggatcaggttcctcgcagccggcgttaagtagggcggccgccctacatcgtcccacctgtaggtacgacactgcgccgcttgaaggaggctttgcggcgatggaccgggtcggcggcggcgaaaagcaactggaggattgcacagtagccaatgctctaggaacttggttcttctcagttgcgggtgctcttgtttgctattcctgtgggcataaagaagaaatccttagccccactcgtcttcttcggcactactggaaccatgctggacattatcatgggncatttacccagtgtgaagcgagagcatgcttgagcgggaaaatgaagatttttggaggccccagaaaattttttcccgtcgaatgcctttccacagcnaacgaagctctgattccttttgcagggctgacagtgaaacactttctccctgttttcctncacttggtaccctgggctttcccctctgggttaaaattaaaagttgttgctcaaaaaaaaaaaaaaacgagacgctcgaggtacccatttcgccccttaaaatgagtcctataccgcgcgctccacctgccgccttttttacaacgtctgg

SEQ ID NO: 58698 - protein, 148 aa, Zea mays
  misc_feature: Ceres CLONE 1512500
  misc_feature (62)..(62): Xaa is any aa, unknown, or other
MDRVGGGEKQLEDCTVANALGTWFFSVAGALVCYSCGHKEEILSPTRLLRHYWNHAGHYHGXFTQCEARACLSGKMKIFGGPRKFFPVECLSTANEALIPFAGLTVKHFLPVFLHLVPWAFPSGLKLKVVAQKKKKTRRSRYPFRPLK

SEQ ID NO: 58699 - DNA, 766 bp, Zea mays
  misc_feature: Ceres CLONE 1512502
  misc_feature (378)..(378): n is a, c, t, g, unknown, or other
tccccgcggtggcggccgctctagactagtggatcccccgggctgcaggaattcgtctcacccctagaaaaagcttgaccggttcggttgccaccaacgcgacccgcaaaatctcgtcgccgaccgccatggtagccgccgacttgtctcgtacgctgcttgctgtcatatccttcgcgcttaggtgcctgctggctcgagcacgtgggggcgcgggatactaatggtgactacaaccttaccatggaggtcgtatccgagctggttctttttccccttctggggcgatctctccgcgacgcatttttttctttcttgcgggtatctcgttatgtcatatttttttttccccccccccgggggggggggggggggggnttatttcattttcccccccaacccacccccactgtgggatttttcccccctcccgtttccgccgccaccttcgtcttactttcatataaacccggaagggggttcgtttttccgctgagtttgcccgcgcggtagaagagaaccacccggttatccaccccctttggcaatttctttttcgcctccccaccggtttggacagccccccatatttgtaactcgctcctgggcccgggcggctacggccgagggggtgcagatatttaatgttgtgagagtgtggacttccgcggaggggcaaaccgcgcctcccccccaaccttctctaatgacatgaaaaagcgccttctctgccgccgcccatgttaatcgcgcgtccattccgccg

SEQ ID NO: 58700 - DNA, 659 bp, Zea mays
  misc_feature: Ceres CLONE 1512504
  misc_feature: Encodes the peptide sequence at SEQ ID NO. 58701
  misc_feature (391)..(391): n is a, c, t, g, unknown, or other
  misc_feature (394)..(394): n is a, c, t, g, unknown, or other
  misc_feature (575)..(575): n is a, c, t, g, unknown, or other
ctggagctccccgcggtggcggccgctctagaactagtggatcccccgggctgcaggaattcgtctcacccctagaaaaaaccccaccgcagcacagcgccggcaaccgccgccatcgatcgatcgcccggaaactgacctctaccgatgtctggagccggcgaggaggataagaagcccgcggagggcggcgcccacatcaaccttaaggtcaagggacaggatggcaatgaggtgttctttcgcataaagaggtccacccagctgaagaagctgatgaacgcctattgcgaccgccagtctgtggacatgaatgccattgcattcctgtttgatggccgcaggcttcgcggcgagcagacccctgatgagctggagatgggagacggcnacnagatcgacgccatgcttcaccagaccggaggcagcgttcctagcaccacctaaaagcagcagctgcggagcctcgttttgctctccgccctgcgtagtactaaacaaaagggaaaagtctttttaaggaacttgtgatgctctggctccttgtgccatgctgagggacatccttagctttnattagtggtagggttgggactttgtctggcacactcggttatctatcccaaaaactgccgcctgtttggacttcaatgaccccc

SEQ ID NO: 58701 - protein, 99 aa, Zea mays
  misc_feature: Ceres CLONE 1512504
  misc_feature (21)..(91): Pfam Name: ubiquitin Pfam Description: Ubiquitin family
  misc_feature (82)..(82): Xaa is any aa, unknown, or other
  misc_feature (83)..(83): Xaa is any aa, unknown, or other
MSGAGEEDKKPAEGGAHINLKVKGQDGNEVFFRIKRSTQLKKLMNAYCDRQSVDMNAIAFLFDGRRLRGEQTPDELEMGDGXXIDAMLHQTGGSVPSTT

SEQ ID NO: 58702 - DNA, 617 bp, Zea mays
  misc_feature: Ceres CLONE 1512588
  misc_feature: Translation starting site: 162
  misc_feature: Pfam Name: B12D Pfam Description: B12D protein
aaagctggagctccccgcggtggcggccgctctagaactagtggatcccccgggctgcaggaattcgtctcacccctagaaaatccgccgtcgcctgtccactttccccgtgcttctccgccgtcgaggccgcgtcccagtgcgaagagaccacgactcagatggccagccgctgggtccggcccgaggtgtacccgctgttcgcggcaacgggcgtggccgtcggcatctgcggatttcagctcttccggaacatcaccggcaacccggaagtcagggtaaacaaggcaggggagggcagctggtgtgcttgagaaccatgaggagggggaggcgttacgccatgcatggcctaagaagctttgtgcacgacaagactcctgagatcatgcctgcagttaacaagttcttcactgacccctattgaaacatgttgattggcatactactactactacttgctactggggattttaccctttgctgggcactccatatgttggggaactccctgacctctaaaaaacctttggagggcttggggaagaccttgctattgttgaaggggggaaggggtttgaacccccatcgctgaaggtcaattcccccgggcaccg

SEQ ID NO: 58703 - DNA, 730 bp, Zea mays
  misc_feature: Ceres CLONE 1512591
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (247)..(247): n is a, c, t, g, unknown, or other
  misc_feature (248)..(248): n is a, c, t, g, unknown, or other
  misc_feature (249)..(249): n is a, c, t, g, unknown, or other
  misc_feature (250)..(250): n is a, c, t, g, unknown, or other
ttttnnnnnnnnnnnnnnnttttnnnnnnnnnnnnnnnnnntttgttnnntttcaagctggggctccccgcggtggcggccgctctagactagtggatcccccgggctgcaggaattcgtctcacccctagaaaaacagacacggacacagcaaccaacaagtcgtccaacgtccagggcttttctgtttttgtttctctctcacgcaagtcgcaaagcaaagcggtcccccaccatgggcttccannnngacgacgacggcatccaaacaactggggggcgtgttggctcgcgagttttcttggccctgcatggaactggcaggggggggccctggcccccccccccgggtttgggaaggacaaaaaacccggggttgccgtgccaaaataaaaaaaaagggccgtgggggagggggaccaccgggggcgcccccccccacacacaaggggggtttttaaaaaaaaacccccggtgtccccggaaaaaaaaaaaggggggggggggggggagaacttctccccggggggggggggggggggggccctttttgtttaaaaaacaaagtttttttatttttttttttttttaagaaggtgtggtgtgcccccccaaatttaaagggggccccctttttttttaccccccccccgtctttttccctccccccccccccctttggggggtgtttattaaagggtgggggtgtttttttttttaataagagaaa

SEQ ID NO: 58704 - DNA, 820 bp, Zea mays
  misc_feature: Ceres CLONE 1512608
  misc_feature: Encodes the peptide sequence at SEQ ID NO. 58705
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (33)..(33): n is a, c, t, g, unknown, or other
  misc_feature (34)..(34): n is a, c, t, g, unknown, or other
  misc_feature (36)..(36): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
nnnnnnnnnnnnnnnnnnnnccccccacccccnntnttttggggnnnnnccacagctggagctccaccgcggtggcggccgctctagaactagtggatcccccgggctgcaggaattcgtctcacccctagaaaaactttctcgagcctgacccttacgccttcgctcgcgccgccgccgccgccgccgctacgccccgcacctcgcttcatttcgtgtcgccaagatgacgaagcgcactaagaaggcaggaattgttggcaaatatggaaccaggtatggtgctagcttgcgtaagcaaatcaagaagatggaggtatctcagcattccaagtacttttgcgagttctgtgggaagtttgctgtgaagaggaaagcagttggaatttgggggtgcaaggactgtggggaaggtgaaggctcggtggtgggtgggcgggggagccctgcttagtgcggtcaccgcccaggagccacaatccggccgccctgaggggaggcaggacgggagggcatggctatagaccttcttttatatttgagtggggggttttccctggtagttagccgccttgggccagggcattgttgggggggggggctcttggtccttgggcggaaacatggtgggcaacccaccggtctcctgggctcgctttgttgcccgacaaccaaaggcctccccttacgtgtgtgggggttcgacgcgcgcccacggacccccccgccggccggcgggcacagacgccggcctccacgcccgcgctgtgttccttatgcgtcattcccccatgatccaaaaacggacccttgtcctcag

SEQ ID NO: 58705 - protein, 75 aa, Zea mays
  misc_feature: Ceres CLONE 1512608
  misc_feature (2)..(75): Pfam Name: Ribosomal_L37ae Pfam Description: Ribosomal L37ae protein family
MTKRTKKAGIVGKYGTRYGASLRKQIKKMEVSQHSKYFCEFCGKFAVKRKAVGIWGCKDCGEGEGSVVGGRGSPA

SEQ ID NO: 58706 - DNA, 729 bp, Zea mays
  misc_feature: Ceres CLONE 1512609
  misc_feature: Encodes the peptide sequence at SEQ ID NO. 58707
aaagctggagctccccgcggtggcggccgctctagaactagtggatcccccgggctgcaggaattcgtctcacccctagaaaaatcccgaatccccaaagcctccgacccccttcctctctccctccgccgccgctgcgcacgcagggaacaagcgacatgggcgtctacaccttcgtgtgccgcaacaacggcggcgagtggaccgccaagcagcactccggcgagatcgaggcttccgccgctaccccatacgagctgcagcgccgcctcgttcgccgctgcctcccgcgggccgactcctggccttacgggggtcccagtacccttcccctttctcccaatagagcaccaccccccgaaggtcctttcccccctgttgttcccgcggggtataatacatccccctttatgctttttttttttggtggggggggggggagaagagaataataattgttttgtataaaaagagaaaaaatactaagaaaacccaccttaattatagcaaccaaacaaacaactctttacagtctacgccgacacccaacttgttacatcaataaaaacaccctaatactatggttttagtgtggcggagaaaactaactcaaagcagtgtggaacccctacgttatattttgatctgcccctgcgcctcagcgaacaccccctacgcttcgcaggcgcggtgcgcgttatcgcttctcggcccaccccgacccctccc

SEQ ID NO: 58707 - protein, 97 aa, Zea mays
  misc_feature: Ceres CLONE 1512609
MGVYTFVCRNNGGEWTAKQHSGEIEASAATPYELQRRLVRRCLPRADSWPYGGPSTLPLSPNRAPPPEGPFPPVVPAGYNTSPFMLFFFGGGGGRRE

SEQ ID NO: 58708 - DNA, 663 bp, Zea mays
  misc_feature: Ceres CLONE 1512612
  misc_feature: Encodes the peptide sequence at SEQ ID NO. 58709
tccccgcggtggcggccgctctagaactagtggatcccccgggctgcaggaattcgtctcacccctagaaaaacctgacgctcgacgcctctcctcctctcctcccccacccgtccatcgcccctccctccggtctgcgctcccacagcctcacccctgcgcccccgccgattcgcgtcgccctttgttggaaggaacgatggagcagaccttcatcatgatcaagcccgacggcgtccagcggggcctgatcggggacatcatcagtcgcttcgagaagaaagggttctacctcaaggggatgaagttcatgaacgtggagaggtccttcgcgcagcagcactacgctgacctttccgacaagcctttcttccccgggttggtggagtacatcatttcccgccccgtggtggcaatggtgtgggaggggaaggacgtcgtgttgactggccgcaggatcattggggccaccaggccttgggaggcagcccccggtacctttcgtgggggactaccccgtggaagtcggcaggaattggcatccatggaaagcgactccgtggaagaacgggaaaaaagagatcgctcctctggttcccctgaaggggtggcccacgtgaagaaacaaccttccttccctggaatctaccaagggttggaccg

SEQ ID NO: 58709 - protein, 154 aa, Zea mays
  misc_feature: Ceres CLONE 1512612
  misc_feature (2)..(128): Pfam Name: NDK Pfam Description: Nucleoside diphosphate kinase
  misc_feature: SWISSPROT Homolog: EC 2.7.4.6 Nucleoside-diphosphate kinase
MEQTFIMIKPDGVQRGLIGDIISRFEKKGFYLKGMKFMNVERSFAQQHYADLSDKPFFPGLVEYIISRPVVAMVWEGKDVVLTGRRIIGATRPWEAAPGTFRGGLPRGSRQELASMESDSVEEREKRDRSSGSPEGVAHVKKQPSFPGIYQGLD

SEQ ID NO: 58710 - DNA, 782 bp, Zea mays
  misc_feature: Ceres CLONE 1512614
  misc_feature: Encodes the peptide sequence at SEQ ID NO. 58711
  misc_feature (1)..(1): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (26)..(26): n is a, c, t, g, unknown, or other
  misc_feature (35)..(35): n is a, c, t, g, unknown, or other
  misc_feature (44)..(44): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
ntttttttnnnnnnnnnnnntttttngggtgtggnccctctttnttttttaaaaatnnnactcaccgcggtggcggccgctctatactagtggatcccccgggctgcaggaattcgtctcacccctagaaaaaataccgaccttgcattttctcaataccttgagcacctaagcaagtccaatgtctcatgcccagccccttcgtttacaggcccagtggaaacacgtcgatattcaggataaccaagccaatgctatgaaggaaccaggaaccagtggtgggtatggctccccaatgaaagatgacaagaacaaggatgtggatacaatagcttcgaacttcatcaagcttaagcacagggcttgggcacttccagaagagcacaaccatgtaccaaccttccactttaaggtgttgctagtccaatagggcaggactatatacttatgctcggtctctatatagcctattaggtcctagttcaaattaacaaaaggctgcttgccagccctggatattttggggaggggaaaaacattggtttaaacccttagtggatcaggaaaatgattggtaatttttcctggaggtggtgttaatttatgggaggaactattacgtgggaccacaactgaggccaggtaagttaattgtaatgaagaaaagaaaagaaagataggcggtgtgtacctttcacaactataccccaagatttccccaccctaccacactcagttcccaggtttcccctgcgccggctcaaacttgatctcctattttt

SEQ ID NO: 58711 - protein, 82 aa, Zea mays
  misc_feature: Ceres CLONE 1512614
MSHAQPLRLQAQWKHVDIQDNQANAMKEPGTSGGYGSPMKDDKNKDVDTIASNFIKLKHRAWALPEEHNHVPTFHFKVLLVQ

SEQ ID NO: 58712 - DNA, 617 bp, Zea mays
  misc_feature: Ceres CLONE 1512620
  misc_feature: The sequence is a functional homolog of SEQ ID NO 1496 in the 10/374,780 US patent application
  misc_feature: The sequence is a functional homolog of SEQ ID NO 1566 in the 10/412,699 US patent application
  misc_feature: The sequence is a functional homolog of SEQ ID NO 1492 in the 10/374,780 US patent application
  misc_feature: The sequence is a functional homolog of SEQ ID NO 1562 in the 10/412,699 US patent application
  misc_feature: The sequence is a functional homolog of SEQ ID NO 1792 in the 10/412,699 US patent application
  misc_feature: The sequence is a functional homolog of SEQ ID NO 2030 in the 10/374,780 US patent application
  misc_feature: The sequence is a functional homolog of SEQ ID NO 206 in the 10/225,068 US patent application
  misc_feature: The sequence is a functional homolog of SEQ ID NO 356 in the 10/412,699 US patent application
  misc_feature: The sequence is a functional homolog of SEQ ID NO 831 in the 11/479,226 US patent application
  misc_feature: The sequence is a functional homolog of SEQ ID NO 934 in the 11/435,388 US patent application
  misc_feature: The sequence is a functional homolog of SEQ ID NO 1794 in the 10/412,699 US patent application
  misc_feature: The sequence is a functional homolog of SEQ ID NO 2032 in the 10/374,780 US patent application
  misc_feature: The sequence is a functional homolog of SEQ ID NO 380 in the 10/412,699 US patent application
  misc_feature: The sequence is a functional homolog of SEQ ID NO 534 in the 10/225,066 US patent application
  misc_feature: The sequence is a functional homolog of SEQ ID NO 936 in the 11/435,388 US patent application
  misc_feature: The sequence is a functional homolog of SEQ ID NO 1878 in the 10/412,699 US patent application
  misc_feature: The sequence is a functional homolog of SEQ ID NO 2138 in the 10/374,780 US patent application
  misc_feature: The sequence is a functional homolog of SEQ ID NO 372 in the 10/225,066 US patent application
  misc_feature: The sequence is a functional homolog of SEQ ID NO 878 in the 11/435,388 US patent application
  misc_feature: The sequence is a functional homolog of SEQ ID NO 1788 in the 10/412,699 US patent application
  misc_feature: The sequence is a functional homolog of SEQ ID NO 2026 in the 10/374,780 US patent application
  misc_feature: The sequence is a functional homolog of SEQ ID NO 354 in the 10/412,699 US patent application
  misc_feature: The sequence is a functional homolog of SEQ ID NO 823 in the 11/479,226 US patent application
  misc_feature: The sequence is a functional homolog of SEQ ID NO 930 in the 11/435,388 US patent application
tggagctccccgcggtggcggccgctctagaactagtggatcccccgggctgcaggaattcgtctcacccctagaaaaatattcacggtcacaggtgttgctgcaaatgctgatgtgttgcatatactttcaggagtgtggaatacacctgactaaaagtgcttcctatggcttgggtgttttctcccatctgaccttttaaagctcctagcgaatcacctcgagcctctaactgagcacaaaatgctgggtttgaccaacctccagcaatcttcccaacaagcagacgatgcgttgtctcaggtcatgcaacctctgctccaatctttggcagatactttggctggatctctcgctcacgcaggttcttcaggaaatgtggcaaactacatgggtcagatggccatggacatgggcaatctcggtacactagagaattttcttcgtcaagacgacaacctgcgacagcatacgttgcatcaaatgcatcgtatcctaacgatccgacaggcttctcgtgctcttcttgcaatccacgactatttttcacgattgcccgcttcaaatctctgtggtttcctacgcccctgataaaaatgggcctcagtattttaatt

SEQ ID NO: 58713 - DNA, 900 bp, Zea mays
  misc_feature: Ceres CLONE 1512643
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (44)..(44): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (69)..(69): n is a, c, t, g, unknown, or other
  misc_feature (900)..(900): n is a, c, t, g, unknown, or other
ttttttttttttttttttnnnnnnnnccccccnnnnaagcgttntnnnngaaacgtcgatctccccccnttggcggccgctctagaactagtggatcccccgggctgcaggaattcgtctcacccctagaaaaacgcaaacatcgaatcgtctcactcgtgtctgccctgctcatactgcttgccctccccgtatccgtccacccgcaacgcacaggaggattcgttggcccacaacaccgggacgttggtggcgcgcctccacgaaccgccgtagtaccaaaacgaacttcaccccccgaacttagccgccttcgcctcccatcatctcctctttccccccccttgtgggttcttggggcttccctaacccttttttatctcttatttttctgtggttttcctgcccaaaatttttttttttcccccccccccagaggggggggagggggggggtgcccccctttcttctctcccttccttcccccgttcttcctgtttgtctgtctaagtaattaacactttcccccctgcccctccccctctccctccctcccaaccaccactcctgactgcaagttcaggcgccgccccccacccttaacatctaccccccccttctttcccttcttcctcctcccccctctcccgccttcacccagccgcccgcccttgtctgtgccgtgtcctcccctcccactcttcattctttcccgccccctctcgcgctcctcccccgctcctgcgcctcctcctcgctctcctcccctccacccctctctccccccccctccctctcgctccctctcccttcctcctcctctcccttccctccccctatcacacaccctccacccactcaccacccaccaccctctctccccctccacaccaataatan

SEQ ID NO: 58714 - DNA, 824 bp, Zea mays
  misc_feature: Ceres CLONE 1512645
  misc_feature (8)..(8): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (23)..(23): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (39)..(39): n is a, c, t, g, unknown, or other
  misc_feature (41)..(41): n is a, c, t, g, unknown, or other
  misc_feature (42)..(42): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (52)..(52): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
tttttttntnnnnnnnnnnnttnttnnnntttnnnnntntnnccnnnggggntggggtttnnnnnnnntccaaagctggactccaccgcggtggcggccgctctagaactagtggatcccccgggctgcaggaattcgtctcacccctagaaaaaaagtgtccaatgcacgaactgatataagaaaccctagcggagccactaacacagtcgcctccttcctgcgccgccgccgccgccgccgctaccaccgcctcgcggccgcctgcggctccgcgtttccgcacggaattgggtgaaggtttcttgaggctgagaacatggtgctaaagacggaacttttgcccgctttcgcgggcaagaagttttttcccgggaaaaggcattaaaatttatcccgggctgatttctcaggggctttcccttttttgcccaacctccaaatggggaaaggcttttcttttccccaaaaacgcgcctgaaacccccgggaaaagtttttccctgggaacccccattttgttacgtggaaagccccccccccaaaaaaagggggattccccccgcggcggaaaaaggcggtaaaaaaaaaaaaaaggccccccccccccccccccccaaaaaaaacccctatcccccccgggggtaatttttggggggggcgccctctccttcggggagaaggatacccccccaaaaaaaaaaaagaaagttgtaaaaaataaccagagaggcccccccaaagagtgtattaaaagaaaaaaaccctttccttccgtaaaaaaaacagaggggccctcttttcaaaaaacaccggggtggtaa

SEQ ID NO: 58715 - DNA, 681 bp, Zea mays
  misc_feature: Ceres CLONE 1512667
  misc_feature: Encodes the peptide sequence at SEQ ID NO. 58716
tggagctccccgcggtggcggccgctctagaactagtggatcccccgggctgcaggaattcgtctcacccctagaaaaaactcactctccccccacccgcgccaggccagacagactaactgagcacccgctgcaaggagtccgcgcccatggcgagcaccaacttggcgtcggccacctcgcggttcatgctggccgcgggcgtgcccacaggcagctgcggcggccgcgtaaagttctcctcggtgcccaaccggcttgccaggaggctcgtggcccgggccgacaacgaggccgccactgctgacgcgtcataaggagagggtgccttgacctccaagcccaacgccgagaatccgccgccaatcgcctccaagaggggcgccaaggtgaatatccttaagagggagtcctactggtacaacgggatcggcaacctcttcactctccatcatgatcccaacacccgctacccggtggatgttcggctaaacagggtgaactactccgggcgtgtccaccaacaactacaccctgaaagaacgtcttagacccgaaattagtgggtccggccagactcaagggctcccacgttaatataccgctgtgaattgaatttggaaccagttgggaaaaagaaggcttgtaaaaccttccatgcctgggcctgtggtggcgctc

SEQ ID NO: 58716 - protein, 55 aa, Zea mays
  misc_feature: Ceres CLONE 1512667
MASTNLASATSRFMLAAGVPTGSCGGRVKFSSVPNRLARRLVARADNEAATADAS

SEQ ID NO: 58717 - DNA, 667 bp, Zea mays
  misc_feature: Ceres CLONE 1512668
  misc_feature: Encodes the peptide sequence at SEQ ID NO. 58718
  misc_feature (493)..(493): n is a, c, t, g, unknown, or other
  misc_feature (560)..(560): n is a, c, t, g, unknown, or other
  misc_feature (627)..(627): n is a, c, t, g, unknown, or other
aaagctggagctccccgcggtggcggccgctctagaactagtggatcccccgggctgcaggaattcgtctcacccctagaaaaagtgctctctcagaggtgggctggcttctcctccccctcttaccaagtcctcttcgggttagggttacttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtcccgtggcggtggcgatggcggcggtggctacggcggcggtcgcggcggcggcggctatggtggncggcgccgtgacggcggttatggcggcggtggcggctacggcggtcggcgcgagggtggtggcggcngctacggaggcggtggcggctaccgcggtcggcccgagggtgggtggtgcggctaccggcggcggcngcggcggcttgaagggactgatgtgtgggccccatcttgg

SEQ ID NO: 58718 - protein, 165 aa, Zea mays
  misc_feature: Ceres CLONE 1512668
  misc_feature (10)..(81): Pfam Name: RRM_1 Pfam Description: RNA recognition motif. (a.k.a. RRM, RBD, or RNP domain)
  misc_feature (48)..(141): Pfam Name: GRP Pfam Description: Glycine rich protein family
  misc_feature: SWISSPROT Homolog: EC 5.2.1.8 Peptidylprolyl isomerase
  misc_feature (130)..(130): Xaa is any aa, unknown, or other
  misc_feature (152)..(152): Xaa is any aa, unknown, or other
MAAADVEYRCFVGGLAWATSNESLENAFASYGEILDSKVITDRETGRSRGFGFVTFSSENSMLDAIENMNGKELDGRNITVNQAQSRGGGDGGGGYGGGRGGGGYGGRRRDGGYGGGGGYGGRREGGGGXYGGGGGYRGRPEGGWCGYRRRXRRLEGTDVWAPSW

SEQ ID NO: 58719 - DNA, 685 bp, Zea mays
  misc_feature: Ceres CLONE 1512682
  misc_feature: Encodes the peptide sequence at SEQ ID NO. 58720
  misc_feature (685)..(685): n is a, c, t, g, unknown, or other
ctccccgcggtggcggccgctctagaactagtggatcccccgggctgcaggaattcgtctcacccctagaaaaacctagaaaaaaatctggaaaatttgatgcaattctgtgcattggagctgtgattagaggtgacacaacccactatgatgccgttgcaaactcagctgcatcaggtgtactcaatgctggattatctgctggtgttccttgtgtatttggtgttctaacctgtgaagacatggatcaggcactgaaccgtgctggtggcaaggctggaaacaaaggagctgaagctgctcttactgccattgagatggcctcgctgttccggcatcacttaggctgacaccttgtgtattctgattttctatacacgaggcggcagcatttccctcctatcaagagttttggctaatagagagcttttccccccgcggctagtataatttattttccaagtctgttgggcccggagcggaattggttgctttcctttctaaaaaaccctgaaaagcctcacaagaacatttctgtaaaggtaaaccctgacccccttgaattaatttgccgcccccaaaacaaaaatttgggccatgaaaaaaaaaaatcccccttattgtttttttttccctttttgttttaccccaaaaaaaaaaaaaaaaaaacccaaacaccctcccn

SEQ ID NO: 58720 - protein, 115 aa, Zea mays
  misc_feature: Ceres CLONE 1512682
  misc_feature (2)..(113): Pfam Name: DMRL_synthase Pfam Description: 6,7-dimethyl-8-ribityllumazine synthase
  misc_feature: SWISSPROT Homolog: EC 2.5.1.9 Riboflavin synthase
PRGGGRSRTSGSPGLQEFVSPLEKPRKKSGKFDAILCIGAVIRGDTTHYDAVANSAASGVLNAGLSAGVPCVFGVLTCEDMDQALNRAGGKAGNKGAEAALTAIEMASLFRHHLG

SEQ ID NO: 58721 - DNA, 612 bp, Zea mays
  misc_feature: Ceres CLONE 1512689
  misc_feature: Encodes the peptide sequence at SEQ ID NO. 58722
  misc_feature (73)..(73): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (612)..(612): n is a, c, t, g, unknown, or other
attctggagctcccgcggtggcggccgctctagaatagtggatcccccgggctgcaggaattcgtctcacccnctagaaaaagacaacgtacgtaagtcatgctgggggacttgagcagcgagcgccacagatcccgatcctgaagcctccgagtgagttcttccgtcctcctcgcagtcagccatggcccgctcctcctcgcagtcgcagtcctccgtcggtggcggcggcggcggcggccgctttcccatcccttggagaccgcatgtaccatcttgcagattggcgtcggaggtaccgaagacgcggctcacctgccagctcgggtgccatggtgatggccttcccccacgatgtgaaccgccgagacgaccagttgtttggggactagctctggcgtataatagaaannngacaagtcgaaaacagcaccaccaccccctaattattcctgtgacccgattaaaagggaggagcagcgcccgcccccaataaatgatacaagggggtggccaccacagaatgatatgcggggttgtgtaggaaaatctctagaaaaccggggtttatccagtccgccgttagactaagagcgggggggcacattcaan

SEQ ID NO: 58722 - protein, 103 aa, Zea mays
  misc_feature: Ceres CLONE 1512689
  misc_feature (76)..(76): Xaa is any aa, unknown, or other
  misc_feature (77)..(77): Xaa is any aa, unknown, or other
MARSSSQSQSSVGGGGGGGRFPIPWRPHVPSCRLASEVPKTRLTCQLGCHGDGLPPRCEPPRRPVVWGLALAYNRXXTSRKQHHHPLIIPVTRLKGRSSARPQ

SEQ ID NO: 58723 - DNA, 676 bp, Zea mays
  misc_feature: Ceres CLONE 1512694
  misc_feature: Encodes the peptide sequence at SEQ ID NO. 58724
aaagctggagctccccgcggtggcggccgctctagaactagtggatcccccgggctgcaggaattcgtctcacccctagaaaaatcaagccacctacaccaccaccccgccggccacactcgtctttctcacgagccacaggcacaggcaggctctcgagctcagtccacccatcgcaggggatggcgtcgtcgttcgccgtggcaacggtcccgtcgctggcggccccggcggccaagaagcggtccggcggcgtcacgtacgtggagggcatgaacgcctacagcggcctcaaggggctcaacaaggtgaacatgctcggggtgcgcaagaccgccgactactccttcgccaaggtcgtggcgtcgctcagccccgcgggcaggaagcggcgcggcggcgcgttcggcgcccagatgaacgccgccgccgagatcttcaggatcgccgccaccatgaacggcctcgtgctcgtcggcgtcgccgtcgggttcgtgctgctccgggtggaggccgccgtcgaggagtcccagttaggtgcgtgggcctgccactggcggctgtcgccccgggccgcattctgcttcagaaaacgtgatatatataaccagaatgtacgcttttcgattcaatttaactttgggtatgtatccctggacaattggggaattactgg

SEQ ID NO: 58724 - protein, 164 aa, Zea mays
  misc_feature: Ceres CLONE 1512694
  misc_feature (79)..(115): Pfam Name: PetM Pfam Description: PetM family of cytochrome b6f complex subunit 7
MASSFAVATVPSLAAPAAKKRSGGVTYVEGMNAYSGLKGLNKVNMLGVRKTADYSFAKVVASLSPAGRKRRGGAFGAQMNAAAEIFRIAATMNGLVLVGVAVGFVLLRVEAAVEESQLGAWACHWRLSPRAAFCFRKRDIYNQNVRFSIQFNFGYVSLDNWGIT

SEQ ID NO: 58725 - DNA, 674 bp, Zea mays
  misc_feature: Ceres CLONE 1512707
  misc_feature: Translation starting site: 140
  misc_feature (674)..(674): n is a, c, t, g, unknown, or other
aagctggagctccaccgcggtggcggccgctctagaactagtggatcccccgggctgcaggaattcgtctcacccctagaaaactagccgcatcccttctttcattcgccgccgccgcctgctctctgctgccgtcgccatggggagaaggcctgcgagatgctatcgccagatcaagaacaagccataccccaagtccaggtactgccgtggtgtccctgaccccaagatcaggatctacgatgttggcatgaagagaaagggtgttgatgagttcccctactgtgtgcaccttgtctcttgggagaaggagaatgtctccagtgaggctcttgaggctgcccgtattgcctgcaacaagtacatgaccaagtctgcaggaaaggatgccttccacctttcgggtccgggttcacccccttccatgtccttcgtatcaacaagatgctttcgtgtgctggggctgataggctccagactggaatgaggggtgccctttggcaagcctcagggcacctgtgctagggtggaacattggtcaggtccctccttttctgttcaatgcaaggacaacaatgctgcacttgccagtgaaaactctccgtcccccccaagttcaagtttccctggccgcccaaaaaattattggagaacccaaaagggggggccttccn

SEQ ID NO: 58726 - DNA, 527 bp, Zea mays
  misc_feature: Ceres CLONE 1512719
  misc_feature: Encodes the peptide sequence at SEQ ID NO. 58727
tccccgcggtggcggccgctctagaactagtggatcccccgggctgcaggaattcgtctcacccctagaaaaaattcctcggagagggagaagccgccttggtagctgtcacagcagcctcggagaaagcccagttccgacaagatgcagatcttcgtgcaagacgctgacaggaaagaccatcaccctcaaggtctataggggcgacaccatcgagctatgtctaggccaacatccaggacatggaagggatcccgccggaccagcaccagctgatctttgccgggaagcagctggaggatggccacatccttgcggactatccatccaggatgagtctacgcatcgcctcgtgcttacgctccgcggtggcatcattgagccctcgctgtaggtgctcggtcgcaagttcaacctggacaagaagatctggcgaaatgctatgcacaactgcacccatggctgtcacttgcggaacaagaaaggggtctcagctcccaaggaggccaggagaaaatcattacttc

SEQ ID NO: 58727 - protein, 95 aa, Zea mays
  misc_feature: Ceres CLONE 1512719
MEGIPPDQHQLIFAGKQLEDGHILADYPSRMSLRIASCLRSAVASLSPRCRCSVASSTWTRRSGEMLCTTAPMAVTCGTRKGSQLPRRPGENHYF

SEQ ID NO: 58728 - DNA, 600 bp, Zea mays
  misc_feature: Ceres CLONE 1512731
  misc_feature: Encodes the peptide sequence at SEQ ID NO. 58729
tccccgcggtggcggccgctctagaactagtggatcccccgggctgcaggaattcgtctcacccctagaaaaattttaatagtcatttcactgggtttggtcaatgattgtatgatttgttgattggtagccaatgcttcaagagctaggtaaacaaaacccacaaattctgcggttgattcaggaaaatcaagctgagtttctccgcttggtgaatgaatctcctgagggtggtcctggagggaacatactaggtcaactggcagctgctgtgccacaaacgctgacagttaccccagaggaacgggaggctatccagcggctcgagggaatggggttcaaccgtgagcttgtgctagaagttttctttgcatgcaacaaggacgaagagcttacagccaactaccttctggatcatggccatgagtttgacgagcagcagcaatagacgtggggtggatggaggaaaccgaggcagttgcagaacagcgagtgtcgttcttatgctatgctgctgactatcttttatttccatatatatttgttcggaatgctttctaagtacatattaattcaatatcaagcgtttcaccgtgtatg

SEQ ID NO: 58729 - protein, 104 aa, Zea mays
  misc_feature: Ceres CLONE 1512731
  misc_feature (56)..(92): Pfam Name: UBA Pfam Description: UBA/TS-N domain
MLQELGKQNPQILRLIQENQAEFLRLVNESPEGGPGGNILGQLAAAVPQTLTVTPEEREAIQRLEGMGFNRELVLEVFFACNKDEELTANYLLDHGHEFDEQQQ

SEQ ID NO: 58730 - DNA, 749 bp, Zea mays
  misc_feature: Ceres CLONE 1512744
  misc_feature: Encodes the peptide sequence at SEQ ID NO. 58731
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (50)..(50): n is a, c, t, g, unknown, or other
  misc_feature (51)..(51): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
nnnttttnnnnnnnnnnnnnnnnnnnnnnnnnntttttttnnnnnntttnntnnnnnnnnccccnnnnnnnnnnnnggtctnnnnttccaagctgggactccccgcggtggcggccgctctagaactagtggatcccccgggctgcaggaattcgtctcacccctagaaaaagttttccgcatccacggagccaggcgaccgccgccgcttccctactcacccttggccggcgacgacgagcgccaccacggcaggatgacgacgctgaggaacctcaagatcaagacgtcgacgtgcaagaggatcgtgaaggagctgcgctcgtacgagaaggaggtggagaaggaggcggccaagaccgccgacatgaaggagaagggcgctgatccctacgacctcaaacagcaggagaatgttttggctgagtcaaggatgatggtcccagactgccacaaacgacttgaaactgcactggctgacttgaaagcaacactggctgaactgaaggagtcaaatgagcaaggtgccgagattggagaagctgagagcccaatcgcagaagttgaagcagttgtcaagcccgcagaagattaaactaaaaaaactcttgggtttgctgaactgttaaccgcacatcctatttttcgcatatggaggcccttgtggagccttattaccaagaatgttttgagggcgtgtaaatcccctgtacccagtttaatccccccctttcctaatctttggaaaa

SEQ ID NO: 58731 - protein, 112 aa, Zea mays
  misc_feature: Ceres CLONE 1512744
  misc_feature (6)..(99): Pfam Name: TBCA Pfam Description: Tubulin binding cofactor A
MTTLRNLKIKTSTCKRIVKELRSYEKEVEKEAAKTADMKEKGADPYDLKQQENVLAESRMMVPDCHKRLETALADLKATLAELKESNEQGAEIGEAESPIAEVEAVVKPAED

SEQ ID NO: 58732 - DNA, 723 bp, Zea mays
  misc_feature: Ceres CLONE 1512756
  misc_feature: Encodes the peptide sequence at SEQ ID NO. 58733
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (32)..(32): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (46)..(46): n is a, c, t, g, unknown, or other
ttttttttnnnnnnnnnnnnnnnnggggtggnttnnnnnnggcatntttttttcaaagctggactccccgcggtggcggccgctctagaactagtggatcccccgggctgcaggaattcgtctcacccctagaaaaaatttttcaccccaaatctgccgaggggattagccgatcgaagcgtcgtcggcggctgcggcaatggcggggctgtcgctgcggtgcggcgactgcggcgcgcagctgcggagtgtggaggaggcgcaggcgcacgctgagtccaccaaccacgccaacttcgtcgagtccactgaggccgtcctcaaccttgtctgctccaactgcggcaagccatgccgctcccataccgaggtggacctgcacacgaagcgcacgggccatacggagttcgcggacaagaccgcggaggcggccaaacccatcgacctcgaggcgccgcttaaagccggcctccgatgatgccacggacgtcgatgcgtcggcctcggcgactgaggagacacaagagatggttgtgccagaggtgaacaaagaggtgctcacgggaccttgagggcatgggtttctcgacagcccgtgccactaggggcgcttcacttccctggtaatagcacccattgaatggtgctaataaccgggcttttcggagcccccagggggacccctaattttggatgaaaatgccccttggtaccccgctaact

SEQ ID NO: 58733 - protein, 92 aa, Zea mays
  misc_feature: Ceres CLONE 1512756
MAGLSLRCGDCGAQLRSVEEAQAHAESTNHANFVESTEAVLNLVCSNCGKPCRSHTEVDLHTKRTGHTEFADKTAEAAKPIDLEAPLKAGLR

SEQ ID NO: 58734 - DNA, 523 bp, Zea mays
  misc_feature: Ceres CLONE 1512763
  misc_feature (188)..(188): n is a, c, t, g, unknown, or other
  misc_feature (194)..(194): n is a, c, t, g, unknown, or other
ctggagctccaccgcggtggcggccgctctagaactagtggatcccccgggctgcaggaattcgtctcacccctagaaaaaaaaccctacccgactccgccgccgcccgccgctccgcctcagcgcatagcccgccgcgacctcatcgatcaccttcaactttcaatcatgggcggacgtcgatgtcngaaccnggaggggttgccgccggaaagctcccaagaagagacgttcgcagtacagctacgcgcgtcgactagagcgctctcgactgtcacggacgactcgtcagctcttcccggcgcgcaagagaaggtccgaggggctgagaagagcccctgggctcatcaagaactgccaaggcaaaaaaaatctctggtgggaaaaaccaaaccgggcaaaaaccttccccaacagatcatttgccccgaaaaaatgggaaacttttttgggggtaaaaaaggaaaaacccttcccccggtggaaaaaaacccgggaaaaaacccggcccccccttgggagt

SEQ ID NO: 58735 - DNA, 484 bp, Zea mays
  misc_feature: Ceres CLONE 1512784
  misc_feature (20)..(20): n is a, c, t, g, unknown, or other
  misc_feature (31)..(31): n is a, c, t, g, unknown, or other
  misc_feature (42)..(42): n is a, c, t, g, unknown, or other
ctccccgcggtggcggccgnctctagaactnagtggatcccnccgggctgcaggaattcgtctcacccctagaaaaacgtgctttctcagaggtgggttggcttctcctcccccaccggttcgtgttcaggttctggttcgtgggcgagagggaagagatggcggcgtcggacgttgagtaccgtttgcttcgttggcggcctcgccttgggccaccggacgaccacttccttcaacaacgccttcagaacctacggggaaggtcctcccattccaaaaatctcctgtgattgggaaaaccccaaagggtcccccgggtttttggggttttcttccccttttttccccccgaggggaaaaccttttttgccaaagcccccccttcttgggggtttttaacccgcgcggggggggtttttttttaggggcgccccaaaaaaaaattcccccccccttaaaaaaaaaaggggggcccccccccccg

SEQ ID NO: 58736 - DNA, 666 bp, Zea mays
  misc_feature: Ceres CLONE 1512789
  misc_feature: Encodes the peptide sequence at SEQ ID NO. 58737
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
tgggttatgggggggtatggggtggacaaacaagtcggtgggatacgnnnnnnngaaannntataaaaactggagctccccgcggtggcggccgctctagaatagtggatcccccgggctgcaggaattcgtctcacccctagaaaaaaccgaagcttctcactagtaaatggcggctccctcctccaccgccgccaccatcatcagctcctgctgccgcctcgggcctccctctccgcccgaacaagccgctgcaggcgctcacaagccgcaggcgccggcagcaggcgtgtcggcgtcgcacgcgctgcgcagggcgtgcgtggcagccgcggcgtgcgcggcgatggggatggcgggcggcggccacataacgctggcgcgggacggggcattcggcgccacgtggaccgactccatgggcgccgcgcgcaccaaggcgccggcccagtggatcgagcgcaggcagtgcccgccgtggcacgccaactcactggagaacgtcgtgcccgagaacctgccccgcccgcccgcgcccaggaggttcgacagcgtctcggtctcggcggccgcgccggacttggtggcgccgcccaacatctgtcctcgcgggcggggccgcccccgggacggggctgctatctcgctcttgacgcgaccgcggga

SEQ ID NO: 58737 - protein, 106 aa, Zea mays
  misc_feature: Ceres CLONE 1512789
MGMAGGGHITLARDGAFGATWTDSMGAARTKAPAQWIERRQCPPWHANSLENVVPENLPRPPAPRRFDSVSVSAAAPDLVAPPNICPRGRGRPRDGAAISLLTRPR

SEQ ID NO: 58738 - DNA, 659 bp, Zea mays
  misc_feature: Ceres CLONE 1512801
  misc_feature: Encodes the peptide sequence at SEQ ID NO. 58739
  misc_feature (563)..(563): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (598)..(598): n is a, c, t, g, unknown, or other
  misc_feature (606)..(606): n is a, c, t, g, unknown, or other
  misc_feature (621)..(621): n is a, c, t, g, unknown, or other
ctggagctccccgcggtggcggccgctctagaactagtggatcccccgggctgcaggaattcgtctcacccctagaaaaaactgacgttcattcggcttgcttgattgttccaggtattcgcagtcgaccgtgtcctcggagcacgatgaaggttgttgctgcctacctgcttgctgtcctcgctgggaatgccagcccctccgctgaggatttgactggcattctggagtcagttggctgtgaagttgacaatgaaaggatggaactgctgctgtcccaactgagcggtaaggacatcaccgagctcattgccgcgggcagagagaagtttgcttcagtcccatgtggcggcggcggtgtggctgttgcggcaggtgcacctgctgctggcggagctgctcctgcagctgaggcaaagaaagaagagaaggtggaagagaaggaagaaagcgatgatgatatgggcttcagcctcttcgactaggttgcacagtcatcacagtattgtttccggggcagttggaaaaattccaaaagggggaaaacccccgaaagtccctgntttttgttnnnnnnnnnnnnnnnnnngnnnntttntttttttntttatttgttgttgntgttttttttttggtgtgtttgatataaaattattgat

SEQ ID NO: 58739 - protein, 112 aa, Zea mays
  misc_feature: Ceres CLONE 1512801
  misc_feature (17)..(111): Pfam Name: Ribosomal_60s Pfam Description: 60s Acidic ribosomal protein
MKVVAAYLLAVLAGNASPSAEDLTGILESVGCEVDNERMELLLSQLSGKDITELIAAGREKFASVPCGGGGVAVAAGAPAAGGAAPAAEAKKEEKVEEKEESDDDMGFSLFD

SEQ ID NO: 58740 - DNA, 891 bp, Zea mays
  misc_feature: Ceres CLONE 1512814
  misc_feature (10)..(10): n is a, c, t, g, unknown, or other
  misc_feature (11)..(11): n is a, c, t, g, unknown, or other
  misc_feature (13)..(13): n is a, c, t, g, unknown, or other
  misc_feature (17)..(17): n is a, c, t, g, unknown, or other
  misc_feature (18)..(18): n is a, c, t, g, unknown, or other
  misc_feature (20)..(20): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (300)..(300): n is a, c, t, g, unknown, or other
tttttttttnntntttnntntttttttttttttttttttttctttgnnnggcacactggccctcccccccgtggccgccgctctttaacagtggatcccccgggctgcacgaattcctctcacccctagaaaaatattcacggtccacggtgttgctgctaaggctgatgtgtttcatatcctttcaggcctgaggaagacaactgctgaagggcgcttcctatgggttggggggccccgaccccatgaatctcccaagcccccacttaatcacctcaaagcctctatctgtatatgttnattggtggctttgaacaatctcaataaaaccacactaaacacccaagaaacagttggcacccggcacatgctatgcccttgccacaatccttttggcaaaagacttttcgaatggatcttttcaagcccaaaatggtatctttatagaaaattttcccccaccattcatttgggttaaaaaacaccccaacccccccgtgggtggttaatttgccgaacaccccccatagaccaaattcttcattttctcattcatatccttgatatatccttgcttatcctccgtttcaccttgttcgccctcaccacttccgcgtgcgctgtccatctctctccacgcccattcccaccccacgaattccccaacacccccccccctctctctccttccccccccccataccctctttttttttatccctccactttcatctattgctttactgttatttttcaatgtgaggctatcgtgatcgcaaacgctctatccaataatccacaccacgggtcgcgcccccgcataactaataaaaatacaaataccttcgttcctaaataacaatggctaaatctgctcttccaccacatccc

SEQ ID NO: 58741 - DNA, 634 bp, Zea mays
  misc_feature: Ceres CLONE 1512824
atagctggagctccccgcggtggcggccgctctagaactagtggatcccccgggctgcaggaattcgtctcacccctagaaaaagtcaccctcgcccccaggacccaacacagagagaaggtctgctctccaccggatggactcccacggcaagccctagcccgccggttcgacgccacctacgcctccgaatcgcgccgacgccgccgaagccgccaaagccgccgacgccgccgaagccacctacgccaacaccgccgaagcccgacgcgacgaacgggttcaggcgccgcatcttccctttggtcctagccgccaagctctttgtcataacttatgtcctcatgcgggcctaccattaggactcagcaaagaacgacccgacgactgatcctgcttctgcaactgctgggaagcctgctgagccagtctctatccccagaaaggaactcccaccaatccctgaagatgaccagagcacgctctacaaatggatgctggaagagaagcggaagatcaagccacgctatgctgccgagaagaataaactcgatgaggagaatggccttctaaaatagttcatccgagcaggatccctcccgagcttatgagctcacccatttgggtctcttgt

SEQ ID NO: 58742 - DNA, 719 bp, Zea mays
  misc_feature: Ceres CLONE 1512836
  misc_feature: Encodes the peptide sequence at SEQ ID NO. 58743
gagctccccgcggtggcggccgctctagaactagtggatcccccgggctgcaggaattcgtctcacccctagaaaaaaaaaatcacagatctctctcggccccgtgcccagcgctccgaaaccctagcgccgccgcgggtgccaggccgcgagcgtcgccatgggcatcgtgtttacgcggctcttctcgtcggtcttcggtaaccgcgaggctcgcatcctcgtcctcggcctggacaatgctggcaagaccaccatactctatagactgcaaatgttagaggtcgtctccacgatccctaccattggattcatctttgagacggtgcagtacaacaacatcaagttctttttttcgccccccccggggggggaagaggggggttttccttactctccggttctactctcccaacagatcagggctatcataatatgtctgttggatccagcgccatacccgattggctttgttaacccactcaaagaaaatatatccatgcccctcccttggacggagctatcacccttgaagggggccgtttggtccttcggttgaacgtaactattccgcggatccccccccggtggactctcctttgaatgttcaccccactatagatcccctccttcaatctcccccaagacttctgcgggacccgcccaatttgacccttttctcctccataccctcttcatcccagaccccccactccccc

SEQ ID NO: 58743 - protein, 132 aa, Zea mays
  misc_feature: Ceres CLONE 1512836
  misc_feature (5)..(112): Pfam Name: Arf Pfam Description: ADP-ribosylation factor family
MGIVFTRLFSSVFGNREARILVLGLDNAGKTTILYRLQMLEVVSTIPTIGFIFETVQYNNIKFFFSPPPGGEEGGFPYSPVLLSQQIRAIIICLLDPAPYPIGFVNPLKENISMPLPWTELSPLKGAVWSFG

SEQ ID NO: 58744 - DNA, 868 bp, Zea mays
  misc_feature: Ceres CLONE 1512848
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (27)..(27): n is a, c, t, g, unknown, or other
  misc_feature (30)..(30): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (868)..(868): n is a, c, t, g, unknown, or other
ttttttttnnnnnnnnnntnnnccttnttnccgtcgttacagggaggnnnnnnaaaactggtactcccccgcggtggcggccgctctagaactagtggatcccccgggctgcaggaattcctctcacccctagaaaaaagcagcagcatccttaccagcacacagtggagctagctagctagtaaaggtcaatcaccaaaatggtgaggcacctcgttgtgcttgctctgcttttctggatccccggggtggggaaaggcgagggggagtgcccaaaaacctcccccagaaaggagggccctaaagaaggggccatgcatttcgggtggggacaaaccgcggtccaccccataaagtgaagtgtttgctaccagtcctgccaacacatcggtagataatcgcctgctggttgtggtgtcttttttattgacccccccccgggggggggggggggggggggaaaccataaaaaacagctcaataccgtctgtaccaattagtttagatgattaggtgtatacaagcgcggtgcggggagaaaaatactgtgagacaactcacaccaaaaataggcaacccccgtcttttacaaacggtggcacaaaggaaagaccaggcaaacaaattattgttccgtcttcgctctcttcttaatctcccctctccatctcgtggaatgaatgtagttatggaatataataaataacaactataataaacttactctcacccacaaactcctaatactaaagaaggagcagaggtaaactaatgagtacagaatcaacagaataagcaaaaagaggtggcgcggagggcgccggtgtaccccaaccacccgaataccgccgcagagaccctctgctcn

SEQ ID NO: 58745 - DNA, 735 bp, Zea mays
  misc_feature: Ceres CLONE 1512857
  misc_feature: Encodes the peptide sequence at SEQ ID NO. 58746
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (49)..(49): n is a, c, t, g, unknown, or other
  misc_feature (50)..(50): n is a, c, t, g, unknown, or other
nnnnnnnnnnnnnnnnnnnnnnnnnnnttttnnnnnttggccttttgtnnccaaactggagctccccgcggtggcggccgctctagaactagtggatcccccgggctgcaggaattcgtctcacccctagaaaaagccagacagaagacaacccgtcagcccctctcgtttttcatccgccttcgcctccaaccgcgtgcgctccacgcctcctccaggaaagcgagagcttctgcataagaacaacaaatcaaaagcgtgatcagctcggtgccaacaaaacctcaacaaccaagtttcatgtctgatctcgacgtccagcttccatctgcctttgatccgtttgctgaggcaaatgctgaggactctggtgctggtcctggaacgaaggattatgtgcatgtgcgcatccagcagcgcaacggcagaaagagtctgactacagtccagggtctgaagaaggagttcagctataacaagatcctcaaggatctgaagaaggaattctgctgcaatggtactgtagttcaggacccagagctaggccaggtcattcagctcccaggtgaccagcgcaagaatgttgctacttttcctaggtccgggctggaattgcaaagaaaagaaaacatcaagaatttcacggggttctaaggggacctggtaaaaggctttggtccccctaatattgtgggggccctcaaaccatattggggggaaacctttgaaaaacac

SEQ ID NO: 58746 - protein, 117 aa, Zea mays
  misc_feature: Ceres CLONE 1512857
  misc_feature (27)..(107): Pfam Name: SUI1 Pfam Description: Translation initiation factor SUI1
MSDLDVQLPSAFDPFAEANAEDSGAGPGTKDYVHVRIQQRNGRKSLTTVQGLKKEFSYNKILKDLKKEFCCNGTVVQDPELGQVIQLPGDQRKNVATFPRSGLELQRKENIKNFTGF

SEQ ID NO: 58747 - DNA, 875 bp, Zea mays
  misc_feature: Ceres CLONE 1512860
  misc_feature (21)..(21): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
ttttttttttttttttttttnttnnntggggggggnnnnnnnnttnnnnnnnntcaaagctggactccaccgcggtggcggccgctctagaactagtggatcccccgggctgcaggaattcgtctcacccctagaaaaaaaaacactctcctccttcctccaccgccgccaacgtcgcctggcggccgtctgcagctccgcgcctctgctcggaagttggtgaaggtttcttgaagctgagaagatggtgctgaagacagaactctgccgcttcagcggccagaagatttatcctgggaaaggcatccgatttatcccgtgctgattctcaggttttccttttttgccaactcaaaatgcaagccgctatttccacatcctccctgtaatacttggtaaggtttacgtggacagcaattgtaccagggaagccacaccacagaagggaaggtccatggcctaagggttgtctcaaaaatgaggcgcccccccccctccccaagaaactccataccttgtagggtctgatttgcttggcggctcctcttccccctcaccgcgcgggctccccaacaaacccaacccgcgtgcctgataaaaaacccccccgaagggcccccgaccgtttgccatggctaaggaaaaaaaggcggtctacctatttagataagtactacaaggggaccctccactttcgggggaaagaagcccaaggtgatgtatacacgcccccccgctacccaactcgccgtgcgcgggggggcccacagcgcgcccaggagcgtggcggtccggagcgagagaaggtcgggcggggctcccccccagcgcccctcccaagggggccacccgacgaccgggacgcggccggccgc

SEQ ID NO: 58748 - DNA, 805 bp, Zea mays
  misc_feature: Ceres CLONE 1512861
  misc_feature: Encodes the peptide sequence at SEQ ID NO. 58749
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (805)..(805): n is a, c, t, g, unknown, or other
nnnnnnnnnnnnnnnnnnnnngggggggnnngggnnnnnnnnttnnnnnnnccaagactggagctccaccgcggtggcggccgctctagaactagtggatcccccgggctgcaggaattcgtctcacccctagaaaaaatccaattcacaggctcaccacaccaaccagcaagcaaaaattccccaatcctctcgtctccgcggcgaagatgtcggggcgcggcaagggcggcaagggcctgggcaagggcggcgcgaagcgtcaccggaaggtgctgcgcgacaacatccaggggatcacgaagccggcgatccggaggctggcgcggcggggcggcgtgaagcgcatctcggggctcatctacaaggagacccgcggcgtgctcaagatctttcctggagaacggcatccgcgacgccgtccccctacaccgaggacgcgcggccgaaagaccgttcaccgccatggaacgtccgtctaaccccctttaagccgcctagggcccgcacccctcttatgggctttcgggcgggcttaggtctgtgcccgcggcccgcctccctccgccctccgccggtttggggggcggtttcctgggggtttgcctgacaggttcgagaaaggtggatttttggggggggacaaaaaaaaaatggctcagcaaacttggtagaaccttgcagtggccccaaaccgacacccacaagggagggggtgttagtcttgagagaaactttgtttgccccaagggcgtggccttggccccctggtaccccaaaaccttcccccccttcttgggggctn

SEQ ID NO: 58749 - protein, 90 aa, Zea mays
  misc_feature: Ceres CLONE 1512861
MSGRGKGGKGLGKGGAKRHRKVLRDNIQGITKPAIRRLARRGGVKRISGLIYKETRGVLKIFPGERHPRRRPPTPRTRGRKTVHRHGTSV

SEQ ID NO: 58750 - DNA, 663 bp, Zea mays
  misc_feature: Ceres CLONE 1513116
  misc_feature (261)..(261): n is a, c, t, g, unknown, or other
tcccccgggctgcaggaattcgtctcacccctagaaaaaaaaacgaaaaaggccgataaacacttatccccaacgatgctatgtatattagccgttctgtatttacacaaatcccacggttcttgtagccacgtgaccaaaaagagatcaacccaccgacctgtattttctcctttgtgatgcaagtcagcaagtgcatggacctgtatatttgagtcgtgaatgaataggaaatgttgtttactacccacaaacaaatanatcctcaacgggcccctgcttttgccttccttgcataaaaaagagaaaaaaaactttttttctcccccccccaggggggggggggggggggggattcttattttccccccccctcccctggcatgtggatataaaataaataaaaaaactgcgaaagactccccgcccagtgcctcaattttactccggaacaagccagtacaccccccccaccccccctgggtcggcgcaatatccccctacaaggcaggcgacagccaattcccctgtttctggccatttacctcgcgaagttgtcaccacaaaaagtgtggaaacgaaatcttggcatcaccccgggttgtttatccccttcggtctttttgtgcgaacactcgggggccgcgctgaacaaaatatggg

SEQ ID NO: 58751 - DNA, 822 bp, Zea mays
  misc_feature: Ceres CLONE 1513117
  misc_feature (40)..(40): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
gtctacaataaatacgttggccgttatctaaattacttgnacccgaaccannntttctttcnnnncaacctccgtcctcccccacggtggccggccgctctagaactattggatcccccgggctgcaggaattcgtctcacccctagaatgatgatgatgatgatgaaatgttcgtggtgcgatgcatggtgtacttgtactatgttgtaactaatgtaaaaaatgcgatggtcgttagatgctatgtccccttaattaaggcggacctacttgcaagtaaggctcgcaaataagggtattccagatttaattgaatactcattatttttctgcaaaaaaatatgtatacacgcatattgctaccaccccaaaaaaaaaattcctttccatcacttttcttttttgacccccattcctcccctataataggagcgcaattttttttttcccccccccgacagggagggggggggggaggggcgtggtctttgttttataattgttttaccacccccccaacactaaactccacgcactcggtgagcgtattctcctctcttttccttcctcttcctctacacacccccggattagtggactccctactaccgagcactacccagttcacaaatctaagtgcaggccgatattccgcctctttctcgcctgcccgcagaccatcttacaccctcccccgccttctctccggacggcgcgtcctcaattcacctaactattactagtggtcacatacacacactccccgactattagtgggccctggtcgtgtaagtccctcgattcttgcgtaccggatctta

SEQ ID NO: 58752 - DNA, 754 bp, Zea mays
  misc_feature: Ceres CLONE 1513121
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
ttctttttttttttgggtttaagcgtgtttttttgttcgtctaccaatttnnnnnnnngnnnnnnnnaaaactgggactccccgcggtggcggccgctctagactagtggatcccccgggctgcaggaattcgtctcacccctagaaaaaattttcctagctgtaaagctctataccaccagatactgccatatgatggtatggttgggtacccgtctttctagggagtttcttttctctctctctctcttttcttattgttatgtttttcaatagaggagtgtgcgcgtgttgtaatcgtttttacctgcgttttcctctaactaggcggtgatctcgcgggaaagcaaggtaaaaaaataaagcaacttaaaatcctctgcccaaaaaaaaaaaaaaaaacgacacctctggaagttcccccttcccccccctcttgtgaacccgtatgtttcggggggtgtaaattgaccaatcactttaaaccaacctcccccccccagggaaaaacgccgtgggcgttttcccccaaaccttacatcggcgcttggtataaaactaccccccccttttccccctgacctgtcgcctaccccaccgcaaaaaggcgccctttaagacgattacgccccttccaccaaacaagcttgcgcccacccccccaatgacctcaatccgcaaaacattgcagccccgcaagaataacttctgttcacaatctacacagcaaaacacctcgcgcacatccccaccc

SEQ ID NO: 58753 - DNA, 589 bp, Zea mays
  misc_feature: Ceres CLONE 1513122
  misc_feature: Encodes the peptide sequence at SEQ ID NO. 58754
ccccgcggtggcggccgctctagaactagtggatcccccgggctgcaggaattcgtctcacccctagaaaaacagcagctgaacgtggggggcaagcaaaagaagtgaagcggtcgtccccaggccatcgcggatgagagtagtttcaggcgatggttttatctgttacagaatgcgcatgcgcgggaatgaacaaagtggcaccatgttgcagtctgtatgtactgacaagtttgtctatcgatctttgattctctgctcttgtaagccgcgactgatgaatctgatgttgcaattgccttcctgggaggcttgctctgatgcgtgttattgtttcccatacccccccctttgccacccttatgaggggggacgtactcagacatcgttttattgtttcctaccccctccgaagggccccgaactgctccagagggggggctcccgcattaaactctgcgcctcactatccgccttggcttttttaaacttctggggggcggcggagaacgccccgtgcagtcgcccaccactttatcccccttttgccacatgtttcccaccctgtttgcccagtatcgggtgaata

SEQ ID NO: 58754 - protein, 35 aa, Zea mays
  misc_feature: Ceres CLONE 1513122
PRGGGRSRTSGSPGLQEFVSPLEKQQLNVGGKQKK

SEQ ID NO: 58755 - DNA, 748 bp, Zea mays
  misc_feature: Ceres CLONE 1513125
  misc_feature: Translation starting site: 276
  misc_feature (12)..(12): n is a, c, t, g, unknown, or other
  misc_feature (13)..(13): n is a, c, t, g, unknown, or other
  misc_feature (28)..(28): n is a, c, t, g, unknown, or other
  misc_feature (29)..(29): n is a, c, t, g, unknown, or other
  misc_feature (34)..(34): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (509)..(509): n is a, c, t, g, unknown, or other
aagagtagagtnntgtgttttcctttcnnacaanannnnnnnnnnnnngtcgcaannnnnagtaagaagcactccccggggtggcggccgctctataatagtggatcccccgggctgcaggaattcgtctcacccctagaaaaacaagaagcctaccattacgtcccgcgagatccagacctccgttcgcctcgtcctccccggcgagctcgccaagcacgccgtctccgagggcaccaaagccgtcaccaagttcaccagctcctaagcgagcgatgcgacgtgcactcctctcctcttcttgcaggagtacaataggagtacggttaggtgtgttcccctccctggccacatgcccgccgccttctgctctccgggctcggttggaggtcttttaacctacaaaaaacaccagtacttttttttttcccccccccccccaggggggggggggggggggcgctccctctcccccccccctcttttgttgaaagcatgaagtgtaaaanagggtggccccccccgcgccaccccaaaaaataaagtgctcagagctggcgtctcgggcggccaccttttacccctaggggtgcaaaacatgggtactgatttgctatggggagtggtgcccccaggtgagacacactctggtgggcccccccccccgccaaccatcatttcttaccgcagtatgcacacacatcgttacatcaataggtggtccgccctgcgcgctcctccccgccgg

SEQ ID NO: 58756 - DNA, 664 bp, Zea mays
  misc_feature: Ceres CLONE 1513132
  misc_feature: SWISSPROT Homolog: EC 3.2.1.23 Beta-galactosidase
  misc_feature (27)..(27): n is a, c, t, g, unknown, or other
  misc_feature (28)..(28): n is a, c, t, g, unknown, or other
  misc_feature (33)..(33): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (40)..(40): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
gcgagggcataaaaacacatttaattnngggtntnnnntntnnnnnnnnngaannnnnntaaaactggagctccccgcggtggcggccgctctagaactagtggatcccccgggctgcaggaattcgtctcacccctagaaaaaaaaaaaaaaaactcaatgtgctatgattttctttttgttgtcttattttcgatacatgtaaatgtcgaattactagccgtgagaattgagagttcaagcctatagagcttgatatgtttgaccaaagtaaatgtatcttcttaaaaacatgaaagtcaagtgctttctttttttatcctctataaaaaagcacaaagtgatggtgatggttttctgcaaaaaaaaaaaaaaaaacgagacgctcgaggtacccaattcgccctatagtgagtcgtattacccgcgctcactggccgtcgttttacaacgtcgtgactgggaaaacccccccgttacccaacttaatccgccttgcagcacatcccccttttcgccagctgggcgtaataaccgaaagaggccccgcaccgattcgcccctttcccaacagtttgccccaacccttgaatgggcgaattggaaaattgtaaaggcggttaaataattttggtttaaaaattccgccggttaaatttttttg

SEQ ID NO: 58757 - DNA, 676 bp, Zea mays
  misc_feature: Ceres CLONE 1513139
  misc_feature: Encodes the peptide sequence at SEQ ID NO. 58758
cacagctggagctccccgcggtggcggccgctctagaactagtggatcccccgggctgcaggaattcgtctcacccctagaaaaaaaccccgccgccgcaacatccctagtcgctcgtcagatcctccagcaccacagcaccttcgccgccgccgccgccgccgccgccatgggtaaggttcacggatcgctggcccgcgctgggaaggtgcgcgggcagacgcccaaggttgcaaagcaggacaagaagaagaagccccgcggccgcgctcacaagcgcatgcaatacaaccgccgcttcgtcaccgccgttgttggattcggcaagaagcgcggccccaactcatcggagaagtagatctagctatggctctccgttttaggcggcgagagtttcctcactgaatgcaacttgctgaagacttatgctattatctgtatcgatgttactgcaacaccgttaagtacaatatatgcatcgttttagttgatcaaaaaaaaaaaaaaaaaccaagacccccgaggtacccaattccccccaatggggagtcgtattaccgggcgctccctggcccgcgattttcaaaccgtctgatcgggaaaaaaccctgggttttcccccactttaccgcccttgcggcacttcccccctttatccgcgcgggcctaataaccg

SEQ ID NO: 58758 - protein, 62 aa, Zea mays; identical to SEQ ID NO: 6893
  misc_feature: Ceres CLONE 1513139
  misc_feature (3)..(61): Pfam Name: Ribosomal_S30 Pfam Description: Ribosomal protein S30

SEQ ID NO: 58759 - DNA, 713 bp, Zea mays
  misc_feature: Ceres CLONE 1513142
  misc_feature (566)..(566): n is a, c, t, g, unknown, or other
  misc_feature (607)..(607): n is a, c, t, g, unknown, or other
  misc_feature (610)..(610): n is a, c, t, g, unknown, or other
  misc_feature (613)..(613): n is a, c, t, g, unknown, or other
  misc_feature (615)..(615): n is a, c, t, g, unknown, or other
  misc_feature (618)..(618): n is a, c, t, g, unknown, or other
tccccgcggtggcggccgctctagaactagtggatcccccgggctgcaggaattcgtctcacccctagaaaatttaagacgaagacgaagtccaagcacaacgtttgctaggtgttcgatgatttgtttgagccaggaatcttcgtcgatctcgtggtttcgagtttggtttagttatggtacgttaattaatcacgtgatgtgaaggacaagagctggattgatctcaaggtgatgctgatgaatgaacctgaagatggatgatctgattagatgccaggatgggagatgctcaccaagcaagtatcatgtaccaacactgacttagggttatcctaaggaagcccctggtgcatgcccaccctttcctggagagggggtaaatggatattttataccactccccccccccccccaaaatgtggcattagagttttttcagccagcctcagcgcggaagaaacacctcacccagcaacaaacaagcaagaaatataaattaaagcttaatagaagctcgaaaacacgctccaacgcaaacatagcaaccagagaaaataaggaanccacccaaagaggatacgccatacccgcgcccctcaataancanccncncangacagcgcgcagcgtagtcactcggacagcgccatttaaaacacataccacaacgccgccgacagaaacaacccccgcaccggtatcccccaccg

SEQ ID NO: 58760 - DNA, 628 bp, Zea mays
  misc_feature: Ceres CLONE 1513148
  misc_feature: Translation starting site: 141
  misc_feature (220)..(220): n is a, c, t, g, unknown, or other
aaagctggagctccccgcggtggcggccgctctagaactagtggatcccccgggctgcaggaattcgtctcacccctagaaaaaattcacgcacctagggttttcgcgccgccgccgccgccgccgccgcagccgcaacaatgccgtcgcacaagaccttccggatcaagaagaagctggcgaagaagatgcgccagaaccgccccatcccctactgggnatccgcatgcgcactgacaataccatcaggtacaacgccaagcgcaggcactggcgccgcaccaagctcggcttctgagcgtcgggattggccggctgctgcgtcggaaggctagggtctaagagctatcttccttctgttttatcaatgtgtcagtttttctgtaagctagcaagtgttgctatgacgcttttattaagattctggtgagcggtgatgttaagagaaaattggcactaccgtggtgtacccccagattcccttgcagcattgctatgcttaagtaagaaacccttttatcttattaataaaaaaaaaaaaaaaaacgagaacgctcgaaggaacccaatttcgcccctaaaaggggagccggaaattaccccggcggctcccctgggcccgtccttt

SEQ ID NO: 58761 - DNA, 648 bp, Zea mays
  misc_feature: Ceres CLONE 1513152
  misc_feature: Encodes the peptide sequence at SEQ ID NO. 58762
  misc_feature (497)..(497): n is a, c, t, g, unknown, or other
agctccaccgcggtggcggccgcctctagaaactagtggatcccccccgggctgcaggaattcgtctcacccctagaaaacatgggccggaacgccgtgttcgacgccgtccgcgagatggccgtcgtgggcggcaccggcgcgttcaggatggcgcgcgggtacgcgcaggcccgcacgcacaccttcgacctcaacaccgggcgacgccaccgtcgagtacaaccttctacatccaagcactaggcttagctagccaccttaaatcgaatcgggcgggggtccccggccccaatcccggcttttggtggaatctcctaaaattggctggggtgggcttccccccattgaaaaccccccgactctcaaccccccgcggttcccccaaagaccaccccctccaacattttccccgtgggcggggccgcccccttcccccgaagggaggtcccccccccccccatataatattctccccctccccggggaaggacaantcccccccaccccgattgtgtgggggtggtgttgttcgtttcttattttaaccaccccccactcactatcaggggcgggcggcttattttttttttattaaaacccaccccccccccccgccggaaaaaaaacacccccccctccttcccc

SEQ ID NO: 58762 - protein, 54 aa, Zea mays
  misc_feature: Ceres CLONE 1513152
MGRNAVFDAVREMAVVGGTGAFRMARGYAQARTHTFDLNTGRRHRRVQPSTSKH

SEQ ID NO: 58763 - DNA, 469 bp, Zea mays
  misc_feature: Ceres CLONE 1513158
ggagctccccgcggtggcggccgctctagaactagtggatcccccgggctgcaggaattcgtctcacccctagaaaaaaactgaccggaccggccggcgttccccgtcgactgtgttcgatcgctagacggggtggcacgctgcgacgactacctgtatggcgagtccctatacttactcatacataagctgcggccgccgtgtcgtccgggtgcgtggcacccgcgccaattaatggtggccttacaaggggaaaacctttccaacttttccaaacaaaaagataagggttttggggggtgggggtaaactgggggtacccccagaaaagggggggtaccccggaaacctaaaagggcccccccctttttgaggagggtttttttttggcgcgttttttttttttttccccaaaaaaaaaaacccctccccttttgggggagaggaaaaaaaacattaaaatttcttc

SEQ ID NO: 58764 - DNA, 609 bp, Zea mays
  misc_feature: Ceres CLONE 1513169
  misc_feature: Encodes the peptide sequence at SEQ ID NO. 58765
  misc_feature (35)..(35): n is a, c, t, g, unknown, or other
  misc_feature (533)..(533): n is a, c, t, g, unknown, or other
tccccgcggtggcggccgctctagactagtggatntcttgggctgcaggaattcgtctcacccttagaaaaaatccaagctcaaagcaagcagatctaagctccaggcagcgtcgcgacagagtgagctagtgagtagcacgacaacaacaatggcttccctgaaggccgccaagcccagcggagttgcggcgcagggcaaggagccggcgcccaagctcagcgagacggcgacgaagccgtcggccgcgaagagcggcggcgttaagaaggttgaacacaaacccccggaaaccccacgggccgggcattatcttctaacgggcggcgggggacaaaaaggccctttttttctccccccccccggaggggaagaggggggggatttatttaattccttcccccccccccgggggatagaacaaccaataattgggtgtgcaccggggggggggagcccccccccccccgtccctgttgccacatggcctcccgggatcccggtgggtgcggcgcttgccccgtcggggggancccccccgacaaacaaccgcggtatgggggggggggccgatggtgacgcggccccccccccagggggcgggtcccg

SEQ ID NO: 58765 - protein, 152 aa, Zea mays
  misc_feature: Ceres CLONE 1513169
  misc_feature (128)..(128): Xaa is any aa, unknown, or other
MASLKAAKPSGVAAQGKEPAPKLSETATKPSAAKSGGVKKVEHKPPETPRAGHYLLTGGGGQKGPFFLPPPGGEEGGDLFNSFPPPRGIEQPIIGCAPGGGSPPPPVPVATWPPGIPVGAALAPSGGXPPTNNRGMGGGADGDAAPPPGGGS

SEQ ID NO: 58766 - DNA, 787 bp, Zea mays
  misc_feature: Ceres CLONE 1513171
  misc_feature: Encodes the peptide sequence at SEQ ID NO. 58767
  misc_feature (34)..(34): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (128)..(128): n is a, c, t, g, unknown, or other
cccgactacccccccccccccattttatttcctntttctcacnnnnnnnnnnnnnnnnaaacacctggagctccaccgcggtggcggccgctctagaactagtggatcccccgggctgcaggaattcntctcacccctagaaaaaggcgccgaccgcaccgacttcccctactcgtccgtcacgtccgtggtggtcgtgccgcggttcgtgggcgagtggggcgacatcgtcatcccgctcagggacggctcctaggtcggacctccgagcgtgcccaggttgcgccaggtcgccgactggtgccgctgcatggccgccgctgagggctccctcgccgttctcttggcgcccccggaaggcgggcgaccccccgtccgaacccgttattaaccggcggccactgggggaggcgcgggaagtttttttccccccccccccttaggggggggggggggggggatttttttttgttcgggggagctgctccccccccccccttctgcccagggaggcgatatggctctccgagctggcgggtggggggggacgccctcctaggtccccagtgtctatgggcgatcggcccccgcggtagcgtaggggggtgtttcgggcgaggaacgggctctcgtcgcggtggcccctccccgctgcgccgcgcctcctcgtatgacatcgatcccccggtacgcgggttattcacggggggggtggcccgttctctggcgtcgcgcgggcgggcggtggcggcggtccgacattgatttcccccctggcgcgcccact

SEQ ID NO: 58767 - protein, 84 aa, Zea mays
  misc_feature: Ceres CLONE 1513171
  misc_feature (15)..(15): Xaa is any aa, unknown, or other
  misc_feature (16)..(16): Xaa is any aa, unknown, or other
  misc_feature (17)..(17): Xaa is any aa, unknown, or other
  misc_feature (18)..(18): Xaa is any aa, unknown, or other
  misc_feature (19)..(19): Xaa is any aa, unknown, or other
  misc_feature (43)..(43): Xaa is any aa, unknown, or other
PTTPPPPFYFLFLTXXXXXKHLELHRGGGRSRTSGSPGLQEFXSPLEKGADRTDFPYSSVTSVVVVPRFVGEWGDIVIPLRDGS

SEQ ID NO: 58768 - DNA, 604 bp, Zea mays
  misc_feature: Ceres CLONE 1513174
  misc_feature: Encodes the peptide sequence at SEQ ID NO. 58769
cccccgggctgcaggaattcgtctcacccctagaaaaagatgaggaccgccatgccggtgatcttgggaatgtgacagcgggagaagatggtgttgttaatgtcaatattactgacagccagatacctcttgctggaccccactcgatcattggccgagctgttgttgtccatgctgatccggatgaccttggcaaaggtggacatgagcttagcaagagcaccggatatgctggcggacgtgttgcctgtggtatcattgggctccaaggctaaagcggttaacctccgaggcaaacaccatagaaggtcgaagcgagcacctcaagaagttgctgttccctttcccctgtattggcaacgcaccccccattactccaaataaagcgcctgatccatgatcagagagcactattcatgtcattttgtttaatgaaccaatgttgcgcacctgccaaaaaaaaaaaaaaaaaacaagacgctcgaaggtacccaatttccccctatagtgaatccgtatttcggcgcgcctcactgggccgtccgttttacaaaccccctgactggggaaaaacctggggggttaccccaactttaatccccct

SEQ ID NO: 58769 - protein, 90 aa, Zea mays
  misc_feature: Ceres CLONE 1513174
  misc_feature (1)..(90): Pfam Name: Sod_Cu Pfam Description: Copper/zinc superoxide dismutase (SODC)
  misc_feature: SWISSPROT Homolog: EC 1.15.1.1 Superoxide dismutase
PGLQEFVSPLEKDEDRHAGDLGNVTAGEDGVVNVNITDSQIPLAGPHSIIGRAVVVHADPDDLGKGGHELSKSTGYAGGRVACGIIGLQG

SEQ ID NO: 58770 - DNA, 667 bp, Zea mays
  misc_feature: Ceres CLONE 1513177
  misc_feature: SWISSPROT Homolog: EC 3.2.1.23 Beta-galactosidase
  misc_feature (667)..(667): n is a, c, t, g, unknown, or other
aaaagctggagctcaccgcggtggcggccgctctagactagtggatcccccgggctgcaggaattcccacgagctctggtaaaaatcttctccgactcgaattcggcaaactcaatccgccttctgcgtgccgaacactccacgatcctactctggagtcagcaccctcgcccttgtggcgagggcgtcggcctttggcgtcggtgtcgtctacgggagcatcaagctctcaatcctcaaggtaacaaaacctaaaaaggaggaagtgcatgatcattactaaggacgacaaggctgctacattttaattcccacatatggaaggatgttataaattggcagtgcaccccttctccatacgtacaatacaatttcgtttatgatttgtggacctgtctgtaacatacctgctatttttttttgtgttgtaataaattcttatacaatgacatgaaatcaggaagtggaaaagcaagtcgttcgacaaaaaaagaaaaaaaaaaaaaaaaacgagacgctcgaggtacccaattcgccctatagtgagtcgtattacgcgcgctcactgggcgtcgttttacaacgtcgtgactgggaaaaccctggcgttacccaacttaatcgccttgcaacacatcccccttttcgccagctggcgtaataaccn

SEQ ID NO: 58771 - DNA, 731 bp, Zea mays
  misc_feature: Ceres CLONE 1513179
  misc_feature (310)..(310): n is a, c, t, g, unknown, or other
  misc_feature (312)..(312): n is a, c, t, g, unknown, or other
  misc_feature (313)..(313): n is a, c, t, g, unknown, or other
  misc_feature (314)..(314): n is a, c, t, g, unknown, or other
  misc_feature (316)..(316): n is a, c, t, g, unknown, or other
  misc_feature (321)..(321): n is a, c, t, g, unknown, or other
  misc_feature (401)..(401): n is a, c, t, g, unknown, or other
  misc_feature (402)..(402): n is a, c, t, g, unknown, or other
  misc_feature (404)..(404): n is a, c, t, g, unknown, or other
aaagctggagctcaccgcggtggcggccgctctagactagtggatcccccgggctgcaggaattcgtctcacccctagaaaaatatctacctaccatcttgtattgtcagctcaaggatgtagcaaactagtagcaacttcaaaaaatgagatgtagcagtcctgttctgttagacggacctggtcaaactaccgtactaaatacaaacaaagcacaccttcatgctgtgttggactcggtattctcaggcaatggacgaataatgacttcttttgttgtgttaattcagtgggtgagatgagagatgcntnnnanaaaanaaaaaaaaaaaaaaaaaaaaaaaaaaaaaaaaaaaaaaaaaaaaaaataaaaaaaaaaagaagaaaataaaaaaatcccnntnccccccccttgtaccccttagccccctcccccctttatacctttgtacacccaataaatcacccggccaaactttctgtaggggcccccactcctccccccaaaaaaggaaggtaatattaccaccccccctcctagtgggcttgttttttttcaacattttcgagtggggggaaaaacaccggcggacgccccccaccataaattcacctctcatatcaaaaaccctccccccttttttccagcgggggggggtaaaaacacccataaaagaaccccccccataagataatacccccttatcaaaacaaagggtcgaaaccaacac

SEQ ID NO: 58772 - DNA, 679 bp, Zea mays
  misc_feature: Ceres CLONE 1513187
  misc_feature (400)..(400): n is a, c, t, g, unknown, or other
  misc_feature (401)..(401): n is a, c, t, g, unknown, or other
catgctggagctccccgcggtggcggccgctctagaactagtggatcccccgggctgcaggaattcgtctcacccctagaaaaggtccttgtggttatctaaaacgcacgcatgctctattatagctagtcatcactatatatatacttgtgtttgtgtattgctgttcttgttctgctggtgtctccgccgtttaatttgacctatgttatggagtgagtgatatatgtgccgtcactcctagtatatagtagtgagtgactagttggtatgtgtagtactgtactatcttttctccatatgcatgttttgccagcgcgtaatttatgtaatgttaggactgctactaaaaaaaaaaaatttttttacccccccccgggaggggggggggggttattcnnactcctattattttcccttactggaccacataaaaaaacctccccccctggctaaaccccttgcgtttaccaactttaatcactttcccacaaaatccccttttcccaagatcgactaaaaaataaaaaccccctaacccaaatagtccctccccacatcttcccccatccctaagtgtctaccgtaaatacccaccccctaaatcctcctccttaaaccccccccctttaaccttttccatctacaccacgccctattttccttcccccaatatttt

SEQ ID NO: 58773 - DNA, 790 bp, Zea mays
  misc_feature: Ceres CLONE 1513190
  misc_feature (1)..(1): n is a, c, t, g, unknown, or other
  misc_feature (2)..(2): n is a, c, t, g, unknown, or other
  misc_feature (13)..(13): n is a, c, t, g, unknown, or other
  misc_feature (35)..(35): n is a, c, t, g, unknown, or other
  misc_feature (57)..(57): n is a, c, t, g, unknown, or other
  misc_feature (78)..(78): n is a, c, t, g, unknown, or other
nnggggggacttntgattttttccatttttttttnttgggagtggtttgggcccccnccccggactggggatccaccngggtggcggccgctcttttctagtggatcccccgggctgcaggaattcgtctcacccctagaaaaatcgacttggatggtagacagatccgagtcacggttgcagaatcaaagcccaggcgtgaattttgagattttgttaaggtggttttagaggtcaatagcgtgtgttcacaagttctagtttgtagcgtctattctttcttccgtatgagttacaagaagatgctgataatgagagactggaagtgaaattgctgtacaaaagaaaatattttttcccaaccccttctaaaaaaaaaaaaaaaaacgagaccctcggagggacccgtattcccccccaaagtggaggcgcactaaccgcaggggggggtgggggcgggggttttttaagcttacaacaaccccccaaaaaccccagggggattaaacaaagttgtaaatacgccctgggaaatatcaactccccccctctttcagccgcgctggggggggaaaaatccgaaaaaaaggccccccgctccccaatgcaaccacttccccccaacagggttggcccccagtcctggtagaaggggcgaaaatgggaaaaactagcaaaaggcggaccaggagaagatgtgcgggtatcaatctacacgccttcacaatctcctttgtttaataattagtgcgcccttctttcttttgagcccaccacggtgcccgcccgg

SEQ ID NO: 58774 - DNA, 591 bp, Zea mays
  misc_feature: Ceres CLONE 1513194
agtggatcccccgggctgcaggaattcgtctcacccctagaaaaactccatatgccgaacagattgtagtcactcgccttgttctgcatggtgcaaagccatggccactcgttgaccatgtcacgttttttttccatttcgtaagagtcttgtgttctgacgtttatgaggacatatcatgtgcaatcactcattttggtgcaagcgtgcaatcaaactatccagagcatccagtctagatccaacggtttcatatggaagtggttaaatgtaaaatagacactaggttgtcagcgtgctcggggaaggcaaaaaaaaaaaaaaacaccacaccctcgaggtacccaattccccctatagtgagtcgtataacgcgggcttcactggccgcccttttaacacctcgttgactggaaaaaaccctggcgtttcccctaccttatctcccctgccagaaactcctcccttaccccagccgggcgtaatatcgaaaaagcccccccccaaatcgcccctcccccaacatttgccccacccttgtatggtctaatgggaaattgcaccgcgctaaacatcccaggtaaaatatcg

SEQ ID NO: 58775 - DNA, 439 bp, Zea mays
  misc_feature: Ceres CLONE 1513195
  misc_feature: Encodes the peptide sequence at SEQ ID NO. 58776
aagaaagaaaggcctcccgtccagagtcgtgtcagcgtaaagaaattccacagccaacaagaagccttctcgcctccttgactccttcctccatcctatcgagaaccatgggcaagctgtgctgcagccaggaagatgacgagccggcgttcaaccttctggggctgctcgtcaccgtcgtcctcgccttgctgctgctcatgctgtgcacacctccccggcgcaggcgctgcgtcgcatactaccctccttgctgctaggaacattcgatttcaaggtagggactagctagggagggcgtggtcttctggtgggtgggggcggggaggtgaataggaaggagatgggcaccgagctaggcttcgaatgcggagcttagctaaagtcccaagttactatgaaataaattgcgctgagtttgtaaaaaaaaaaaaaaaaa

SEQ ID NO: 58776 - protein, 50 aa, Zea mays
  misc_feature: Ceres CLONE 1513195
MGKLCCSQEDDEPAFNLLGLLVTVVLALLLLMLCTPPRRRRCVAYYPPCC

SEQ ID NO: 58777 - DNA, 671 bp, Zea mays
  misc_feature: Ceres CLONE 1513196
  misc_feature: Encodes the peptide sequence at SEQ ID NO. 58778
  misc_feature (613)..(613): n is a, c, t, g, unknown, or other
aaagctggagctcaccgcggtggcggccgctctagaactagtggatcccccgggctgcaggaattcgtctcacccctagaaaaaacgaggtcgaggcgatgccgaccttccacttcgtcaagaacggcaagacggtcgcgaccatcgtgggtgccaggaaggacgagctcctggcccagatcgagaagcatgccgcgcctgcgcctgcgtctgcgtctgcctaaaggagatcagtcgtcgccgtcaataagggccagcacgtatggctgtaaatgttgtcgttatcagttctggctttgtcatttgtgggcgattgtgaactagtagtatgtttgtttctatccgagccggaggctatacttacccctcgatacttggtgggagtgcgtttctgttcccctgtgacccccccattgaatcgacccgctcaccactgcaccaggccgtgggtgagtggtgacagtgaatttcctggtattcacaatgggtcccctggcaccgtattgggacaactaggataaatccccgttgcggctgccacaaaaaaaaaaaatacacctggacgccctcctaggtaccccttctccacccctaatagctgcggaccaaattnggcgggtgctcccaccggcccttccctcttcaccgcggttgcggggcggcggtataaa

SEQ ID NO: 58778 - protein, 41 aa, Zea mays
  misc_feature: Ceres CLONE 1513196
MPTFHFVKNGKTVATIVGARKDELLAQIEKHAAPAPASASA

SEQ ID NO: 58779 - DNA, 645 bp, Zea mays
  misc_feature: Ceres CLONE 1513198
  misc_feature: Translation starting site: 141
  misc_feature: SWISSPROT Homolog: EC 3.2.1.23 Beta-galactosidase
aagctggagctccccgcggtggcggccgctctagaactagtggatcccccgggctgcaggaattcgtctcacccctagaaaaaatcaggtgctcttgccaccacagcccgccgttgtgagagctagcgttggaggtggcgatggcggcattgcaagagcagcaggaggaggacggcgacgagggcgagggcgggaaagacgacgacgaggagtcagaggatgatggggtagggtgggggcaactgatctgatcttctcttgacgcttgtcccgaggcgtcctgtccgcttgtggcggtgtagcagtaagatattggcgcaataggctcaatcaccctttttttcccctctctctctctctctatctcatcattttctttcctgcttctacgttgctgtgcttgattttttaaccacttttgttcctatgaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaagcccgcaccgatcgcccttccccacagttgcgcagcctg

SEQ ID NO: 58780 - DNA, 807 bp, Zea mays
  misc_feature: Ceres CLONE 1513202
  misc_feature: Pfam Name: TMA7 Pfam Description: Translation machinery associated TMA7
aactccagacactacgcgccatccccccccggaccgggaggaaacaaacatcttttttcaaactggagctccccgcggtggcggccgctctagaactagtggatcccccgggctgcaggaattcgtctcacccctagaaaaactctccgcctcgcgcacccggttccgcgtgcctttccccacctactctcgcggctctcgccagccagtctagggtttcggtcccggcgtgcttatccgccccccgccggccctgtcgaagcatggagggaaggccaagccgctgaaagcgcccaaggtcgactagaaggagtacgacgagacggattcttgcttttttggtgtattgaagacaaataaagaaaaagcactgaaaaaaccttaaaggcccagccaaagaaggggcgcgtactggcgggcccccgtgtctaatccactacaccaccacaaccaaagaccgcccgcggggaacgcaatgttgtgtcttccccccccccctcccaatatacggagcgcctgcacttggcacaccacaattttttagcgacgtgcggtgactcgggcggaaaacggcggggccggtcaccccctgactgttgcttctacccaatgagggtagaaaatttctcctctttcccacccatcccctgtagtttttattacaccaaccacgttctaggacaacagagatcggccgcacgcaccacaaaatgatgagagacaacgcggtgttaggtgttccccccctgctccctactggggccaaccaccgccgctctgcttgctcgctccacaaacacacccacg

SEQ ID NO: 58781 - DNA, 786 bp, Zea mays
  misc_feature: Ceres CLONE 1513204
  misc_feature: Encodes the peptide sequence at SEQ ID NO. 58782
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (457)..(457): n is a, c, t, g, unknown, or other
  misc_feature (461)..(461): n is a, c, t, g, unknown, or other
  misc_feature (462)..(462): n is a, c, t, g, unknown, or other
  misc_feature (463)..(463): n is a, c, t, g, unknown, or other
  misc_feature (464)..(464): n is a, c, t, g, unknown, or other
  misc_feature (474)..(474): n is a, c, t, g, unknown, or other
  misc_feature (476)..(476): n is a, c, t, g, unknown, or other
  misc_feature (477)..(477): n is a, c, t, g, unknown, or other
  misc_feature (479)..(479): n is a, c, t, g, unknown, or other
  misc_feature (480)..(480): n is a, c, t, g, unknown, or other
  misc_feature (786)..(786): n is a, c, t, g, unknown, or other
tttcctccctttcccttatttttcctttnnnnnnnggggnnnnnccgggatnnnnnngcatactagggctccccgcggtggcggccgctctagaatagtggatcccccgggctgcaggaattcgtctcacccctagaaaatcgagcctgacccttacgccttcgctcgcgccgccgccgccgccgccgctacgccccgcacctcgcttcatttcgtgtcgccaagatgacgaagcgcactaagaaggcaggaattgttggcaaatatggaaccaggtatggtgctagcttgcgtaagcaaatcaagaagatggacgtatctcagcattccaagtacttttgctagtcctgtgggaaggtgggtggtgaacaggaaaccttttttttttttgggggtgcaaaggactgtgggaaagttttttgttcccccccccctaggggggggaagaagggggggncccnnnncccccccccnanncnnttattccctcttccaaaaaaaaaacacaccctccccctttccacctcggccttttcctcctttaccccccctttcccctcctcaccttacctctctaatcccccccatctcccccatatccccccccttttctccccactcacacccatcacctcttctccacccccccccctcctccattttccccccccccaccccaccacccccccctccccttttttaccttcccctccccctctccccccaccccccccacaccccttcatccccccatattcatacccccccccccccccatttactttn

SEQ ID NO: 58782 - protein, 39 aa, Zea mays
  misc_feature: Ceres CLONE 1513204
  misc_feature (2)..(40): Pfam Name: Ribosomal_L37ae Pfam Description: Ribosomal L37ae protein family
MTKRTKKAGIVGKYGTRYGASLRKQIKKMDVSQHSKYFC

SEQ ID NO: 58783 - DNA, 659 bp, Zea mays
  misc_feature: Ceres CLONE 1513267
  misc_feature: Encodes the peptide sequence at SEQ ID NO. 58784
aaagctggagctccccgcggtggcggccgctctagaactagtggatcccccgggctgcaggaattcgtctcacccctagaaaaaaccggccgctctcctagtccagcatgtacagctactatctgtactgggaggggaagtggtattggtggtcgtcggggtactggagcgaacctaacgataccgaaccacctcaggacagctctgccgacggtgtgatcttgatcaaggatatggcggagtggcaaaagcactgtgaccagactgctccatacaacaagctgctggtgtatgagttctacgaaaagaattcctcgctgtgcaaggccatggacaagccgttcgagaagctcgccacgcagtacaaaggcagggccgacttctgcaagctggacgtggacaactttgagcttttggcgcggatttgcggagtggaaggagcgtatccgacgttcgtgctgttcaagaaatgcgcgcaggtgggcaaggtcgttggcctcaaggaggacgacctcgagcggagcgtccagcgagcgataataagctaggagtagtcgtcatgtagtactacacagactcagttttcgtacgtgtgcccagacaaaactacaaaaggacatgactaatatgcgtacccatcgatcggcacagtggcggat

SEQ ID NO: 58784 - protein, 146 aa, Zea mays
  misc_feature: Ceres CLONE 1513267
  misc_feature (37)..(143): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
MYSYYLYWEGKWYWWSSGYWSEPNDTEPPQDSSADGVILIKDMAEWQKHCDQTAPYNKLLVYEFYEKNSSLCKAMDKPFEKLATQYKGRADFCKLDVDNFELLARICGVEGAYPTFVLFKKCAQVGKVVGLKEDDLERSVQRAIIS

SEQ ID NO: 58785 - DNA, 698 bp, Zea mays
  misc_feature: Ceres CLONE 1513268
  misc_feature: Encodes the peptide sequence at SEQ ID NO. 58786
aaagctggagctccccgcggtggcggccgctctagaactagtggatcccccgggctgcaggaattcgtctcacccctagaaaaaaaccgagacaccgcgtgcgaaccaagcagaccccagcagaagaagcgaagtcgtcgccggagcaggaggaagagcgagcagcaagatgtcgtggcaggcgtacgtcgatgaccacctgctgtgcgacatcgaaggccagcacctcagcgccgccgccatcgtcggccacgacggcagcgtctgggcacagtccgagaacttccccgagttaaagcctgaggaggttgctgggatgataaaggactttgatgaacctggaactcttgcaccaactggtctttttgttggaggtacgaagtacatggtgatccaaggtgaacctggagttgtcatccgaggaaagaagggcactggaggcattactatcaagaaaactggcatgtccttgattatcggtatctatgatgagccaatgactcccagggcaatgcaatatggtggtgggagaagctccggcgaattaccctgacggaacaggggcttctaaggtttgtcctaaacggctatttttgggcacttggggcacttaaaggtttgccccccccttttgggattcctgtaaaattgggggggcttggtgccatgtggcctttggcggaaactgctatgaaaag

SEQ ID NO: 58786 - protein, 127 aa, Zea mays
  misc_feature: Ceres CLONE 1513268
  misc_feature (2)..(126): Pfam Name: Profilin Pfam Description: Profilin
MSWQAYVDDHLLCDIEGQHLSAAAIVGHDGSVWAQSENFPELKPEEVAGMIKDFDEPGTLAPTGLFVGGTKYMVIQGEPGVVIRGKKGTGGITIKKTGMSLIIGIYDEPMTPRAMQYGGGRSSGELP

SEQ ID NO: 58787 - DNA, 640 bp, Zea mays
  misc_feature: Ceres CLONE 1513271
  misc_feature: Translation starting site: 86
tggagctccccgcggtggcggccgctctagaactagtggatcccccgggctgcaggaattcgtctcacccctagaaaaagaaaaaatggcgcggggccttctgggttggcacccgtgttacagaatgataggcaatcaggccctgaggaagcaaggactagtggttggtcatcaatggatcggcgtcgtgccccactaccaattacaagtgtggggacattatctaagcagaaagcaccggtagggaatgatgctactgtttctagagatgctgtgatatctggaccaaattttatgggaaggtcaagtggatcttcaaggaagcctgttgtttccagtagccgtgatatggtggccactgacagttccgagccttcacgagcacgtgcaaccgacgcaagcccaggggcgttccgcagagcctcacgtcctcagagaagctcacctgtccattccgcacaacagaagcgctcatcctcaggccggcatccgtctaacgtgaagaactacgattctgctctcaaaggcattgaaggtcttcattttgatggcgacgagagggttcagtactagagccgcacgaaattctacatgcactgtaaaaatcataatcaggtggtaagcatcgtgtttcctgttt

SEQ ID NO: 58788 - DNA, 690 bp, Zea mays
  misc_feature: Ceres CLONE 1513275
  misc_feature: Encodes the peptide sequence at SEQ ID NO. 58789
  misc_feature (398)..(398): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (405)..(405): n is a, c, t, g, unknown, or other
  misc_feature (406)..(406): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
atatctggagctccccgcggtggcggccgctctagaactagtggatcccccgggctgcaggaattcgtctcacccctagaaaaaccgctctctatcctcccactcaaatactcctcaatagccatcgaggagaagggagatagaaaccggagggaacacccactcgatggggagccatgacccgaggacagaactctgagtctcacaccggacacgtccccgccgcatacgcggcgacgccagggcccaactcggtgtccgccgtgggctggaaaggctcgggaggccactctgtggagcggaggatgcactctgagcttatggttctgatgatgggcgagtacccgaggcgtgttgtttttttcccccccccacaaggggggagaggggggggaccntnnnncnnttcctcccnnnatggcctatcaagggaaaatcaaaacaatttggcgttgggctggggcgcctaatgacccgtacgaaccggcctaagggccccctctaccccccctggttacaccccaacgggccacctgcgctgggcttcttttggcttgtctatttttttgcataaaatggtttcccctccctacaaccgcccctacacaccttcttcccctttcggacccccgttctgtggttcctacactccctttccttcctttcggtggtccagcggtccgtggttgg

SEQ ID NO: 58789 - protein, 97 aa, Zea mays
  misc_feature: Ceres CLONE 1513275
  misc_feature (75)..(75): Xaa is any aa, unknown, or other
  misc_feature (76)..(76): Xaa is any aa, unknown, or other
  misc_feature (77)..(77): Xaa is any aa, unknown, or other
  misc_feature (80)..(80): Xaa is any aa, unknown, or other
  misc_feature (81)..(81): Xaa is any aa, unknown, or other
MTRGQNSESHTGHVPAAYAATPGPNSVSAVGWKGSGGHSVERRMHSELMVLMMGEYPRRVVFFPPPQGGRGGGPXXXSSXXGLSRENQNNLALGWGA

SEQ ID NO: 58790 - DNA, 390 bp, Zea mays
  misc_feature: Ceres CLONE 1513280
  misc_feature (201)..(201): n is a, c, t, g, unknown, or other
tggactcccccggtggcggccgctctagaactagtggatcccccgggctgcaggattcgtctcacccctaaaaaagtcggtagccgtcggttcacttctccggtaaggaaagggttcgtactcatggcgccgccgcagccaaagtcggggcctcttcgttggcatcaaacagggtcatgtcgtcaccaaagcgcgaattgnctcccccgccccgtgcccaccgcaaggggggaaaatccacccaaaaaagggtttttccatttgggtcaagggggcccctaaaatcaaaaaaaaaatttttccccgggggtttttccccccccccctttaaaaaaaaaaaaagggggtttttccccctggggaaagactttttttttaaaaaaaaagggg

SEQ ID NO: 58791 - DNA, 649 bp, Zea mays
  misc_feature: Ceres CLONE 1513281
  misc_feature: Encodes the peptide sequence at SEQ ID NO. 58792
aagctggagctccccgcggtggcggccgctctagaactagtggatcccccgggctgcaggaattcgtctcacccctagaaaaactactgacgagctcgccatggcctccctctcctctgccgccgtcaccgccccttccttcgacgcaccagcgccagcccacgccgtggtcagaaggaggtccttcaccgtgcgcgcctctctccgcaaggccaccggcaccgccgccgtggaaatggctgccagcaccctgcttgcctgctgtgccatggcccacgaggtgctgctgggcgcacgccaccgcggactcgtcttcgagcccagccagttcaccgtcaaggccggtgacaccatcacattcaagaacaacgccagcttcccgcacaacgtcatcttctacgaagactatgtgccaagcggcgtcaacgccaccaagatctcgcaggaagagtacctcaacgcgccaggcaagacctactccgtcaccctcaccgtgacaggaacctacggcttctactgctagccgcatcaaggagccagaatggtcggcaagatcaccgacaactaattaagctagctatcgatcgatatccattcatgtattagcatgatgcttcctgctttgtactccgccgatctgtccatcact

SEQ ID NO: 58792 - protein, 140 aa, Zea mays
  misc_feature: Ceres CLONE 1513281
  misc_feature (59)..(141): Pfam Name: Copper-bind Pfam Description: Copper binding proteins, plastocyanin/azurin family
MASLSSAAVTAPSFDAPAPAHAVVRRRSFTVRASLRKATGTAAVEMAASTLLACCAMAHEVLLGARHRGLVFEPSQFTVKAGDTITFKNNASFPHNVIFYEDYVPSGVNATKISQEEYLNAPGKTYSVTLTVTGTYGFYC

SEQ ID NO: 58793 - DNA, 632 bp, Zea mays
  misc_feature: Ceres CLONE 1513284
  misc_feature: Encodes the peptide sequence at SEQ ID NO. 58794
aagctggagctccccgcggtggcggccgctctagaactagtggatcccccgggctgcaggaattcgtctcacccctagaaaaaaatcagatagagagagcatagtcgatcatgaacggtggcaagaaggaagtggccggtgcggtggtggccatactgctggttctgcagctcatggcaactccaccgacggtcatggccgcccgctcgccgcgcggagccgtgccggatggctccctcgccacgacgcccaaagtgacgatgctgtcggccacgctgtgctacacgggggagacatgcaaatacactccctgcttcactcctgcttgctcctgcagctttagtgatcgcctctgctacgtcatatttactcctgttgcttgagttgaggccattccgctaagccacaactcttacatgcatgcgccggtcgacgacgacgacgctgcctctcgtgagcttctgttcaagtgatgcatgtttcaaggcatccatggatgctttacgtatatgcgtattaattatccgtgtcaaggaaccggacagaaggcggtgttgttttcttttcgcctactggtgcatcactttatggggaaatacatcttggatctgtgcaaaacaaaaaacaaaaac

SEQ ID NO: 58794 - protein, 90 aa, Zea mays
  misc_feature: Ceres CLONE 1513284
MNGGKKEVAGAVVAILLVLQLMATPPTVMAARSPRGAVPDGSLATTPKVTMLSATLCYTGETCKYTPCFTPACSCSFSDRLCYVIFTPVA

SEQ ID NO: 58795 - DNA, 646 bp, Zea mays
  misc_feature: Ceres CLONE 1513286
  misc_feature: Encodes the peptide sequence at SEQ ID NO. 58796
tggagctccccgcggtggcggccgctctagaactagtggatcccccgggctgcaggaattcgtctcacccctagaaaaaagcagtgacgaactcgaagcttgcgttcttgtagtagaggtcggcagcaagcggtagagcgagaggtcgagaagatgaagagcagcactctgttggcgatcctagttctccaggcccttctggtctctgcggccgtggccaaaggacctgcagggccgacgacgaagaagcagtgctggtgcggcgagtgcaccagctggtcgggcgtgtggacctgcgacgacctcctcaccaagtgcgccgccacctgcaagaactgcgtccccgtgtccacggacaagggcaccaccaagtacaggtgtcgcgacttcctccccgaaaactgcggctgcaagatccactagactcatccacagcggcacagccgatggatccttccatgctcctccgtccgtccgccttgctataagcaggcaggcagccaccaataagctagctcttgctgttgttttgcatgtttgattgggtgtcccttcccagtcgagatggaataaaataaatgtcaggcgctaaaaaaaaaaaaaaaacgagacgctcgaggtacccaatcgccctatagtgagtcgt

SEQ ID NO: 58796 - protein, 89 aa, Zea mays; identical to SEQ ID NO: 50292
  misc_feature: Ceres CLONE 1513286

SEQ ID NO: 58797 - DNA, 653 bp, Zea mays
  misc_feature: Ceres CLONE 1513287
  misc_feature: Encodes the peptide sequence at SEQ ID NO. 58798
aagctggagctccccgcggtggcggccgctctagaactagtggatcccccgggctgcaggaattcgtctcacccctagaaaaaacgcttccttgtctccaccgcgagcgacctccatacaacggtgtcagcggcctccctacgccaccgtcctcatccgccgccgtcgtccactacaccgccacggtcgtcctcggtcgcgaccgcgcccttcgttctcatccagcgccacggtctagggcatgacctattgatcaggaaagttgtagcagacacgttcgtcgtcgcgaacatcgtcgagccgtgtggctactgcgctggccggtgagcatcgtcaagtcgtgtggctgctgcccctgaccagcacgatgcgtctctggtctcccatgatgattagatggcacctgatcaccgcgtctctgaacacctgatcaccgggagctcttcatatttaagaaggcatggaacatcagtgcttgcacaagagtttatggtgtctacacatgattatgacattgaagaagaagaagaaatccatgggtttgcattgcctcaccagtctgcacctcgtgatatggaaagcaccgggagacatccattcagacatcaaatagttcggttatctgaaacagctgatataaagtttaaatggcg

SEQ ID NO: 58798 - protein, 85 aa, Zea mays
  misc_feature: Ceres CLONE 1513287
MAPDHRVSEHLITGSSSYLRRHGTSVLAQEFMVSTHDYDIEEEEEIHGFALPHQSAPRDMESTGRHPFRHQIVRLSETADIKFKW

SEQ ID NO: 58799 - DNA, 713 bp, Zea mays
  misc_feature: Ceres CLONE 1513288
  misc_feature: Encodes the peptide sequence at SEQ ID NO. 58800
  misc_feature (312)..(312): n is a, c, t, g, unknown, or other
  misc_feature (356)..(356): n is a, c, t, g, unknown, or other
  misc_feature (403)..(403): n is a, c, t, g, unknown, or other
  misc_feature (404)..(404): n is a, c, t, g, unknown, or other
  misc_feature (423)..(423): n is a, c, t, g, unknown, or other
  misc_feature (702)..(702): n is a, c, t, g, unknown, or other
  misc_feature (713)..(713): n is a, c, t, g, unknown, or other
aagctggagctccccgcggtggcggccgctctagaactagtggatctcttgggctgcaggaattcgtctcacccctagaaaaagagccacggagagcaaaggcagcacactcagctatccagcaaaagagatcgagacgcaggagtcatggccaccgtcagcgccgccgtggtgaccaccatcgttgcccgcgccgcgatcgccaggcccaatgctctagggctgcctgcgctgagggcgaggagcgagagggtgcggtgcatctacgccaaggacgcggcccctgtcagcaccaagggcgcgggcgcgtcnctgctcgcctctttgggcgcggtgaccgcgtcggcggggccccncttttttttctcccccccccaccggggaacgacaggggggcaccttnncttaaccctcttttttcancaacaccctgcctgggctgggatcctccttgggggtctttggggcgccatccttggtcccctcaccccccttttgcacctctctgacctctccaccacgactgagggagttcccctgggccttccttctttttagatccccccccccggccggataaatgcgtcttcaacttttcacctttggccgccctttccccccgtttttccgcgctctccccgcggtttcttttgcgcaccaaatgtcccgtggtcacagccgatacacactatccgtcgcctncttgttttttn

SEQ ID NO: 58800 - protein, 136 aa, Zea mays
  misc_feature: Ceres CLONE 1513288
  misc_feature (70)..(70): Xaa is any aa, unknown, or other
  misc_feature (86)..(86): Xaa is any aa, unknown, or other
  misc_feature (92)..(92): Xaa is any aa, unknown, or other
MATVSAAVVTTIVARAAIARPNALGLPALRARSERVRCIYAKDAAPVSTKGAGASLLASLGAVTASAGPXFFFSPPHRGTTGGHLXLTLFFXQHPAWAGILLGGLWGAILGPLTPLLHLSDLSTTTEGVPLGLPSF

SEQ ID NO: 58801 - DNA, 669 bp, Zea mays
  misc_feature: Ceres CLONE 1513289
  misc_feature: Encodes the peptide sequence at SEQ ID NO. 58802
aaagctggagctccccgcggtggcggccgctctagaactagtggatcccccgggctgcaggaattcgtctcacccctagaaaaaagtccaccactcgttcgttccaaacggagaagaggatcaggttcgttccaagggaagggagaagagggtcaggagagagagagagagagagagagagcccttgctcgttcgttcaccaccacagctccgatcgatccgcaaggcaggcaagatgtacaacgcgccgtcggcccaggagatgtcctacttggagcacgtgcagaggcgccacgaggagaagggctgcctctacgcctgcatcttcactgcgctgtgctgcttctgctgctacgagacctgcgagtgctgcctcgactgcctctgctgctgctgcaactagccggggctagctccggaggacggtcgagacgcagcagatggaggtcgcctccgtctcttctacctacctaccaatctacctagtgatgatgattcagttcccgtttagtctggtggtgtgcaagtgcaaacataataacgcacgcatgtcgtagcgtagtacaggagagatgttttactctgtcagttccagtttgagcattcgtaaacccaaccaccatggtctgaactctgaaccaccgcaaaaaaaaaaaaaaaacgagaccc

SEQ ID NO: 58802 - protein, 55 aa, Zea mays
  misc_feature: Ceres CLONE 1513289
MYNAPSAQEMSYLEHVQRRHEEKGCLYACIFTALCCFCCYETCECCLDCLCCCCN

SEQ ID NO: 58803 - DNA, 815 bp, Zea mays
  misc_feature: Ceres CLONE 1513293-R
  misc_feature (727)..(727): n is a, c, t, g, unknown, or other
  misc_feature (785)..(785): n is a, c, t, g, unknown, or other
ttcgaattgggtacctctagcgtctcgtttttttttttttttttcgaatttaaacaacaggttctgatatatatacataccatatcatgtcatcggagaccacttaatatatgatcacaacaaatgcaaccagatcacccaccaggagggggtactctctttcatgcgtaatcacaaaaactgacgccaaacatgctaagacagatatcaaactgaagaactctgtttctctctctctcacacacaccacacaatacctatgtatggcacccaactcggcctctcttattattgttcaaccaccaccacaagctagatagataataatcatacccatggtcatccatcgatgtgatcagcaattgcaggggtcccacttgcaattgccaccgcacctactgacctgggcggcctctccggactccaccactgcctcaacgaactcgagcgcggccttcttctcctggaccaccccgatgacgacgatggcctgctccgatgtgctcatctcctccaggtcatggtacttcttgccccacttgatgcttgagcctcagccgcaccttgatcctcagttgcaagacatactcgcaccttgtggtgcaaaacgaaactcaatctcttcaagaatcatcgaaacaagccgtcttatatgctagttttttttttctaggagatgagacgaactcatgcagcaccccttggatccactacttaatagaaagancgccaccgacgaaggagctccagcattatgttgcaccctgaatcagggttcatatgcngcgcttgtgcgtaatcattggtcattagct

SEQ ID NO: 58804 - DNA, 661 bp, Zea mays
  misc_feature: Ceres CLONE 1513295
  misc_feature: Encodes the peptide sequence at SEQ ID NO. 58805
  misc_feature (661)..(661): n is a, c, t, g, unknown, or other
aaagctggagctccccgcggtggcggccgctctagaactagtggatcccccgggctgcaggaattcgtctcacccctagaaaaaatattccttcgcttccgtcaggtcgggtccgcagcctccccctctcgcagatccccacctgctccgccgccggccaccgcgttgctcccctcggcagccaggatgacagaagtaccatttctgccacgtgagaggctcttcaagcagcaacattacttccagaacttgaccaagcacacctacctgaaagggcgctacgacgtgatcacctccgtcgccatcccccttgcactcgctgcctccagcatgttcatgattgggcgtggagtttacaacatgtctcatggggttgggaagaaagagtgatcttccactggttaactattgtttctgcttggcatggaagtcataccgtcgagactgcgaagtcctcttcgcttgcaaaataatacggccaaataacaattcgactacattttcgcatcaattttctgtttgtatttgtgggtgtgaagtggcagtaacttgaaaatcagcactgtcactgttttggttagttactccattcctttcgtcttttgtgtcccctttcaatagaagcaagctggccttgtacttcctcaaaaaaaaaaaaaan

SEQ ID NO: 58805 - protein, 67 aa, Zea mays; identical to SEQ ID NO: 37080
  misc_feature: Ceres CLONE 1513295
  misc_feature (9)..(62): Pfam Name: COX7a Pfam Description: Cytochrome c oxidase subunit VIIa

SEQ ID NO: 58806 - DNA, 750 bp, Zea mays
  misc_feature: Ceres CLONE 1513300
aagctggagctccccgcggtggcggccgctctagaactagtggatcccccgggctgcaggaattcgtctcacccctagaaaaaactcctccctgctcggtgtatcacgcccgctaccaactcgcataataccctctttccgtctaaaagaatagaacggtgcagcgggtcgaagctggaggaagcggacgggggcaccttggggtccaagagatcctcgagctgcagtgccgtccccagaaactttaggctgctccaagaacttcaacgaacttgagaaaggcattgtgcgatggaactgtaaagctatccgaaggacaagatatcttgatgacatattgtacgcggttcctgataccggaaactatgcatctccacctctacaacatctgctagtcgaccgtgacgagatctagtgaacataatagatgttcctcccgacttcgagattcctccattacaaaacgcacggtagagtcccccatattccagacttcgccatgcatgtagtgagaatgtagtatacaccctcgcaatcctcggatggagctcgaagccgtagtcggattgaccgtatacccttgcgccagacggtgaaaagggtacccctccggatcggcacgaacatttcttgcacccacccttatttcaaggggagactgtcccaagcttcccctccaaaacgacaaggattgtcccaattccctccgtgaaacggccattgcaactaccttacaccccccccacgcat

SEQ ID NO: 58807 - DNA, 758 bp, Zea mays
  misc_feature: Ceres CLONE 1513302
  misc_feature: Encodes the peptide sequence at SEQ ID NO. 58808
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
nnngggttttgttataaataattttcaattgcccnnnnnnnctctnnnnnnccaaactggagctccccgcggtggcggccgctctagaactagtggatcccccgggctgcaggaattcgtctcacccctagaaaaactagccgcctgcctctcctcctccagagctcgtcgccaccggccaccgccaccctcgatcacgccgtccgtcgaggtaaggtcagcatggtgagggtcagtgtgctcaacgatgcgctcaagtccatgtacaacgctgagaagatcggcaagaggcaggtcatgatcaggccgtcgtccaaggtcatcatcaagttcctgacggtcatgcagcgccacggctacattggagagttcgagtacgttgatgaccaccgatcgggcaagatcgtggtcgaactcaacgggaggctgaacaagtgcggcgtcatcagccctcgctttgatatcggcgtgaaagacattgaggggatggactgcaaggctgctccccgtccaggcagttcggatacatcgtcctcccaacttccgcaggcatcatggacccacgaggaggccccgccggaaaaagctgtaggaggcaagggttcttaggttttctttctattcgaaagaaagcttgaaaaatcttttgttattgggccccggccctgccctggaccttacatgctcctgcaaaccttaaaatcaccccggcgttatttgttccccttataaaatatggcagcctcttctcttaagaa

SEQ ID NO: 58808 - protein, 128 aa, Zea mays
  misc_feature: Ceres CLONE 1513302
  misc_feature (5)..(126): Pfam Name: Ribosomal_S8 Pfam Description: Ribosomal protein S8
MVRVSVLNDALKSMYNAEKIGKRQVMIRPSSKVIIKFLTVMQRHGYIGEFEYVDDHRSGKIVVELNGRLNKCGVISPRFDIGVKDIEGMDCKAAPRPGSSDTSSSQLPQASWTHEEAPPEKAVGGKGS

SEQ ID NO: 58809 - DNA, 679 bp, Zea mays
  misc_feature: Ceres CLONE 1513311
  misc_feature (375)..(375): n is a, c, t, g, unknown, or other
  misc_feature (378)..(378): n is a, c, t, g, unknown, or other
aaagctggagctccccgcggtggcggccgctctagaactagtggatcccccgggctgcaggaattcgtctcacccctagaaaaaaggagctttccagcgccttccagagtttcggaagagtagtaagcgctaaggtgttcgtggacaaagcaacgggcgtcagcaaatgcttcggtttcgtgagctacgactctcctgcctccgcgcaggcagccatcaacaggatgaacggctaccagttaggcggtaaaaaactcaaggtacaactgaagagagaaaacaacaccaagcacagtagtaaaccgttttgacagacaaggcagcagccgtccggtacccggtacatattaattgaccgtcaacacattgcaccancancctcagggcctggggagggaagagacccgtgtaccctctttgttcacttcaacattcttggagattcgtcagctcagctcagctcgtgtaattcattgcagcagacataggccgtagcagccgtttgtaccatgatcagatcacttgtacacatgattcattcaattggtactgacagcccgtctttcatcctaaaataatttcgctgtgacaacccttatcattttgctgaccaatgaaagtccggtaaaactttgttccttaaaaaaaaaaaaaaaaccaaaacccccccgagttctcc

SEQ ID NO: 58810 - DNA, 648 bp, Zea mays
  misc_feature: Ceres CLONE 1513312
  misc_feature: Encodes the peptide sequence at SEQ ID NO. 58811
  misc_feature (443)..(443): n is a, c, t, g, unknown, or other
  misc_feature (444)..(444): n is a, c, t, g, unknown, or other
tggagctccccgcggtggcggccgctctagaactagtggatcccccgggctgcaggaattcgtctcacccctagaaaaaaaaggtgagcgagctttccttcggaactctcgtgctcacctcatccgtccgacaaatccacacgaatcctctgattcagagcagggtgttggcattgatcagacgcctgccatggcggatcagttcgtggattcggcgaacaatgtgatcattgaggaggtgaacaagggcctgaacccaggaatggtggttctgcttgtggttgcaagcttcctgctgctcttctttgtggggaactatgcgctgtatgtgtatgcgcagaagacgctcccgccaaagaagaagaagccggtgtcgaagaagaagctgaagagggaaaagctgaagcagggggtctctgcgccgggagagtaaacggccatgnnctgccgatcctcccgtccagagctcctattcacctggattataaagaaaaaaattttatttatttcccagctggagccgaattgtttgaagtactttggtcctgaagatgctctggcttttaagggacatctgaattggagaaaaaaaaaaaaaaaacgagccgctcgaggaccccattccccccataggggagcccaataccc

SEQ ID NO: 58811 - protein, 80 aa, Zea mays; identical to SEQ ID NO: 816
  misc_feature: Ceres CLONE 1513312
  misc_feature (10)..(80): Pfam Name: S1FA Pfam Description: DNA binding protein S1FA

SEQ ID NO: 58812 - DNA, 633 bp, Zea mays
  misc_feature: Ceres CLONE 1513315
  misc_feature (302)..(302): n is a, c, t, g, unknown, or other
  misc_feature (383)..(383): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (396)..(396): n is a, c, t, g, unknown, or other
  misc_feature (398)..(398): n is a, c, t, g, unknown, or other
  misc_feature (399)..(399): n is a, c, t, g, unknown, or other
  misc_feature (404)..(404): n is a, c, t, g, unknown, or other
  misc_feature (409)..(409): n is a, c, t, g, unknown, or other
  misc_feature (483)..(483): n is a, c, t, g, unknown, or other
gagctccccgcggtggcggccgctctagactagtggatctcttgggctgcaggaattcgtctcacccctagaaaaagttgccataccaccagtactagctcgctcgctcgcttgctctcagaactgatcgctgtgaggagtatgccgtcgctgtggccaacgaggaagaagcgggcgcgaggctcggcggtccggtcgtggtcgcgccgccgcgggagcaagaaatcatcgtcgtcgtcgtcgctgggggcgctgtggcggcggatggtcgggccacgctgggggacccggacccggactcngacccgggcccgggggaagaagccggggctgctctcgcgcgccgcgcttgtgctcccctcccggcggggggggggggggcnatgccctccnnnncnnacccncccgntggaatcaaatcgtcccaatcgggatcctgccggggcgtggccccccctgccttggcctctttttccccttccnggggccggggtttttggggccggccccccagcccttctttttttccccgggcctggctcctttcctcgtggggggggccctcctacgatcccccttcccagcttggggtcggcttaaaacttctccttcgcggaaccgcccccccccccc

SEQ ID NO: 58813 - DNA, 864 bp, Zea mays
  misc_feature: Ceres CLONE 1513316
  misc_feature: Encodes the peptide sequence at SEQ ID NO. 58814
  misc_feature (11)..(11): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (29)..(29): n is a, c, t, g, unknown, or other
  misc_feature (30)..(30): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
gttccgggatnctnnnnaaaaacactttnntnnnggaaaaaannnnnaaacgtagagctccccccggtggcggccgctctattactagtggatcccccgggctgcaggaattcgtctcacccctagaaaatcgaggtagcagctccccccgcaaaaaccctagctttacctccccacaagcgcctccaagatgaagctcgtcaggttcttgatgaagctgaacaacgaaacggtgaccatcgagcttaagaacggcaccgtcgtacacggaaccattaccggttatccggccgattatggcttacatagacggacagctatcctcagatagttaagcgtcgacatccaggagaaatactcatcccgaaaactgttgaaccctgaccctacataggggaaaaaatcctggtatcttttttttcccccccccccggggaggaaagaaggggggcccccttcttacaacccctcccccccgagcagtcctaaccacctctgcaaaaccattcgcttcgcctgccggcgtaatttccgcatggggcgtccgtggcccacaagtccgcgcccctagtacctagtagcgctgcggactccttcgcgcgccgcctcgctgcagctttgtcctccgccccgcacctcgactccataacgcctccccgtgtacttcgggccgtagcacagaccccccctcccgccctactatgtcatagcggcacaacacacaccgcgaccgcacagccgccggatgtcttcgccggttgctcccccccctctacttccaccttattatccgccgccacctccccaaattggccaatgccatcagtgcctcccatctctatcccccgcgacccggagaagggg

SEQ ID NO: 58814 - protein, 46 aa, Zea mays
  misc_feature: Ceres CLONE 1513316
MKLVRFLMKLNNETVTIELKNGTVVHGTITGYPADYGLHRRTAILR

SEQ ID NO: 58815 - DNA, 652 bp, Zea mays
  misc_feature: Ceres CLONE 1513320
  misc_feature: Encodes the peptide sequence at SEQ ID NO. 58816
  misc_feature (458)..(458): n is a, c, t, g, unknown, or other
  misc_feature (503)..(503): n is a, c, t, g, unknown, or other
  misc_feature (524)..(524): n is a, c, t, g, unknown, or other
  misc_feature (545)..(545): n is a, c, t, g, unknown, or other
  misc_feature (546)..(546): n is a, c, t, g, unknown, or other
  misc_feature (563)..(563): n is a, c, t, g, unknown, or other
  misc_feature (564)..(564): n is a, c, t, g, unknown, or other
  misc_feature (569)..(569): n is a, c, t, g, unknown, or other
  misc_feature (599)..(599): n is a, c, t, g, unknown, or other
caaagctggagctccccgcggtggcggccgctctagaactagtggatcccccgggctgcaggaattcgtctcacccctagaaaaagtgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccgagggcatgaacggcaaggagctggacggccgcaacatcaccgtcaacgaggcccagtcccgcggcggccgtggaggcngcggcggtgggtacggtggtggccgtggaggcggcggctaccgcngtggcgggcgccgtgatggcngcggcggctaccgcggtggcnngcgcggctaccgtggcnngcgcngctacgggtgtggtggcggcggctacggcngtggcaacgtgggcggcggctacggcaactccgaacggaactggaggaactgg

SEQ ID NO: 58816 - protein, 156 aa, Zea mays
  misc_feature: Ceres CLONE 1513320
  misc_feature (10)..(80): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (92)..(92): Xaa is any aa, unknown, or other
  misc_feature (107)..(107): Xaa is any aa, unknown, or other
  misc_feature (114)..(114): Xaa is any aa, unknown, or other
  misc_feature (121)..(121): Xaa is any aa, unknown, or other
  misc_feature (127)..(127): Xaa is any aa, unknown, or other
  misc_feature (129)..(129): Xaa is any aa, unknown, or other
  misc_feature (139)..(139): Xaa is any aa, unknown, or other
MAASDVEYRCFVGGLAWATDDHSLHNAFSTYGEVLESKIILDRETQRSRGFGFVTFSTEEAMRNAEGMNGKELDGRNITVNEAQSRGGRGGXGGGYGGGRGGGGYRXGGRRDGXGGYRGGXRGYRGXRXYGCGGGGYGXGNVGGGYGNSERNWRNW

SEQ ID NO: 58817 - DNA, 844 bp, Zea mays
  misc_feature: Ceres CLONE 1513321
  misc_feature: Encodes the peptide sequence at SEQ ID NO. 58818
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (72)..(72): n is a, c, t, g, unknown, or other
  misc_feature (386)..(386): n is a, c, t, g, unknown, or other
  misc_feature (387)..(387): n is a, c, t, g, unknown, or other
  misc_feature (417)..(417): n is a, c, t, g, unknown, or other
  misc_feature (472)..(472): n is a, c, t, g, unknown, or other
  misc_feature (473)..(473): n is a, c, t, g, unknown, or other
  misc_feature (474)..(474): n is a, c, t, g, unknown, or other
  misc_feature (496)..(496): n is a, c, t, g, unknown, or other
  misc_feature (498)..(498): n is a, c, t, g, unknown, or other
  misc_feature (532)..(532): n is a, c, t, g, unknown, or other
  misc_feature (557)..(557): n is a, c, t, g, unknown, or other
  misc_feature (572)..(572): n is a, c, t, g, unknown, or other
  misc_feature (596)..(596): n is a, c, t, g, unknown, or other
  misc_feature (635)..(635): n is a, c, t, g, unknown, or other
  misc_feature (642)..(642): n is a, c, t, g, unknown, or other
  misc_feature (659)..(659): n is a, c, t, g, unknown, or other
  misc_feature (663)..(663): n is a, c, t, g, unknown, or other
cctgttattcttctatcccctcttttttccccctnnnnnnnnnnttttnnnnnnncaaattggccctctccncggtggcggccgctctagactagtggatcccccgggctgcaggaattcgtctcacccctagaaaaagtgctttcttagaggtgggttggcttctcctccccctccggttcgggttcgggttcgtgaggttctccggggttcggtttggtgggtgagcggatcgagatggcggcattcgatgttgagtatccctgcttcttctgcgggctcgccttgggtcggaactacccttcccgccccaccgccttcccggccaacgggcgaagttcttccattccaggaccatcctcggattgggagaaggtacaagtcgnnggggtggcccggtttcgttttgttttgccntcttttttttttccccccccgggggggggggggggcggggggctctccccctagnnnggggcccgcgggtgatactcgngngggccaattaacgcgcccatttccccaatttttntcctgccccgcggcgcgcgtgccgngtgagccccatcgtntgttccgccccggccgcgcgctanccctggcttgccttttgccgtgtattgcgcctccagagnctatgtnttttcctatctgtttcnagtnggcgggccttagggtggccgtgccctgcccgtaacgcctcgccccctccctctcgtcgccgcgctctccttcgttgtgtccgctgtttgccccccgcatttcccgaccctgtttctccctgtacttgctgccgcacactctaccctctgtgtttccttaatgctcgctcccttcatccatt

SEQ ID NO: 58818 - protein, 77 aa, Zea mays
  misc_feature: Ceres CLONE 1513321
  misc_feature (50)..(50): Xaa is any aa, unknown, or other
MAAFDVEYPCFFCGLALGRNYPSRPTAFPANGRSSSIPGPSSDWEKVQVXGVARFRFVLPSFFFPPPGGGGGGGLSP

SEQ ID NO: 58819 - DNA, 836 bp, Zea mays
  misc_feature: Ceres CLONE 1513322
  misc_feature (46)..(46): n is a, c, t, g, unknown, or other
  misc_feature (50)..(50): n is a, c, t, g, unknown, or other
aaaagatatatattttttttttatactctatttctcgcgctacccntccnttaaaacgggactccccgcggtggcggccgctctagactagtggatcccccgggctgcaggaattcgtctcacccctagaaaagtgctttcttataggtgggttggcttctcctccccctccggttcgggttcgggttcgtgaggttctccggggttcgggttcgtgggtgagcggatcgagatggcggcgtcggatgttgagtactgctgcttcgtcggcggcctcgtcttgggcccacggacgaccactccctccatgacgccttccgcacctacggtgaggaccctccaggtccaagatcatccttcgattgggagacgtaaaggtcccgtcggctttctgctatagtcacccttattccatgaacgaagccgatgctgcacctgccattcgaaggggccattaatctggataagggaaactgggcaccgacccgcaatatccccccctctaaccattggtctaatgttccacccggccgggtccccccgcgaaagccgcgcagcgcgcaatggggttctggtattgacggggtccctgttataggtttctgaccggccttaatcccccccccttggtatggggcgcccccgtatgcgctggtatggcgatagattcccaacccgtttgcgccctagatgcttatccgttagtatggtcgccgcccccatatcccgcccattcaagaggagcgccgagcaccccgggcgagtgggcccccctcgcgcgggatgttggtttataggttgaacccacttgcgcggggtaattattccgtccaacg

SEQ ID NO: 58820 - DNA, 679 bp, Zea mays
  misc_feature: Ceres CLONE 1513323
  misc_feature: Encodes the peptide sequence at SEQ ID NO. 58821
acagctggagctccccgcggtggcggccgctctagaactagtggatcccccgggctgcaggaattcgtctcacccctagaaaaaaggagtgatgttacacgttttagatatggtgatgaacaacacttggatgaagcactgcagagaatctttcaatatggtttgggtgggggcattcctagacgtaatgcacctatattacaaaagattcgagaggaagtaactgacgatgggaaatacagtttagtactcgtatttcaagccaaagcattggagctatctgattttgagaagagacaggctaaattcacctccttttttggtcctgggattaaggcagaaatcggaaaaggtggcggtgatctatatgaagttcgtctaatcgcagacactgtttagaaacaatctttgtgaattttctctattacaaaactaaacttttttcttttttttttctttgatccgctgattttgcatatatgatgttaatagcatcagattttacccttgttaaaaaaaaaaaaaaaaaaccccccctccccctccccctacctcggaatttaacccccttgcccgcgcccgctcccaagccccaccccccccctaaaagggggtgcctttttccccccccttcctggccccccttttttacagcgcccccccccccggaaaaacccct

SEQ ID NO: 58821 - protein, 132 aa, Zea mays
  misc_feature: Ceres CLONE 1513323
TAGAPRGGGRSRTSGSPGLQEFVSPLEKRSDVTRFRYGDEQHLDEALQRIFQYGLGGGIPRRNAPILQKIREEVTDDGKYSLVLVFQAKALELSDFEKRQAKFTSFFGPGIKAEIGKGGGDLYEVRLIADTV

SEQ ID NO: 58822 - DNA, 694 bp, Zea mays
  misc_feature: Ceres CLONE 1513326
  misc_feature (18)..(18): n is a, c, t, g, unknown, or other
  misc_feature (694)..(694): n is a, c, t, g, unknown, or other
ccccgcggtggcggccgntctactacattacatcccccgggctgcaggaattgactaacacacctagaaaaaaaggcttacctgaaatcaccactcctcaagtagtttcttcggccctacgaggagaagcacgcaagtggctggagacgaatcggtcgacatggctcgcacacagtctgccgtacaggacgccttggtggccgccgttgctactgctggtatcggcggaaacgaccttggaggctgacctcacctgaggtcagcggacctcccccatcgccccaagcatcttgcaaacccggggcatgctgttcgggccctccgccgtccctgtgctgggggctcaatttttttttcccccccccccgggaggggggggggggaccatccctcccccttgatacggttttccccccccccccccagacacctccattagcctcatccccagtttctaccccccgtttccccctaatgatctgcagcccgcttccccttttattgataagaacgtgaacccacctaccccatagccctagctatctccttgacccccgtaccgcatacatccccgccgaagctcataccacaaaaccatctcccacttctagaaccccacaacaggattaatacctccccccttatcgacatctctactccccacaatgagtattgccggtaattatctcccacn

SEQ ID NO: 58823 - DNA, 690 bp, Zea mays
  misc_feature: Ceres CLONE 1513327
aaagctggagctccccgcggtggcggccgctctagaactagtggatcccccgggctgcaggaattcgtctcacccctagaaaaactacctcctcatccagcgcggctccactcaaagcttgagccttccttttcttttcttgtgtttgttttattttcttggaaggggggagtcgtcttctccatctctccttagcctaggagaaggagagatccagaagcgaaagcttcacggtttgtacaaattctagatctaaccggactaaccagaaaacaaaattaaatacttctaacgcatgagccacttcgccgcctccatgaaaagcccccttgcagtcgctgtctccacgcccgtcggttttttttccccccccccccgggggggggggggcgaactttttttacccctcttctcccctggtggtgtcacctaaaaagaacgctttatccaacccccgggtgggtatttatcaatcttcttttctcccaaacgctgaccaaagtatgtctatcctttacgttccctcaataccgacccatgattttagttccctcccccaccacttagcatttaaaaccaccgcgccttcacgaactccatgtattctttccgaaattccccccctatgttaccatgccatcgactggcctcacccctcttcctcacatttcctagatgcctataatccgg

SEQ ID NO: 58824 - DNA, 751 bp, Zea mays
  misc_feature: Ceres CLONE 1513329
  misc_feature: Encodes the peptide sequence at SEQ ID NO. 58825
  misc_feature (751)..(751): n is a, c, t, g, unknown, or other
ccagctggagctcaccgcggtggcggccgctctagaactagtggatcccccgggctgcaggaattcgtctcacccctagaaaaagtctcatctccgtccacatccgtcctccagcactccagctgcatcgacgaggaccgccgtagcgatttgcgaagcaagggacgggagaggaacccgaggaaggcgaaaatgatctaccgcaactggtcgctgctctcgtccacagtcgtcatttggggcggcgtcgccaccgccggcctcgccggtatcttcctcttgggcggcaaggagaaattcaatgggtatctgtgccgcgaaggcaagaggcttaaggcagaaggacagaaccccgcatgggccttaacctacccccccccctcctggggggggctgccagccaaccacataccccctcccaaattttacaaagaattcctcgccgtcccctcccaaaaacaacggtccctcatcttgggcggctcagaatgggaattcctttccctcctgcggggctctttcctttccgggggcgaactgcgtctaccccaatcacactcgcccctccggttttcggtgttttctctcgcccccccccttaggtgtcccctgccggtgtcgcagggggtgtcacccggccgcctagttttggtgcgcgccccccacaatgtcaagtgtccccgccccccacaaaccccgcatcgcccgcgcccccgcgcgggtctcgcccccctccgctaaccctcgcaan

SEQ ID NO: 58825 - protein, 182 aa, Zea mays
  misc_feature: Ceres CLONE 1513329
MIYRNWSLLSSTVVIWGGVATAGLAGIFLLGGKEKFNGYLCREGKRLKAEGQNPAWALTYPPPSWGGLPANHIPPPKFYKEFLAVPSQKQRSLILGGSEWEFLSLLRGSFLSGGELRLPQSHSPLRFSVFSLAPPLRCPLPVSQGVSPGRLVLVRAPHNVKCPRPPQTPHRPRPRAGLAPLR

SEQ ID NO: 58826 - DNA, 729 bp, Zea mays
  misc_feature: Ceres CLONE 1513331
  misc_feature: Encodes the peptide sequence at SEQ ID NO. 58827
atagctggagctccccgcggtggcggccgctctagaactagtggatcccccgggctgcaggaattcgtctcacccctagaaaaaacaaagttgtttgtgcatcgcggcggcgacaagggggcgacgaggcaggcggagcgggcggcgactacagcggcagcagatctcacggaatggcggcgaaggcaatctcgagccccgtgccggtggagtggtacccgacgctggccgtcgtcatggtatccgtaggcctcatgttcaccgcctccttcttcatttatgaagcaacttcatcccggaggagccgtaccctgtcaaaggagatcgcaacagcagttgttgcttctgttttcttgggctttgggtctctgttcctgctccttgccagtggtgtttatgcctgatgactggctatgggcccgtgtgtgcttggtgttctgcacccccagttgtaaaccttgctatgaaccgaatcctcaagctgttgttccctcccgaatatagaccctttgaacctttttctaacaacgaagtattgggagcacccccagtttaaacccaccgttttcctttccggggcctgccattaattattccctccaattctaaaatcccgctggttcccccgacacaaaaaaacaaaaaaaaaccccccccccgcctcccggggtaacccccaattttcccccccttttaagtgggaggtccgcttaatttaaccgcgcgccg

SEQ ID NO: 58827 - protein, 76 aa, Zea mays
  misc_feature: Ceres CLONE 1513331
  misc_feature (2)..(76): Pfam Name: UPF0197 Pfam Description: Uncharacterised protein family (UPF0197)
MAAKAISSPVPVEWYPTLAVVMVSVGLMFTASFFIYEATSSRRSRTLSKEIATAVVASVFLGFGSLFLLLASGVYA

SEQ ID NO: 58828 - DNA, 680 bp, Zea mays
  misc_feature: Ceres CLONE 1513333
  misc_feature (680)..(680): n is a, c, t, g, unknown, or other
aagctggagctccccgcggtggcggccgctctagaactagtggatcccccgggctgcaggaattcgtctcacccctagaaaaaagcagtctccctaatccccaaagcttccgacccccttcctctctacctccgccgccgctgcgtacgctgggaacgagcgacatgggagtctagacctttgtgatgagcaacaacggcggggagtggaccgtcaaggaccactccggccagatctacgcttccaccgatacctaatacgagctgcagtaccgcctcgtcggttacgcctccgcggccgactctgactacggcgaccagtcgtccttctccgtgtacacgcccagctccgccgagttccatgtgatcaacagagctagcgctggtggtccaatcatggaaagcgcatgtggtgcgctctgctgctgctgcatctggtgaggctgcttctgacgcacccatggatgacaagattcgacaggataacgaataaaacaacaactatatcggaatcctccgtgttcgaccaagagttgtgtgggttatcctgaatcttaaaaaccgggcgttttgggtcctgttccccgaaattaaattttgcccggccccgtccggggaaacatgaaacaaacttgtttgctaatttgttaacaaagcgaaccgtgtttcccatttttttgn

SEQ ID NO: 58829 - DNA, 673 bp, Zea mays
  misc_feature: Ceres CLONE 1513338
  misc_feature: Encodes the peptide sequence at SEQ ID NO. 58830
  misc_feature (640)..(640): n is a, c, t, g, unknown, or other
aaagctggagctccccgcggtggcggccgctctagaactagtggatcccccgggctgcaggaattcgtctcacccctagaaaaaatccaccatcacacagcaatccacacaagcacttcgacgtcacacgggcgctgcgcacagacacaccaagcgtcggcaccaatggcttactaccaggaggtggactactgctcggaggaggtgaggtcggtggccccggccggcttcggccgccacggcggcggcgtccagcagcacgtcgtcaaggagaagttcgaggaggtcgacacggtctcacgcgccggcgccaaccaccaccaccaccatggtcaccacggcggccacggcttcgtggtgcgcgagaccagggtcgaagaggacatcaacacctgcaccggcgagttccacgagcgcagggagagcttcctcgccagggctaactgagccgcccggcggccggcatccacgcccgttcgtgcttgcctgcgtgccttatgtatgtctgtgggtgactggttgtgcagggtcatcgtacttggctatcctacctgccccgcactcagctcctgtaacaaattacgaccaataagcctcctgaacctgaaaaaaaaacttccttccttaaaaaaaaaaaaantgaacgcaaacacaaaatgaccaaacccaacaa

SEQ ID NO: 58830 - protein, 93 aa, Zea mays; identical to SEQ ID NO: 55378
  misc_feature: Ceres CLONE 1513338

SEQ ID NO: 58831 - DNA, 688 bp, Zea mays
  misc_feature: Ceres CLONE 1513341
  misc_feature: Encodes the peptide sequence at SEQ ID NO. 58832
aaagctggagctccccgcggtggcggccgctctagaactagtggatcccccgggctgcaggaattcgtctcacccctagaaaaagatcctcttccttgtccccaccctcttctccgatggcgacgctgcagctcaaccacatcgcgcgggagacctccgacgtggcccgactcgccgccttctacgaggccgtgctggggttcgagcgcatcccttcgcccacctactcgggcttccaggtcgcatggctccgcctcccgagctcccccgacgtcgcgctccacctcatcgagtgggaccccgccgcggcacccgtcgcggtggggcctggcgccgagggctcgccgccgtcgcagctgccccggcgccaccacttcgccttgtccgtcgctgactacgacgggatcgtgaccgggctgaaggcgcgcggcacccatgtgttcgaaaagtcgcagccggatcggagcaagcgtcagatccttcttctccgaccctgacggcaaatggcctagaggttactaacccctggttgccggggaaagaaaactggaacagaaaccctgaattcgccggtctaacttcttttttttatcggggaaataacccttcggaaaacccctgccctaccgttgatgccggattcgaaaaccgggggaaccgtttccttgggggtcaaagatttccattt

SEQ ID NO: 58832 - protein, 126 aa, Zea mays
  misc_feature: Ceres CLONE 1513341
MATLQLNHIARETSDVARLAAFYEAVLGFERIPSPTYSGFQVAWLRLPSSPDVALHLIEWDPAAAPVAVGPGAEGSPPSQLPRRHHFALSVADYDGIVTGLKARGTHVFEKSQPDRSKRQILLLRP

SEQ ID NO: 58833 - DNA, 661 bp, Zea mays
  misc_feature: Ceres CLONE 1513343
  misc_feature: Encodes the peptide sequence at SEQ ID NO. 58834
atagctggagctccccgcggtggcggccgctctagaactagtggatcccccgggctgcaggaattcgtctcacccctagaaaaaatttgttcatctaagaaagatcggaaatgatgagcatctgcataaggcatttgcatacttcgaccggaaccagagcgattatattgaaattgatgaactccatgagtcattagctgatgaccttggacaaaaccgtgaagagattatcaatgccatcatccgtgatgtagacaccgataaggatggcaagataagctacgatgagtttgcgacgatgatgaaggccggaacagacgggaggaaagcatccagacagtactcgagagagcggttcacaagcctgagccttaagctgcaaaaggatggatcgctgcagatgacgattacacggtagcccgataacaccacataggcaagttgtgaattacagatggaaaccatgtgtagattttctggttgtttgttgacagctcttctgcttgtccttatgttccattgctttgtattctccgcttgcggcctgtttgaaggattacgggggggatgtttatgctatgattgtatttagactgcatgatccatgcatcgctcctttccaccgccccaggggcaagtgtcctgtacaagaaaaagagga

SEQ ID NO: 58834 - protein, 39 aa, Zea mays
  misc_feature: Ceres CLONE 1513343
  misc_feature: SWISSPROT Homolog: EC 2.7.11.1 Non-specific serine/threonine protein kinase
MMKAGTDGRKASRQYSRERFTSLSLKLQKDGSLQMTITR

SEQ ID NO: 58835 - DNA, 847 bp, Zea mays
  misc_feature: Ceres CLONE 1513345
  misc_feature: Encodes the peptide sequence at SEQ ID NO. 58836
  misc_feature (19)..(19): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
ccttttcctttttctttcntcactactcataccnnnnnnntgttnnnnnttcaaactgggactccccgcggtggcggccgctctagactagtggatcccccgggctgcaggaattcgtctcacccctagaaaaaagaagcctccaccctcctgcgcctccaccctcctcgccgcctcactccctctgaggtcgcagatccgtccggttagacgaagccgcccgcacccatggcctccggtgagctcgcctgcacctacgccgccctcatcctcagcgacgacggcatcgccatcaccgccgagaagatcgccaccatcgtgaaggcggccaacatcaaggtcgagtcctactggccggcgctcttcgctaagctcctggagaagcgcagtgttgaggatctaaaccccctcccgttgggatcctggtggaggcggctgctccaatttgcttgctggccgcccccagactggggaggttgcttgccagcttgcttgcctgcccccctggtctgcattacgtaccaaccaaagggaataacccccccaggcaagcgagttcctgtaatgaacccaaccatggggcgctttctaagaccttgggttcctaaactggaaggaaagcccccctccgcctatctccaaggcccttttactaaaaaattccccctgtatggccttgtccccacagaaatcttaatcctttgcgacccaagtgtctgcgcagtcccttttttgcgcacccttgcatatttccccctcacagtttttggcggcctctttcgcaatccggtggccttttccccccaattgggacttgaaataaaccccccccagactcaacttttag

SEQ ID NO: 58836 - protein, 206 aa, Zea mays
  misc_feature: Ceres CLONE 1513345
MASGELACTYAALILSDDGIAITAEKIATIVKAANIKVESYWPALFAKLLEKRSVEDLNPLPLGSWWRRLLQFACWPPPDWGGCLPACLPAPLVCITYQPKGITPPGKRVPVMNPTMGRFLRPWVPKLEGKPPSAYLQGPFTKKFPLYGLVPTEILILCDPSVCAVPFLRTLAYFPLTVFGGLFRNPVAFSPQLGLEINPPQTQLL

SEQ ID NO: 58837 - DNA, 667 bp, Zea mays
  misc_feature: Ceres CLONE 1513346
  misc_feature: Encodes the peptide sequence at SEQ ID NO. 58838
  misc_feature (590)..(590): n is a, c, t, g, unknown, or other
  misc_feature (596)..(596): n is a, c, t, g, unknown, or other
aaagctggagctccccgcggtggcggccgctctagaactagtggatcccccgggctgcaggaattcgtctcacccctagaaaaagtctttcttctgctcttccatcgcgccagtgttttgagaagctggtcggcgctcctagatcccttcgcctctctcgcgttcgaggctaggtagccgccaccatgagccgctcggggcagcctccggatctcaagaagtacatggacaagaagcttcagattaagctgaatgcaaaccgtgttgttattggcacacttcggggattcgaccagttcatgaatctggtgatcaacaactctgtggaggtcaatggaaatgacaagacagatattggaatggtggttatcaggggaaacagtgttgtcatgatcgaagcactggagccagttgccaagtcgcagtgaatccttatttttcagctgatatagtcgcagcatgaaaactgatgtaaatgctatgagtgaaccctgttgtacttcggactcgtgcttttgcacagcaacataactcggctaccagcacccctgtttcaatggtgacttcattactgacttgggcgctccatnccccgncgggaggggaataaaataaggtcatcagggcgccaaaaccgagacccctccgaggtaccccatttccgccc

SEQ ID NO: 58838 - protein, 80 aa, Zea mays
  misc_feature: Ceres CLONE 1513346
  misc_feature (8)..(72): Pfam Name: LSM Pfam Description: LSM domain
MSRSGQPPDLKKYMDKKLQIKLNANRVVIGTLRGFDQFMNLVINNSVEVNGNDKTDIGMVVIRGNSVVMIEALEPVAKSQ

SEQ ID NO: 58839 - DNA, 497 bp, Zea mays
  misc_feature: Ceres CLONE 1513347
  misc_feature: Encodes the peptide sequence at SEQ ID NO. 58840
  misc_feature (184)..(184): n is a, c, t, g, unknown, or other
  misc_feature (188)..(188): n is a, c, t, g, unknown, or other
  misc_feature (277)..(277): n is a, c, t, g, unknown, or other
aaactggagctccccgcggtggcggccgctctagaactagtggatcccccgggctgcaggaatcgtctcacccctagaaaaaacaccaccattccgagcacactagtcttccctgcgcttgctcgctccttcttgcccccatggcgctgctcgccttccagggcatggccatgtcgaaccgcgncgcngcccttccatctacaacaacggggcgtctcaatcctaagttttccactccttctaacggtttgaaacctccgccgcctttccccggggncccaaaaattggtttccccttgggcccttttggggccccctccccccatttttgaaccccagggcgaaaagggaaaaaaaaaaaaaaggggaaaaaggttacccccctttttgtgggaaggggggccccccaaaaaaaaaaaaaaaaaaagggggttttttgggttttttttttttccccaaaacccccaaaaagaaaaagaaatctcttccaaaaaagg

SEQ ID NO: 58840 - protein, 63 aa, Zea mays
  misc_feature: Ceres CLONE 1513347
  misc_feature (15)..(15): Xaa is any aa, unknown, or other
  misc_feature (46)..(46): Xaa is any aa, unknown, or other
MALLAFQGMAMSNRXAALPSTTTGRLNPKFSTPSNGLKPPPPFPGXPKIGFPLGPFGAPSPHF

SEQ ID NO: 58841 - DNA, 673 bp, Zea mays
  misc_feature: Ceres CLONE 1513351
  misc_feature: Encodes the peptide sequence at SEQ ID NO. 58842
aaagctggagctccccgcggtggcggccgctctagaactagtggatcccccgggctgcaggaattcgtctcacccctagaaaaacttgatccagccaagccagggatcgccatgtcggactcggaggagcaccacttcgaatcgaaggccgacgccggagcgtccaagacctacccgcagcaggctggcaccgtccgtaagaacggcttcatcgtcatcaagaaccgcccctgcaaggttgtggaggtttctacctcaaagactggtaagcatggtcatgccaaatgccactttgttgccatagatatattcaacgggaaaaagctcgaagatattgttccttcgtcacacaactgtgatattccgcatgtgaaccgtactgagtatcagctgattgatatatcagaggatggatttgtgagccttcttacttcagatggcaacactaaggatgatcttagactcccaactgatgagactcttgtggcccagatcaaggaagggtttgaaagtgccaaggatcttgttgtgactgtccagcccgctatggggggaggagcaaatctgccccctgaaggatgttggcccccagtaacttcccctgcctttggaaatcctggatcccccaaaccttaaattcgaaaaaaagaagtgtcttcccaggatttgcttc

SEQ ID NO: 58842 - protein, 174 aa, Zea mays
  misc_feature: Ceres CLONE 1513351
  misc_feature (86)..(155): Pfam Name: eIF-5a Pfam Description: Eukaryotic initiation factor 5A hypusine, DNA-binding OB fold
  misc_feature (30)..(64): Pfam Name: KOW Pfam Description: KOW motif
MSDSEEHHFESKADAGASKTYPQQAGTVRKNGFIVIKNRPCKVVEVSTSKTGKHGHAKCHFVAIDIFNGKKLEDIVPSSHNCDIPHVNRTEYQLIDISEDGFVSLLTSDGNTKDDLRLPTDETLVAQIKEGFESAKDLVVTVQPAMGGGANLPPEGCWPPVTSPAFGNPGSPKP

SEQ ID NO: 58843 - DNA, 684 bp, Zea mays
  misc_feature: Ceres CLONE 1513353
ccccgcggtggcggccgctctagaactagtggatcccccgggctgcaggaattcgtctcacccctagaaaaaacgcgctaaattatcacagagcgagaaaaaaattatgtttggtgacccaactccccggcccaatccgtgggagagaacagggctttcgcccccggcctcacaaggtcgggaagggtttcctcgagctcaccctctccactcgtgcacccgccgccacttcctttctctcgcgcacccgacgtcgcatcctctctcgtgcagttggggccagctgttgggccgaggtcgacgacggggtcgacctctccgtggagacagccaaggcggccgtgagccacgccgccacgagccaccacgagcacgacggcgagctcagcgatctggagtcggatctggtggggcggcagaagactggctgctcgtcgtcgccggcgggcacaacgccggctgcaaagctgatcgtgccgccagcacagcaaatctagccaattccaggggggtacaaaaagggttttttcatccaccaattggtcccccaaaaaaaaaaactggaaacctccaaaatgggcgttttgccttctaccgtttttacccctttgaaggaaatttgaatgggtaaaaaactggaagcccattgtattttaatgccttataggctttttccaaaaaaga

SEQ ID NO: 58844 - DNA, 770 bp, Zea mays
  misc_feature: Ceres CLONE 1513354
  misc_feature: Encodes the peptide sequence at SEQ ID NO. 58845
  misc_feature (47)..(47): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
gggggtgggttgggttttgtgccctccgatctccgttaaagggggtngnnnnaaaaactggaactccacgcggtggcggccgctctagaactagtggatcccccgggctgcaggaattcgtctcacccctagaaaaaatatatatccaacaaccagcagtgcaacaagcaagatttacctgcccatcgatcatatcgtcaactggtccggcagttcgcgacaccatgagctccacggagtgcggcggcggcggcggcggcgccaagacgtcgtggcctgaggtggtcgggctgagcgtggaggacgccaagaaggtgatcctcaaggacaagccggacgccgacatcgtggtgctgcccgacggctccgtggtgacagcggattatcgccctaaccgtgtccgcatcttcgttgacatccccccccagacgccccacatcgggctgataatatataacctagcccgctatttcccttccccttgccccagaacttgcacatcaaactttcatacgatggaaattaactggggccatgccagaataatggcatgcggtgaaatctttccccacttacttcaagggccctaaaacaaaagttctccaaaaatgccccccccccttcctgtcccccgtggtcacaactacacccgccccgtacccgccaacacagaaaaacccctctgtcgtcctttgctttcccgcaccaccgcccctaaatcgttgtaagccctttaacctaattccgcccacggaatttccccccgctcc

SEQ ID NO: 58845 - protein, 121 aa, Zea mays
  misc_feature: Ceres CLONE 1513354
  misc_feature (14)..(73): Pfam Name: potato_inhibit Pfam Description: Potato inhibitor I family
MSSTECGGGGGGAKTSWPEVVGLSVEDAKKVILKDKPDADIVVLPDGSVVTADYRPNRVRIFVDIPPQTPHIGLIIYNLARYFPSPCPRTCTSNFHTMEINWGHARIMACGEIFPHLLQGP

SEQ ID NO: 58846 - DNA, 636 bp, Zea mays
  misc_feature: Ceres CLONE 1513355
  misc_feature: Encodes the peptide sequence at SEQ ID NO. 58847
aaagctggagctccccgcggtggcggccgctctagaactagtggatcccccgggctgcaggaattcgtctcacccctagaaaaaacggccaccacacatcccttcctctctctctctcctcgagcattcgtgctgctccgaccccaccgccacaggctcggcggtccggcgatctcgctcaccggcgggaacatgactacttcaaggcgccttgctgacaggaagactgcaaagttccagaagaacatcaccaggaggggttctgtgcctgaaaccactgtcaagaagggaaatgactaccctgttggccctctattgcttgggttcttcatctttgtcgtcattggatcatcgttgtttcagatcatcaggacggcgaccagcggcggggtggcttgagagccggcccacatctaatccccagtatagagagttgcttgttatacatgcatccagctaggattgggtagcagctaaaatgttaaacgtgacaagactgccctgcattccgttcatttggtgggccttgaatctggaactgaaccataaggcagaatcatgtaccttatataaagtgttaaatgggtaaactgatctcagtgtttcatttaaaaaaaaaaaaaaacgagacgctcg

SEQ ID NO: 58847 - protein, 68 aa, Zea mays; identical to SEQ ID NO: 8783
  misc_feature: Ceres CLONE 1513355
  misc_feature (1)..(64): Pfam Name: RAMP4 Pfam Description: Ribosome associated membrane protein RAMP4

SEQ ID NO: 58848 - DNA, 864 bp, Zea mays
  misc_feature: Ceres CLONE 1513357
  misc_feature: Encodes the peptide sequence at SEQ ID NO. 58849
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (864)..(864): n is a, c, t, g, unknown, or other
cccccctctttctcttcctttttcccnnnnnnnnnnnnnggggggggtnnnngtcgacctcacctccccccgctggccgccgctctagaactagtggatcccccgggctgcaggaattcgtctcacccctagaaaaagtcgacccctctacaccggcgatcggcggcgaacgatggggtgggcgacccggttcctggcggcggtgtgcttctttgctgggggggtgctcttcgtcccagagggtatcggttccccatccggcgcaggagccgtcacccgcccccaagctggccccactccctcttcttttgccacctctcgggggaggtcccccctctgggcttctttcccccggggggggggggagggttccacgacccctgcctttttgtcccatgtcccgggaaattggaaaaaaaaagaagttttttttctcctaccccccccggggggggggaggaaggggggggatttcccctcttccccccctttccctccctctgccggttgctttttgataaataaaagaaaacaaaccaccgccgtcccctctttggggcgggggggggggatcttccaggcacttgtaaatattaccaattcccccctttccccgttcctgggcccttgttgcccccccctattctttaacccgctcccctttgaccccccttgccccgccccgcataaccccccgccttgtcccccctgtaccgccgcgcccgacttattcttggacctccccgtgtgcccccccctgaccccgatgacccccttcgccactccttgtcgctcccgccccgcccccccttatcccttttttacgcctccttctccctccgccccatcttttaccccccctcn

SEQ ID NO: 58849 - protein, 230 aa, Zea mays
  misc_feature: Ceres CLONE 1513357
MGWATRFLAAVCFFAGGVLFVPEGIGSPSGAGAVTRPQAGPTPSSFATSRGRSPLWASFPRGGGEGSTTPAFLSHVPGNWKKKEVFFLLPPPGGGRKGGDFPSSPPFPPSAGCFLINKRKQTTAVPSLGRGGGIFQALVNITNSPLSPFLGPCCPPLFFNPLPFDPPCPAPHNPPPCPPCTAAPDLFLDLPVCPPLTPMTPFATPCRSRPAPPYPFFTPPSPSAPSFTPP

SEQ ID NO: 58850 - DNA, 599 bp, Zea mays
  misc_feature: Ceres CLONE 1513361
  misc_feature (110)..(110): n is a, c, t, g, unknown, or other
  misc_feature (231)..(231): n is a, c, t, g, unknown, or other
  misc_feature (285)..(285): n is a, c, t, g, unknown, or other
  misc_feature (286)..(286): n is a, c, t, g, unknown, or other
aagctggagctccccgcggtggcggccgctctagaactagtggatcccccgggctgcaggaattcgtctcacccctagaaaaaactggttgctagtgctaccaagaacanggaaggggaaacaccgccgccgcgcgccttccattccatactcgcggaggaaagaacacagccagcgcatggtcacgtcgacgaccgccgcgccgtgctgtccccgccgtcccgtggcggncttcgcctggcgccgtctcccccggcgcgcgttggcgtccgcgccgcgccggcnncggcgttccctggcggccccccccggagctgaaccccttccttggtattaccctgaaccacgggctggttcctcttttctgggccggtttcgttttttttaatttccaagggggagggaatgggcaaaaacgggggtcccaacaaaaaggggaaaaaaccttttttaacccccgggaaaaaaacgcccccaagaaattttttgggccttttttaaaattccaaaaaaccccccggggggtttaacacccttaaaaaacccttcccccgggggggctcttttgggcccaaaaatggcccccacaaaaaattccc

SEQ ID NO: 58851 - DNA, 699 bp, Zea mays
  misc_feature: Ceres CLONE 1513364
  misc_feature: Encodes the peptide sequence at SEQ ID NO. 58852
aagctggagctccccgcggtggcggccgctctagaactagtggatcccccgggctgcaggaattcgtctcacccctagaaaaagtctctcgcccctctctcccaccccgcagccgccctagcacccgcgacgagcaggatctgcccagttgctcttgcggtagttcccccaactgtcaccatgcagaacgaggagggtaagactgtggacctctatgtccccaggaagtgctcggccacaaacaggatcatcactgccaaggaccatgcctctgtccagatcaacattggccacttggatgcgaatggcctgtatgatggtcacttcacaacgtttgctctctctgggtttgtccgtgctcagggtgacgcagacagctccttggacaggctgtggcaaaagaagaaggctgatatcaagcagtagatttttcttctagtttaccaagaattggacaccgcccttagctatgttttgaattcatgtcactatatgcaatggtggtgatttcagccggggccctttaaatctgaaaaatttaggaatcctttggtggggttcccttttgaaatttggaaggggggggggttcgttttaaattccctctgggacaaccccccttttaggtaaccattggggatgaatttttgggtattccaaaaaaaaaaaaaaaaaaaccagaagcccctccgagggttc

SEQ ID NO: 58852 - protein, 81 aa, Zea mays; identical to SEQ ID NO: 6959
  misc_feature: Ceres CLONE 1513364
  misc_feature (1)..(81): Pfam Name: Ribosomal_S21e Pfam Description: Ribosomal protein S21e

SEQ ID NO: 58853 - DNA, 774 bp, Zea mays
  misc_feature: Ceres CLONE 1513365
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (12)..(12): n is a, c, t, g, unknown, or other
  misc_feature (13)..(13): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (25)..(25): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (84)..(84): n is a, c, t, g, unknown, or other
accgnnnnngannagggnnnnaaanaannnnnnnnnnnnnnnntaaccnnnngcaaaacgagagtccccgcgggggggaggggnttgttctcatgagatcccccggggtgcaggaattcctctcacccctagaaaacaagtgcgagaactgcggggaggtcaccgccaagttcacctacgtcaccctcagcgagcaagtcgacctgcccaaaggacacggcgccgctcacctcgtccagaagtctagtgtcaccggtgaaccattcgaaacaaggtgccttggctactacgcatgatgggaaagcacctcaggatctaatttgatcttgtgtaggcatctgcagttattttgtctattatgctcctgttctgttttattgtattctttatcttcaaggtagaaaaataatttttttttccccccccccactggggggaggaggggggtactttttctcccaatccaccgctggttctgccgcgttttacaaatgaaatataacccggctatcgctgtcggtgaccggtttgtattatccggccatcaacaatacaaatggtgcacctctccctgaaacatttctggtgtgtaaggactttccctcggggtcaagaacttttggtaaattccatgggataccattatcttacggggttgtcaccatcctgcatcaatattcggtcgcccctttttccccaggttgccgactctcgcgccctcattccagaagccacccctgccgctcgcgtatcatcagcgactcgctgctcgtg

SEQ ID NO: 58854 - DNA, 649 bp, Zea mays
  misc_feature: Ceres CLONE 1513367
  misc_feature: Translation starting site: 188
  misc_feature (260)..(260): n is a, c, t, g, unknown, or other
  misc_feature (263)..(263): n is a, c, t, g, unknown, or other
  misc_feature (341)..(341): n is a, c, t, g, unknown, or other
  misc_feature (361)..(361): n is a, c, t, g, unknown, or other
  misc_feature (362)..(362): n is a, c, t, g, unknown, or other
  misc_feature (380)..(380): n is a, c, t, g, unknown, or other
  misc_feature (407)..(407): n is a, c, t, g, unknown, or other
  misc_feature (439)..(439): n is a, c, t, g, unknown, or other
  misc_feature (490)..(490): n is a, c, t, g, unknown, or other
ggagctccccgcggtggcggccgctctagaactagtggatcccccgggctgcaggaattcgtctcacccctagaaaaaaccactcatcaccagctagtagctctagcaaagcacttgccatctaccgaccgccgcattccaaacagcccgacgagctagcagagcggcaggcacctcctccaggaacatggcccgcacgcagcagttggcagtagtggcgacagccgtggtggccttgtggctgcttggccgcggcgacntcngaagcggccatcagctgcgggcaggtggcgtcggccatcgcgccctgcatctcctacgcgcgcgggccaggctcaggnccctccgccggctgctgcanncgcgtcaggagcctcaanaacgccgcccgcaccaccgccgaccgncgcgccggctggtactggcctcagaacgccgncgccgggcgtcagcggcctccacggcgggtacgccgccagcatcccctccnagtggcgcggtcagcatccccctacaacatcagcacctcccacgactgcgtcaagggtgaactggaacctaaacgacgacaaagggggcccggcgccgcctggagacgatccatatctattccgggcgtcgtcggggcctggggggttcggaccgtcat

SEQ ID NO: 58855 - DNA, 887 bp, Zea mays
  misc_feature: Ceres CLONE 1513370-R
ggtactcgagcgtctcgtttttttttttttttttagggagggatggggtatatatatatagcatcaaaattatgtaatgaagagtagcactgattattgttacatgacgaaggttgagcatccatggaggctagattatagacagacaccctgattttacatgacgaatcgcaagaagcgcatgcattggatatccttagccggagagggcgctggtgttgtagacgaggagggcgccgccgccgaggatcccagcgagggtgacggcccagatcagaagcccagtggttccaccgacgtagacgtcgccggtgggagaccagtcatcctcgttgtagattgggctgtatccgtcgacgttcgcgccgtacttgtcgacgaactggtacacgcccttgccctccccctttctcccgttggcgtcgacgtcgacggtcaggccacccccaatcccgtagggcttgtcggtcttgatcttcttcttggagcagacgacggcgaaggaggaggcgcggcggccgaggggcggcaggccctgaggcgccaccgccagagctgacgaggagatcatggaggccgccatcgccgccgctgctgctgctcctagctagctgcgtgcagtgtgtgctgctctcgctcgctgagtcgctggtagatgggtggctgcaggtcgttagctgccgagccaaaagctagcccatatactagctgttggccccaagccctggccgattatgccggggacggagcgcaggtgtgaaccaccgccccccccccttttttctaggggtgaaaacaaaattcctgccgcccccgggggaatcccctaggtttttagaagggggccgcccaccggcgggtgggaacttccgccttttttgttttct

SEQ ID NO: 58856 - DNA, 590 bp, Zea mays
  misc_feature: Ceres CLONE 1513371
  misc_feature: Translation starting site: 155
  misc_feature (189)..(189): n is a, c, t, g, unknown, or other
  misc_feature (195)..(195): n is a, c, t, g, unknown, or other
  misc_feature (198)..(198): n is a, c, t, g, unknown, or other
  misc_feature (211)..(211): n is a, c, t, g, unknown, or other
  misc_feature (213)..(213): n is a, c, t, g, unknown, or other
  misc_feature (229)..(229): n is a, c, t, g, unknown, or other
  misc_feature (231)..(231): n is a, c, t, g, unknown, or other
  misc_feature (275)..(275): n is a, c, t, g, unknown, or other
tggagctccccggcggtggcggccgctctagaactagtggatcccccgggctgcaggaattcgtctcacccctagaaaaaacgccgtcactcctctcaacccgaccacgccgcgcctccgcttcgaaccctagccgagcggggtaaggagggaaatgggggaagggtactgggcagctttcggcaagcngccggnaancaaaacgcacacngnctgtgcatccgctgcngnctgcgcagcttccacctccagagagtacctgctcctcctggggntaccccgcggccgcatccgcaagtttaattgggatgtgaaggcatcaggcccaagaccactggtacgggaaggataaggtactggcaacccgggcctcgccggttcaggaccactttcaaaaaagggctgggggttgccccaaaaaaaaaggcggccgcgcccccccaaggggggagggtgccccccaaaaacccccaaaacagaaagggggggacttttttgaggagaatggcccccccgaaaaattttgcccccaaaaaaattaaacaaaagggggttccccccgggctttaaaaaaaaaccccccacccccc

SEQ ID NO: 58857 - DNA, 644 bp, Zea mays
  misc_feature: Ceres CLONE 1513376
  misc_feature: Encodes the peptide sequence at SEQ ID NO. 58858
  misc_feature (501)..(501): n is a, c, t, g, unknown, or other
  misc_feature (619)..(619): n is a, c, t, g, unknown, or other
ggccgctctagaactagtggatcccccgggctgcaggaattcgtctcacccctagaaaaagacaggtagaagacgactgactgcctcgagcagcagagatcagggaggccgagggcgggatgacgatccggttcgtgctgttcgtcaacaagcagggccagacgcggctggcgcagtactacgagcacctctccctcgacgagcgacgggccctcgagggcgagatcgtccgcaagtgcctcgcccgcactgaccagcagtgttcgtttgtggagcaccggaactacaaggtcgtttacaggcgctacgcctcccttttcttcctcgtcggcgtcgacagcgatgagaatgagttagctatccttgaattcatacatcttctggtggaaactatggatcgccacttcggcaatgtgtgcgagctcgatatcatgttccatctggagaaagtgcacttcatgttggaagagatggtgatgaatggttgcattgtggagaccnagtaacagaacatcttggcaccaatacaacttatggagaaaacttcctaaaatagtgatatccatttgtgtagtttttacctccacttcttagcaaatttggcctgtctggccctttncataaatttccctctggaaggggag

SEQ ID NO: 58858 - protein, 127 aa, Zea mays
  misc_feature: Ceres CLONE 1513376
  misc_feature (2)..(129): Pfam Name: Clat_adaptor_s Pfam Description: Clathrin adaptor complex small chain
MTIRFVLFVNKQGQTRLAQYYEHLSLDERRALEGEIVRKCLARTDQQCSFVEHRNYKVVYRRYASLFFLVGVDSDENELAILEFIHLLVETMDRHFGNVCELDIMFHLEKVHFMLEEMVMNGCIVET

SEQ ID NO: 58859 - DNA, 675 bp, Zea mays
  misc_feature: Ceres CLONE 1513377
  misc_feature (622)..(622): n is a, c, t, g, unknown, or other
ggagctccccgcggtggcggccgctctagaactagtggatcccccgggctgcaggaattcgtctcacccctagaaaaactcctccgtttttcggatgcactctcttggcctcttgctcctcgcgcctctggccgtcgggatggccccgatcgtggtgctcgagactggggtttagcatccaggatgatctgcatgagctacttagtgatatcaattcgaagctctccctgatacgcgtcattggaagacaccggatgtgctcccttttgtctctccgagatctgtgctgtgcgcaccgccgtctgacgcgtgctgaccgtcatctcacataatgacaaatcggctctgcgtaatctctagaatatcaagactctgctcccggtctacctgcgcccctagaggacccgcgtccatctcgttcgctgctgcacaagcttgagctctccttgaagagcgataggcaccatagtcgcgaaaactatctccgcttgacgaaatacgctatcaacgactatatctttcaaagatcgttgatcctggtcccgttttgctcatatgtgacttgagattgacacatgtctatctccgaccaagtactgtgtagctgatcatctgcatgatngaatccgagtactttttgcttgttttcgacgtgctctgagacccaaatcaacc

SEQ ID NO: 58860 - DNA, 548 bp, Zea mays
  misc_feature: Ceres CLONE 1513379
  misc_feature: Encodes the peptide sequence at SEQ ID NO. 58861
gctcttaactagtggatcccccgggctgcaggaattcgtctcacccctagaaaaaacctgctgttcatcgtccgggacgtgaaggtgcagccgaacccagatgaagtcgctgatgtgaagtacatgaaccgcgaggagctcaaggagctcatccggaaggctgacgctggcgaggatggggtgaagatctccccctggttcacgctggtggtggacaacttcctcatgggctggtgggaccatgtcgaggaatgcaccctcggctaggccgtggacatggagaccatcccatagctgaaggagtgaggtgacgccgagcctgccgtctgcgatgaacctcactgccctgctgctggctggctgcccctgccatggttttaatccaaaaattttattcccctccccgctccccggaaaatggacttgactgtttcccggggggaaaattcccttttttgaattgatccctaagtcccgccacagggtttttggatttagattgggttttttcggggacataaatcccgcccgtggaacccccttttttt

SEQ ID NO: 58861 - protein, 47 aa, Zea mays
  misc_feature: Ceres CLONE 1513379
  misc_feature: SWISSPROT Homolog: EC 5.3.3.2 Isopentenyl-diphosphate Delta-isomerase
MNREELKELIRKADAGEDGVKISPWFTLVVDNFLMGWWDHVEECTLG

SEQ ID NO: 58862 - DNA, 778 bp, Zea mays
  misc_feature: Ceres CLONE 1513381
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (165)..(165): n is a, c, t, g, unknown, or other
  misc_feature (166)..(166): n is a, c, t, g, unknown, or other
  misc_feature (167)..(167): n is a, c, t, g, unknown, or other
  misc_feature (168)..(168): n is a, c, t, g, unknown, or other
  misc_feature (169)..(169): n is a, c, t, g, unknown, or other
  misc_feature (170)..(170): n is a, c, t, g, unknown, or other
  misc_feature (171)..(171): n is a, c, t, g, unknown, or other
  misc_feature (172)..(172): n is a, c, t, g, unknown, or other
  misc_feature (173)..(173): n is a, c, t, g, unknown, or other
  misc_feature (174)..(174): n is a, c, t, g, unknown, or other
  misc_feature (175)..(175): n is a, c, t, g, unknown, or other
  misc_feature (176)..(176): n is a, c, t, g, unknown, or other
  misc_feature (177)..(177): n is a, c, t, g, unknown, or other
  misc_feature (178)..(178): n is a, c, t, g, unknown, or other
  misc_feature (179)..(179): n is a, c, t, g, unknown, or other
  misc_feature (180)..(180): n is a, c, t, g, unknown, or other
  misc_feature (185)..(185): n is a, c, t, g, unknown, or other
  misc_feature (186)..(186): n is a, c, t, g, unknown, or other
  misc_feature (187)..(187): n is a, c, t, g, unknown, or other
  misc_feature (188)..(188): n is a, c, t, g, unknown, or other
  misc_feature (189)..(189): n is a, c, t, g, unknown, or other
  misc_feature (190)..(190): n is a, c, t, g, unknown, or other
  misc_feature (191)..(191): n is a, c, t, g, unknown, or other
  misc_feature (192)..(192): n is a, c, t, g, unknown, or other
  misc_feature (193)..(193): n is a, c, t, g, unknown, or other
  misc_feature (194)..(194): n is a, c, t, g, unknown, or other
  misc_feature (195)..(195): n is a, c, t, g, unknown, or other
  misc_feature (196)..(196): n is a, c, t, g, unknown, or other
  misc_feature (197)..(197): n is a, c, t, g, unknown, or other
  misc_feature (206)..(206): n is a, c, t, g, unknown, or other
  misc_feature (207)..(207): n is a, c, t, g, unknown, or other
  misc_feature (208)..(208): n is a, c, t, g, unknown, or other
  misc_feature (213)..(213): n is a, c, t, g, unknown, or other
  misc_feature (214)..(214): n is a, c, t, g, unknown, or other
  misc_feature (215)..(215): n is a, c, t, g, unknown, or other
  misc_feature (216)..(216): n is a, c, t, g, unknown, or other
  misc_feature (217)..(217): n is a, c, t, g, unknown, or other
  misc_feature (218)..(218): n is a, c, t, g, unknown, or other
  misc_feature (219)..(219): n is a, c, t, g, unknown, or other
  misc_feature (220)..(220): n is a, c, t, g, unknown, or other
  misc_feature (221)..(221): n is a, c, t, g, unknown, or other
  misc_feature (222)..(222): n is a, c, t, g, unknown, or other
  misc_feature (223)..(223): n is a, c, t, g, unknown, or other
  misc_feature (224)..(224): n is a, c, t, g, unknown, or other
  misc_feature (225)..(225): n is a, c, t, g, unknown, or other
  misc_feature (226)..(226): n is a, c, t, g, unknown, or other
  misc_feature (227)..(227): n is a, c, t, g, unknown, or other
  misc_feature (228)..(228): n is a, c, t, g, unknown, or other
  misc_feature (229)..(229): n is a, c, t, g, unknown, or other
  misc_feature (230)..(230): n is a, c, t, g, unknown, or other
  misc_feature (231)..(231): n is a, c, t, g, unknown, or other
  misc_feature (232)..(232): n is a, c, t, g, unknown, or other
  misc_feature (233)..(233): n is a, c, t, g, unknown, or other
  misc_feature (234)..(234): n is a, c, t, g, unknown, or other
  misc_feature (235)..(235): n is a, c, t, g, unknown, or other
  misc_feature (236)..(236): n is a, c, t, g, unknown, or other
  misc_feature (237)..(237): n is a, c, t, g, unknown, or other
  misc_feature (238)..(238): n is a, c, t, g, unknown, or other
  misc_feature (239)..(239): n is a, c, t, g, unknown, or other
  misc_feature (240)..(240): n is a, c, t, g, unknown, or other
  misc_feature (241)..(241): n is a, c, t, g, unknown, or other
  misc_feature (242)..(242): n is a, c, t, g, unknown, or other
  misc_feature (243)..(243): n is a, c, t, g, unknown, or other
  misc_feature (244)..(244): n is a, c, t, g, unknown, or other
  misc_feature (245)..(245): n is a, c, t, g, unknown, or other
  misc_feature (246)..(246): n is a, c, t, g, unknown, or other
  misc_feature (247)..(247): n is a, c, t, g, unknown, or other
  misc_feature (248)..(248): n is a, c, t, g, unknown, or other
  misc_feature (249)..(249): n is a, c, t, g, unknown, or other
  misc_feature (250)..(250): n is a, c, t, g, unknown, or other
  misc_feature (251)..(251): n is a, c, t, g, unknown, or other
  misc_feature (252)..(252): n is a, c, t, g, unknown, or other
  misc_feature (253)..(253): n is a, c, t, g, unknown, or other
  misc_feature (254)..(254): n is a, c, t, g, unknown, or other
  misc_feature (255)..(255): n is a, c, t, g, unknown, or other
  misc_feature (256)..(256): n is a, c, t, g, unknown, or other
  misc_feature (257)..(257): n is a, c, t, g, unknown, or other
  misc_feature (258)..(258): n is a, c, t, g, unknown, or other
  misc_feature (259)..(259): n is a, c, t, g, unknown, or other
  misc_feature (260)..(260): n is a, c, t, g, unknown, or other
  misc_feature (261)..(261): n is a, c, t, g, unknown, or other
  misc_feature (262)..(262): n is a, c, t, g, unknown, or other
  misc_feature (263)..(263): n is a, c, t, g, unknown, or other
  misc_feature (264)..(264): n is a, c, t, g, unknown, or other
  misc_feature (265)..(265): n is a, c, t, g, unknown, or other
  misc_feature (266)..(266): n is a, c, t, g, unknown, or other
  misc_feature (267)..(267): n is a, c, t, g, unknown, or other
  misc_feature (268)..(268): n is a, c, t, g, unknown, or other
  misc_feature (269)..(269): n is a, c, t, g, unknown, or other
  misc_feature (270)..(270): n is a, c, t, g, unknown, or other
  misc_feature (271)..(271): n is a, c, t, g, unknown, or other
  misc_feature (272)..(272): n is a, c, t, g, unknown, or other
  misc_feature (273)..(273): n is a, c, t, g, unknown, or other
  misc_feature (274)..(274): n is a, c, t, g, unknown, or other
  misc_feature (275)..(275): n is a, c, t, g, unknown, or other
  misc_feature (276)..(276): n is a, c, t, g, unknown, or other
  misc_feature (277)..(277): n is a, c, t, g, unknown, or other
  misc_feature (278)..(278): n is a, c, t, g, unknown, or other
  misc_feature (279)..(279): n is a, c, t, g, unknown, or other
  misc_feature (280)..(280): n is a, c, t, g, unknown, or other
  misc_feature (281)..(281): n is a, c, t, g, unknown, or other
  misc_feature (282)..(282): n is a, c, t, g, unknown, or other
  misc_feature (283)..(283): n is a, c, t, g, unknown, or other
  misc_feature (284)..(284): n is a, c, t, g, unknown, or other
  misc_feature (285)..(285): n is a, c, t, g, unknown, or other
  misc_feature (286)..(286): n is a, c, t, g, unknown, or other
  misc_feature (287)..(287): n is a, c, t, g, unknown, or other
  misc_feature (314)..(314): n is a, c, t, g, unknown, or other
  misc_feature (362)..(362): n is a, c, t, g, unknown, or other
  misc_feature (565)..(565): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggnnnnnnnnnnnnnggggggggnnnggggnnnnnnnnnnnnnnnnnnnnnnnnnnnnnnnnnnnnnnnnnnnnnnnnnnnnnnnnnnnnnnnnnnnnnnnnnnnaaaaaactgggagactccaccgggggntgggcgggccggctctagaaactagtggaatccccccgggctgcaggnaattcgtctcacccctagaaaaaaactccaacctacccagcctcggccagccacctccccgtcgctctcagctcttctgccgccgcctccctcttccctcactcatcctccgtctgagcaatgcctcatcgcggatcttcgctctctcctcgcatggctgtcagggcatcaactcaattctctagccttctccggtggagaangggtaaacattcctcccgctggaaacagtggcaaagaaaatcgggtttccgggcttgcccaaaaaaggaaacgggggaaaaaggttggggaaaatttggaaaaaaaacactttggttttttcggacaacactggaaattttgggggggaaacaaaattcccgaaaattgggggggaaatccctgggaaacggttgaaaattgggaggggccct

SEQ ID NO: 58863 - DNA, 650 bp, Zea mays
  misc_feature: Ceres CLONE 1513385
  misc_feature: Encodes the peptide sequence at SEQ ID NO. 58864
tccccgcggtggcggccgctctagaactagtggatcccccgggctgcaggaattcgtctcacccctagaaaaagacccgaccagcggccgagtgcccgattacgatcagccatcgccgccacctccctccgcggctccgccttccgccgcgaacacgccgctgtctcgaccccttgtcctcctccttcagcaagatggcggagattgagataacaacagcacctgctgacttccgcttccctacgacaaacctcacaaggcattgttttactcgctatgtcgagtaccacaggtgtttgagtgccaaaggggatgatgctggtgtttgcgaaaaatttgccaagtactacaggtccctttgccctggagaatgggttgagaaatggaacgagcagagggagcatgggacgtttccaggacctctctgaatgtaccgcccgatacctccagttggaccagtcaacaagttggccaggcagtcctactgttccattctgcattcctacttccagaatcatacatgccttttgtcccttgctcttcaaccagtcgccacaaagctgttactgatgcctctcgtatgcagctcatataatttggctacagttgccccacatgctaccctgtttagtgtgtggactgtggacctc

SEQ ID NO: 58864 - protein, 77 aa, Zea mays
  misc_feature: Ceres CLONE 1513385
  misc_feature (4)..(76): Pfam Name: COX6B Pfam Description: Cytochrome oxidase c subunit VIb
  misc_feature: SWISSPROT Homolog: EC 1.9.3.1 Cytochrome-c oxidase
MAEIEITTAPADFRFPTTNLTRHCFTRYVEYHRCLSAKGDDAGVCEKFAKYYRSLCPGEWVEKWNEQREHGTFPGPL

SEQ ID NO: 58865 - DNA, 659 bp, Zea mays
  misc_feature: Ceres CLONE 1513387
  misc_feature: Encodes the peptide sequence at SEQ ID NO. 58866
tggagctccccgcggtggcggccgctctagaactagtggatcccccgggctgcaggaattcgtctcacccctagaaaaaaagcaaataagacgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacggctgcagctgcggtggcaactgcaagtgcgacccctgcaactgctgatcacatcgatcgacgaccatggatatgattattatctatctagcttgtggtggtggttgaacaataataagcgaggccgagctggctgccatacataggtattgtgtggtgtgtgtgaaagaaagagaaacagagttcttcagtttgcaatctctctctgcatgtttggcgtcagtctttgtgctcatgtacctacgtgtgtctacctgcatgttggttgatccgattgcatctgctgataccataatataaatggctccacgatgatatgatttgatc

SEQ ID NO: 58866 - protein, 76 aa, Zea mays; identical to SEQ ID NO: 8464
  misc_feature: Ceres CLONE 1513387
  misc_feature (1)..(76): Pfam Name: Metallothio_2 Pfam Description: Metallothionein

SEQ ID NO: 58867 - DNA, 622 bp, Zea mays
  misc_feature: Ceres CLONE 1513388
  misc_feature: Encodes the peptide sequence at SEQ ID NO. 58868
tggagctccccgcggtggcggccgctctagaactagtggatcccccgggctgcaggaattcgtctcacccctagaaaaaacctggttctccatccggtcagaccaatcaacaaagtgacgcgagcacgagcatccatcgtttccccttcttccccatcgcgtgccctcgccgcagccatcttccatggcggaccagctcacggacgagcagatcgcggagttcaaggaggccttcagcctcttcgataaggatggcgacggctgcatcactaccaaggagcttggaactgtgatgcgctcccttggccagaaccccactgaagcagagctgcaggacatgatcaacgaggttgatgctgatggcaatgggaccattgacttcccagagttcctgaacctgatggcaaggaagatgatggacaccgactccgatgaggagcttaaagggagcctttcgcgtcttcgacaagggaccagaatggttttcattcttcagctgctgaagctcccgcccttgtcatggacccaaccctcgggggagaaaaccttaaacgggaccaagggaaggcccaaaaaaaaaaatcccccgggggggcccaatttttaaaccggcccccccccc

SEQ ID NO: 58868 - protein, 140 aa, Zea mays
  misc_feature: Ceres CLONE 1513388
  misc_feature (12)..(40): Pfam Name: efhand Pfam Description: EF hand
  misc_feature (48)..(76): Pfam Name: efhand Pfam Description: EF hand
  misc_feature: SWISSPROT Homolog: EC 2.7.11.1 Non-specific serine/threonine protein kinase
MADQLTDEQIAEFKEAFSLFDKDGDGCITTKELGTVMRSLGQNPTEAELQDMINEVDADGNGTIDFPEFLNLMARKMMDTDSDEELKGSLSRLRQGTRMVFILQLLKLPPLSWTQPSGEKTLNGTKGRPKKKNPPGGPNF

SEQ ID NO: 58869 - DNA, 639 bp, Zea mays
  misc_feature: Ceres CLONE 1513391
  misc_feature: Encodes the peptide sequence at SEQ ID NO. 58870
  misc_feature (376)..(376): n is a, c, t, g, unknown, or other
  misc_feature (505)..(505): n is a, c, t, g, unknown, or other
  misc_feature (506)..(506): n is a, c, t, g, unknown, or other
  misc_feature (639)..(639): n is a, c, t, g, unknown, or other
gcggtggcggccgctctagaactagtggatcccccgggctgcaggaattcgtctcacccctagaaaaacccgaaccaaatcactcccaccgtctccacagcaaccagcacacatttccctttggcggatcgaaggaaggaaggaggagatgggtggcggcatggaggtgcacaaaaaccggtggatcgaagagtggaacgccggccgggagaacctcgagttcaacttccgctggacccgccgcagcctcgccgtcgtcggcctcttcggcctcgctgtccccatcctcgtctacaagggcatcgtccgcgaattccatatgcaggacgaggatgcaggtcggccatacaggaagttcctgtaagaggcgtccagngctgcaggatacgtcgattctccaccgggggctgagaggaggggagtttccattcagtttgtgtcggtattgttttagtctgaatctgatgaagcaatttggaatgctgaattattgtgcctgatccannatgataaggtgtaatgactcgtctttcattactgaaactggacatgtttgaatctaaaaaaaaaaaaaaaacgagacgctcgaggtccccattcgccctatagtgagtcgtatacgcgcgctcactggccgcn

SEQ ID NO: 58870 - protein, 71 aa, Zea mays
  misc_feature: Ceres CLONE 1513391
MGGGMEVHKNRWIEEWNAGRENLEFNFRWTRRSLAVVGLFGLAVPILVYKGIVREFHMQDEDAGRPYRKFL

SEQ ID NO: 58871 - DNA, 678 bp, Zea mays
  misc_feature: Ceres CLONE 1513393
  misc_feature: Encodes the peptide sequence at SEQ ID NO. 58872
  misc_feature (407)..(407): n is a, c, t, g, unknown, or other
  misc_feature (408)..(408): n is a, c, t, g, unknown, or other
ggagctccccgcggtggcggccgctctagaatagtggatcccccgggctgcaggaattcgtctcacccctagaaaaaatgagcacccctgtcctccgccgtcccatggccgcgacctgttcgtgggacacttccttccacgagcaacagcagaatcagaagctctagctacctctactaccgacctggatccactcaacccgctacactgagcaccgcttcccgttcgacaagtggagagaagaggttattcatcgatctgcgctgcagcctgcaaaggataaggagaaggacgcgcttgacatgggcaagtacgtggagctgctggacatgggcgagcacatcgccgagcgcttccactcccactgccagcagaccgagcgcctctactaccacccgcccgcaggnnggtcggcagccacctgaggatcatcgcattggcgactctgcgatggatggagccgtcgacgctgccgtgatgctgaagcaacaggctcacaggttccattcctctcgagattatcctccagacctgcgtcaattgccgctggccggggcgggatgctccccagtactcgtcgagggggacctgacatgaaaccatgggatttgtatcatcgattctctggattgggaaaaaatccggattcgggtggggctgacccaggccacgaaatgt

SEQ ID NO: 58872 - protein, 40 aa, Zea mays
  misc_feature: Ceres CLONE 1513393
  misc_feature (36)..(36): Xaa is any aa, unknown, or other
MGKYVELLDMGEHIAERFHSHCQQTERLYYHPPAGXSAAT

SEQ ID NO: 58873 - DNA, 574 bp, Zea mays
  misc_feature: Ceres CLONE 1513394
  misc_feature: Encodes the peptide sequence at SEQ ID NO. 58874
  misc_feature (361)..(361): n is a, c, t, g, unknown, or other
  misc_feature (410)..(410): n is a, c, t, g, unknown, or other
  misc_feature (489)..(489): n is a, c, t, g, unknown, or other
ctccccgcggtggcggccgctctagaactagtggatcccccgggctgcaggaattcgtctcacccctagaaaaatccccagttctttggtccgcgtcagagaggcggcggcgatgtctgggcgcggcaagggcggcaagggtctgggcaagggcggcgcgaagcgccaccggaaggtgctccgcgacaacatccagggcatcaccaagccggcaatccggaggctggctaggaggggtggcgtgaagcgcatctcggggctcatctacgaggagacccgcggcgtgctcaagatctttctcgagaacgtcatccgcgacgccgtcacctacaccgagcacgcgcgccgcaagaccgtgacngccatggacgtcgtctacgcgctcaagcgccagggccgcaccctctacngcttcggaggctaggctaggcgcctcttcgtagtcggggactggttaggggacatgtctctgtgtgatgctttctgaangtagtatgctgcaatagctgtgtaatccatcgcttcttgcatgagcgctttgagcatgctaccgtatgttgtgtctggggggtga

SEQ ID NO: 58874 - protein, 103 aa, Zea mays
  misc_feature: Ceres CLONE 1513394
  misc_feature (25)..(94): Pfam Name: Histone Pfam Description: Core histone H2A/H2B/H3/H4
  misc_feature (100)..(100): Xaa is any aa, unknown, or other
MSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYXFGG

SEQ ID NO: 58875 - DNA, 632 bp, Zea mays
  misc_feature: Ceres CLONE 1513395
  misc_feature: Encodes the peptide sequence at SEQ ID NO. 58876
  misc_feature (612)..(612): n is a, c, t, g, unknown, or other
  misc_feature (617)..(617): n is a, c, t, g, unknown, or other
gctctagaactagtggatcccccgggctgcaggaattcgtctcacccctagaaaaaaggagcagcagcagagcagcggcgatggcggcctccatgatctcctcgtcagctctggcggtggcgcctcagggcctgccgcccctcggccgccgcgcctcctccttcgccgtcgtctgctccaagaagaagatcaagaccgacaagccctacggcattgggggtggcctgaccgtcgacgtcgacgccaacgggagaaagggcaagggcaagggcgtgtaccagttcgtcgacgagtacggcgcgaacgtcgacggatacagcccgatctacaacgaggatgactggtctcccaccggcgacgtctacgtcggtggaaccactgggcttctgatctgggccgtcaccctcgctgggatcctcggcggcggcgccctcctcttctacaacaccagcgccctctccgggctaggatatccaatgcatgcgcttcatgcgattcgtcatgtaaagtcaggggtgtctgtctataatctagcctccggggatgctcaaccttcgtcatgtaacattcatcagggctactcttcattacataattttgatgcctctctcnaaggnagtttgcctggctgc

SEQ ID NO: 58876 - protein, 184 aa, Zea mays
  misc_feature: Ceres CLONE 1513395
  misc_feature (32)..(128): Pfam Name: PsbR Pfam Description: Photosystem II 10 kDa polypeptide PsbR
  misc_feature (178)..(178): Xaa is any aa, unknown, or other
MAASMISSSALAVAPQGLPPLGRRASSFAVVCSKKKIKTDKPYGIGGGLTVDVDANGRKGKGKGVYQFVDEYGANVDGYSPIYNEDDWSPTGDVYVGGTTGLLIWAVTLAGILGGGALLFYNTSALSGLGYPMHALHAIRHVKSGVSVYNLASGDAQPSSCNIHQGYSSLHNFDASLXGSLPGC

SEQ ID NO: 58877 - DNA, 637 bp, Zea mays
  misc_feature: Ceres CLONE 1513397
  misc_feature (471)..(471): n is a, c, t, g, unknown, or other
ggagctccccgcggtggcggccgctctagaactagtggatcccccgggctgcaggaattcgtctcacccctagaaaaaatcttttagttacattaaacaaatgggtcactgctgcagatgtgaattcgtactacaactccgctggcatgggtgttgcaacaaagtgaatggcaaaccgctagaccaaattaggcaggcatgtttatttacttatcctggctaatctatttgtttgtgatccaaatctgacactaacactaataggtgactgatgtataaacttgttacagtgccactgaatgaactgaagcagttaatcttgagcaacaactgaacacgacaagcacttcacagaagctgaccgctgcaagctaacaagtagtaatgcttgtcataccccatacggcacagagaatgtgtttgtacaaagatgggtgatgtttacacaattcatggtagctcgaaattaantatatgctccagtgctggaagtgttgcctttgtgtgacataagcttacgggctaatgtgagtatagcgctcactgatgactagttctagaacttccgcggctatgatgagatcctcctgccttggtgctgggtccaatgcacccctaacaaaaactaaaaattggg

SEQ ID NO: 58878 - DNA, 650 bp, Zea mays
  misc_feature: Ceres CLONE 1513399
  misc_feature: Encodes the peptide sequence at SEQ ID NO. 58879
  misc_feature (42)..(42): n is a, c, t, g, unknown, or other
  misc_feature (70)..(70): n is a, c, t, g, unknown, or other
cacccgcgggtggcggccgctctagaactagtggatcccccngggctgcagggaattcgtctcacccctnagaaaaaaaaaaaaaaaaaaaaaaaaaaaaaaaaaaaaaaaaaaaaaaaaattccggcttaccacacttaaagccgccgccgctgccgtttcgcgcaccgtaccctagccctcgtcagcggcggcttcaagctcctccagccatgacgttcaagcggaggaatggcggacgcaacaagcacgggcgcggccacgtcaagtacatccgctgctccaactgcgccaagtgctgccccaaggataaggctatcaagcggttcttggtgaggaacattgttgagcaggctgccgtgagagatgtgcaggaggcctgtgtacatgatggatatgttctacccaaattgtatgcaaaggttcatcactgtgtctcatgcgcaatccatgcgcacatttgtccgtgtccgctctcgtgagaacaggaggaacggtgagcccccgcagcgcttcaaacgccgggatgatggccccaggcctggtcagggcccgccgcgccccaggcggtgcacttcctgaactgcagttgctgctgctcctcgaaactaaagtctgggattaattttcggggcttaattttttggaaa

SEQ ID NO: 58879 - protein, 89 aa, Zea mays
  misc_feature: Ceres CLONE 1513399
  misc_feature (1)..(87): Pfam Name: Ribosomal_S26e Pfam Description: Ribosomal protein S26e
MTFKRRNGGRNKHGRGHVKYIRCSNCAKCCPKDKAIKRFLVRNIVEQAAVRDVQEACVHDGYVLPKLYAKVHHCVSCAIHAHICPCPLS

SEQ ID NO: 58880 - DNA, 654 bp, Zea mays
  misc_feature: Ceres CLONE 1513401
  misc_feature: Encodes the peptide sequence at SEQ ID NO. 58881
  misc_feature (499)..(499): n is a, c, t, g, unknown, or other
  misc_feature (528)..(528): n is a, c, t, g, unknown, or other
  misc_feature (542)..(542): n is a, c, t, g, unknown, or other
ccccgcggtggcggccgctctagaactagtggatcccccgggctgcaggaattcgtctcacccctagaaaaagattgagtgcatccctgtcccttgtgaagtgtcaagcaatgccccaatgtacttcaaaaaggctattgatgaagctgaagaagaatggacccaacatgagatgaagaaggttatcccgacaagtgcaagccgcaacttgaggcaagtcatcccggagaactttgcctacttccatgtggagttcgggctggaccgtggctttgttcatgtaatagatgacgagagcaagttcagtgctggatttggattgaatgtcattagagggatgctccagttgccagaggaggacatgcaccgtcgacgaaggcacgagtccatggataaccagaggcaggctgttgctagcttcatgaaagattgggagcccttcgattggacgaagcaacttgattgaatgtgaatacagttttgagaacgctcgaagaanaattgcacgacttgtactaaaagattttngtagaactttgtantggatgtatgctatcacttttgttttgtttccaacataaatgttttattccccagaaactaacaggcgcaggtttctagctggaaaatgatatcgactgaggaaaaaaaaaa

SEQ ID NO: 58881 - protein, 115 aa, Zea mays
  misc_feature: Ceres CLONE 1513401
  misc_feature (13)..(111): Pfam Name: CwfJ_C_2 Pfam Description: Protein similar to CwfJ C-terminus 2
MYFKKAIDEAEEEWTQHEMKKVIPTSASRNLRQVIPENFAYFHVEFGLDRGFVHVIDDESKFSAGFGLNVIRGMLQLPEEDMHRRRRHESMDNQRQAVASFMKDWEPFDWTKQLD

SEQ ID NO: 58882 - DNA, 681 bp, Zea mays
  misc_feature: Ceres CLONE 1513403
  misc_feature: Encodes the peptide sequence at SEQ ID NO. 58883
ggagctccccgcggtggcggccgctctagaactagtggatcccccgggctgcaggaattcgtctcacccctagaaaaagccaacggcgccacggcggcgacgagaagtggcgagccccgagagcgggtttagttagaggctacgggcggtcgggcgcggcggcggcggcggccatgagcagcgggagcgagagcactaccgccagcaggtggcccgagctggccacgctgcgcgccctggcgcgcgacgccgcggagcagctgcggctgccgcgggccggcacgtcggcgtcggcgtcggcgtcgtcgtcgccgtggcgcgggcgcgaggaccacctccacggccacggcaagacggccaaggtgatgcacctgctgctctggggacccaagtgaagcggcgagaggccaccgtaccgccggcgttgctcgttttgctctgcctgcaatccgccccgcacggactgtactgtactgtacctatacacctatatactaagacgtgcacatgtactaagcctacgaacgtgctgcgtgtaccctcctaaacaaaagaaaaaaaacgaggacgcttcgaggtaccccgattcccccccaatagggaggccgaaattacagccgggcttaactgggcctcttcgtttttcccaaccggccctcgaaccgggtaaaaaacctccgg

SEQ ID NO: 58883 - protein, 73 aa, Zea mays; identical to SEQ ID NO: 58678
  misc_feature: Ceres CLONE 1513403

SEQ ID NO: 58884 - DNA, 640 bp, Zea mays
  misc_feature: Ceres CLONE 1513408
  misc_feature (464)..(464): n is a, c, t, g, unknown, or other
  misc_feature (490)..(490): n is a, c, t, g, unknown, or other
tccccgcggtggcggccgctctagaactagtggatcccccgggctgcaggaattcgtctcacccctagaaaaaatccaatctcatcaccagctaagaacagggcttcgtctctgtggaaagcaagacagggcacctcaagtgctgtttcgtctccctcgtgctcctcctgtgtcttgtccttgagtcccaccaggctgaagctggatgcaaatgatgctgcgaaaccgccaccggaaaataccattttaatcgctgcgttgactccggtttggtcgacaatattgcgttctgtgcaggtaatgccggttgcatcattatggaaaacagatgtgtaggcccgtggccggtggctgctcctgatgcgctttcactggatgtcatttgattacttagaagcaagtaagtcaagaaacgacggccagacgactgtcgtccagcgattggttatttagggacttgccgnttgtcttcttatttcaactatcccancagcccctttcgagagggtcatccccttcaaagctgccgactggtgcgtaaaccaatctatatatccaataaaaaggggcccctaggggtggatttgtctcccaaaaaaatgtttaaactaaaacctctgaggtacccatttcccccaaa

SEQ ID NO: 58885 - DNA, 645 bp, Zea mays
  misc_feature: Ceres CLONE 1513409
  misc_feature: Encodes the peptide sequence at SEQ ID NO. 58886
tggcggccgctctagaactagtggatcccccgggctgcaggaattcgtctcacccctagaaaaaactggttgctagtgcttcctggatcaggaaggaaacaccgccgccgccgcgccttccattccagtactcgcggaggaaaggaacaccagccatcgccatggtcacgtcgacgaccgccgccgccgtgctgtccccgccgtccgtggccgggcttcgcctggcgccgtctcctcgggcgcgcgtggggttccgcgcggcaccggcacggcggtccgtggcggcgcgcgcggatctgatcccgtcgctggtgatcaaccagagcacgggtgtgtcgctcttcctgggccgcttcggcttcgtcaacttccatcgggagagcgtggcaaatcaagtgcccgatcagatcggaaacacgcacttcgacgccggagactagcgagcctaggagttctcgggactgctcaggtccaatgactccgtgcgcttcaacatcgtcgacatcctcgcctggggatcgcttggacagatcgttgcctatgagatcctctgcacttctagtaacggatacgaccccaaatgcttctgagcagtctgttgcgggcatgttcttgagcttgactgtattcaactcccgtgggagt

SEQ ID NO: 58886 - protein, 92 aa, Zea mays
  misc_feature: Ceres CLONE 1513409
MVTSTTAAAVLSPPSVAGLRLAPSPRARVGFRAAPARRSVAARADLIPSLVINQSTGVSLFLGRFGFVNFHRESVANQVPDQIGNTHFDAGD

SEQ ID NO: 58887 - DNA, 642 bp, Zea mays
  misc_feature: Ceres CLONE 1513410
  misc_feature: Encodes the peptide sequence at SEQ ID NO. 58888
  misc_feature (555)..(555): n is a, c, t, g, unknown, or other
  misc_feature (629)..(629): n is a, c, t, g, unknown, or other
tccccgcggtggcggccgctctagaactagtggatcccccgggctgcaggaattcgtctcacccctagaaaaaaaaaaaaaaaaaaaaaaagtgacccggtccggtgggtgtggctcgcttcctctctgtccgactcctttccttcattttcctcttctgacctccggcagcaccatggagaacgtcgccgcgaatccttccgctgcggccgccgccgcagggaatggcgtccaagcatcgggggccggaggggagcgcccggaggacgcgtcgaagcagaacctggcgcaggtgacgagctcgatccagaagacgctgggcctgctccaccagctcaacctcaccgtctcctccttcaactctgcctcccagcttcccctcctccagcgcctgaacgcgctcgtggcggagctcgacacgatgcagaaactagccgagggttgtaacatccaggtgccaaatggaggtcgtcaatttgatcgacgatgggaagaaccccgacgagtttactagggatgtgctcaacagctgcattggcaagaaccagatcaccnaggggcagactgacgcttttcaagagcctacgggaagcatctcctttgaggagcttgacaagctttcccctgangacgtagagcata

SEQ ID NO: 58888 - protein, 112 aa, Zea mays
  misc_feature: Ceres CLONE 1513410
MENVAANPSAAAAAAGNGVQASGAGGERPEDASKQNLAQVTSSIQKTLGLLHQLNLTVSSFNSASQLPLLQRLNALVAELDTMQKLAEGCNIQVPNGGRQFDRRWEEPRRVY

SEQ ID NO: 58889 - DNA, 648 bp, Zea mays
  misc_feature: Ceres CLONE 1513411
  misc_feature: Translation starting site: 153
  misc_feature (408)..(408): n is a, c, t, g, unknown, or other
  misc_feature (626)..(626): n is a, c, t, g, unknown, or other
ggcggccgctctagaactagtggatcccccgggctgcaggaattcgtctcacccctagaaaaagacctgcagccaaccatctaccagcgactcagcgagcgagagcagcacacactgcacgcagctagctaggagcagcagcagcggcggcgatggcggcctccatgatctcctcgtcagctctggcggtggcgcctcagggcctgccgcccctcggccgccgcgcctcctccttcgccgtcgtctgctccaagaagaagatcaagaccgacaagccctagggaaattgggggtggcctggaccgtcgacgtcgacgccaacgggagaaagggcaagggcaagggcgtgtaccagttcgtcgacaagtacggcgcggaacgtcgacggatacagcccaatctacaacngaggatgactggtctcccaccggcgacgtcctacgtcggtggaaccactgggcttcggatctgcgccgtcaccctcgctgggatcctcggcggcggcgccctcctcgtctacacaccagcgccctctccggctaaggatatccaatgcatgcgcttcttgcgattcgtcatgaaaatccagggtgtctgtctataatctagcctccatggatgctcanccttcgtcatggtaacataatc

SEQ ID NO: 58890 - DNA, 657 bp, Zea mays
  misc_feature: Ceres CLONE 1513414
ctccccgcggtggcggccgctctagaactagtggatcccccgggctgcaggaattcgtctcacccctagaaaaagctctctgcttccctctccattttttcatctcattcggcgccgcggcaccccctgctcgtcactcgcgatggcccggatcaaggtgcacgagctgcgcggaaagagcaagacggatctgcaagcgcagctcaaggagcttaaatcggagctctccctcctacgcgtcgccaagcaagattgtgcgcacctccatcgctcgcgtgctcaccgttatctcgcagaagcagaagtcggcgctgcgtgaggcgtacaagaagaagaagcttctcccgctcgatctccgccccaagaagacccgcgccattcgcaggcgcctcaccaagcaccagctctccttgaagaccgagagggaaaagaagcgtgggaagtattttcccatgcggaagtacgctatcaaggcctagattagtgaaagaacagcttttatcccatacagttttgcccagaagttttttgagtttgatgtaccccacatctttcgtcattacaatgttgaagtgtatgatggaaaaatgttttgcccaggagcttccttgagtttgatcaactgcatgatgaaaaaaatgggaacttttttgtttt

SEQ ID NO: 58891 - DNA, 641 bp, Zea mays
  misc_feature: Ceres CLONE 1513416
  misc_feature: Translation starting site: 150
  misc_feature (615)..(615): n is a, c, t, g, unknown, or other
tccccgcggtggcggccgctctagaactagtggatcccccgggctgcaggaattcgtctcacccctagaaaaactctctccttcccgagcaggaggtggacaatgtaagcagcaatcgcaggagccctagcgccgccgcacccgcaggaatgggtatcgacctcgtcgccggtgggaggaataagaagaccaggcgcactgcgcccaagtctgactatgtctacctcacgctcctcgtcaggctctaccgtttcttggtcaggaggaccgagagcaatttcagcgctgtcattctcaagaggcttttcatgattagaaccaaccgaccaccaatctccatgcgccgccttgtcgagttatatggaacgacaggagaacaacattgctgtgcttgttggcacagtcacatgatgacacaatgatccacgatgttcccgcactgaaggttactgccctgatgttcacggagacagcaagggccagtattgtcaatgctggcggcgagtgcctcacatttgaccagcttgctcttcgagctccacttggcgagcacacggtcctcttcgagcgccccaataatgctcgtgatgcactgaggcactttggcaagctccntggagtgccgcacagccacaccatgc

SEQ ID NO: 58892 - DNA, 553 bp, Zea mays
  misc_feature: Ceres CLONE 1513417
  misc_feature: Encodes the peptide sequence at SEQ ID NO. 58893
  misc_feature (327)..(327): n is a, c, t, g, unknown, or other
  misc_feature (502)..(502): n is a, c, t, g, unknown, or other
  misc_feature (531)..(531): n is a, c, t, g, unknown, or other
gcggtggcggccgctctagaactagtggatcccccgggctgcaggaattcgtctcacccctagaaaaagaagctggagaagctcgcacgcaagggccccagctcaggagagcaagcttcgtcgactacagtctctgcagcaagtgatgtgaaggctggggctgggccaacggagtcagcgtctgcaaacgtgtcaaccgacaagaacaggaactacgctgtcctggcaggcacaattgctgctctgagtggcctgggttggtatctattgtcaaagcctaagaagtcggaggaggttgtggactgaagagggggttacgaatgcgangctgtggatggttggccttatatttcaccatggtttactttctgcgcacgccttctggaaataatttgtgaaacatacgctgcagtctgcattacttgttctgaggcctggttgcacacgaaacattgaaatctgtactcgagacggtccgtagttctctccctcgcttgacagntgcaaatggtgagtgatgcttgtcctacntcgttgctgagaaaaggaaaaa

SEQ ID NO: 58893 - protein, 47 aa, Zea mays
  misc_feature: Ceres CLONE 1513417
GGGRSRTSGSPGLQEFVSPLEKEAGEARTQGPQLRRASFVDYSLCSK

SEQ ID NO: 58894 - DNA, 671 bp, Zea mays
  misc_feature: Ceres CLONE 1513418
  misc_feature: Encodes the peptide sequence at SEQ ID NO. 58895
  misc_feature (581)..(581): n is a, c, t, g, unknown, or other
  misc_feature (599)..(599): n is a, c, t, g, unknown, or other
tccccgcggtggcggccgctctagaactagtggatcccccgggctgcaggaattcgtctcacccctagaaaaaagcagcagcagcacagtcatccacactaacgaacgaactcttgctccgatcacgagctagctgaggtcgacgatggcggctgtgctgaacagcaggaagacggcgcaggcggtggtggccgtgctggtggcggcggcgctgctggcttcgtccacttcggcggcgatcacctgcgggcaggtggggtcgtcgctggcgccgtgcatcccgtacgcgacggggagggccagcgcgctccccgcgtcgtgctgcagcggcgtcaagagcctcaacagcgcggcgcggaccaccgcggaccgccaggcggcgtgcccctgcctcaagagcttcgccaacagcgtccagagcgtcaacatgggcaccgtcgcccccatccccggaaagtgcgggcgctccgtcggattccccatcagcatgtccaccgactgccacccgatcagctaagtttccaacgaccaacctaataatgcctaccgaaacgtacaccaacggccccgcgccgctggcnggaatggaggacccccangcaaaaaaataaaaaaaaagccgctggtattggctgggaacatacttgttttaatttaagccccccccaatg

SEQ ID NO: 58895 - protein, 123 aa, Zea mays
  misc_feature: Ceres CLONE 1513418
  misc_feature (34)..(119): Pfam Name: Tryp_alpha_amyl Pfam Description: Protease inhibitor/seed storage/LTP family
MAAVLNSRKTAQAVVAVLVAAALLASSTSAAITCGQVGSSLAPCIPYATGRASALPASCCSGVKSLNSAARTTADRQAACPCLKSFANSVQSVNMGTVAPIPGKCGRSVGFPISMSTDCHPIS

SEQ ID NO: 58896 - DNA, 659 bp, Zea mays
  misc_feature: Ceres CLONE 1513419
  misc_feature: Encodes the peptide sequence at SEQ ID NO. 58897
tcaccgcggtggcggccgctctagatctagtggatcccccgggctgcaggaattcgtctcacccctagaaaaactctccgtatccggcggcggaagcggaagcggaagcggaaggaagtaagcggccaccatggtgaatggacgcacggggcaacgcgtcaggctctacttccggggcaccatcctcggatacaagaggtccaaatcgaaccagtacgataccacgtctcttgtgcagatcgaaggtgtgaacacccaggatgacgtcgcgtggtacgctggccagcgcatgccgtatctctactaagccaagaccaagagcggtgagacccgctaccggtgcctctggggtaagggcaccctccacggaagggagtccggcggtgtccgcaccaagttcgagtcttacctcccgcctgaaactttggtgcgcaaggtcttagaggtcatggcccctaaacaggttttaagggttttgttggagtaaaaagggtttaaaaaagttatgcgtttttccttacttttttccggaaccttaaagctttttttttgggaaacttaaaatgtgcccttcgggccttgaacttttgcggggtgaaattttggtctaaatttttttgtcccaccccatgaaccaatatatttggggggggtttggc

SEQ ID NO: 58897 - protein, 58 aa, Zea mays
  misc_feature: Ceres CLONE 1513419
MVNGRTGQRVRLYFRGTILGYKRSKSNQYDTTSLVQIEGVNTQDDVAWYAGQRMPYLY

SEQ ID NO: 58898 - DNA, 664 bp, Zea mays
  misc_feature: Ceres CLONE 1513420
  misc_feature: Encodes the peptide sequence at SEQ ID NO. 58899
ggagctccccgcggtggcggccgctctagaactagtggatcccccgggctgcaggaattcgtctcacccctagaaaaaacccgactccgccgccgctcccgctccgccccagcgcatcgcccgccgccacagcgtaccgcgacctcatctatcaccttcagctttcaatcatggcggacgtccatgtcaaaccggaggttgccgccggaactcccaagaacaggacgttccgcaagtactgctaccgcggcgtcaacctagatgcgcttctcgacatgtccactgacgacctcgtccagctcttccccgcgcgcgccaggagaaggttccagaggggtctgaaaaggaaacccatggcgctcatcaagaaactgcgcaaggcgaagaaggatgctcctgctggtgagaatcctgagccagtcaagacacatctccgtaacatgatcattgtccctgagatgattggacgcattgttggtgtctacaacggcaagaccttcaaccaggttgagatcgcgcctgaagtgatcggccactaccttgctgagttctccatctcctacaaaccggtcaagcacggcaggcccggtatacgtgccacccactcctcgcggtttattcctctgaaatgagctggtactcggctcatttagatcccaagaca

SEQ ID NO: 58899 - protein, 153 aa, Zea mays
  misc_feature: Ceres CLONE 1513420
  misc_feature (55)..(136): Pfam Name: Ribosomal_S19 Pfam Description: Ribosomal protein S19
MADVHVKPEVAAGTPKNRTFRKYCYRGVNLDALLDMSTDDLVQLFPARARRRFQRGLKRKPMALIKKLRKAKKDAPAGENPEPVKTHLRNMIIVPEMIGRIVGVYNGKTFNQVEIAPEVIGHYLAEFSISYKPVKHGRPGIRATHSSRFIPLK

SEQ ID NO: 58900 - DNA, 608 bp, Zea mays
  misc_feature: Ceres CLONE 1513421
  misc_feature: Encodes the peptide sequence at SEQ ID NO. 58901
  misc_feature (443)..(443): n is a, c, t, g, unknown, or other
  misc_feature (608)..(608): n is a, c, t, g, unknown, or other
agtggatcccccgggctgcaggaattcgtctcacccctagaaaaaatgaaagcgtctaggtttattttcagtgaaatcagccggaagttcccaatcatgcccttcactgctagggcattaaaagagaagcgtgcacacttatgcttggtggaatgcatgaaccatgagctattgcatccgtaccctgtacttcatgacaagccaggtgaccttgttgcacacataaagttcactgtgctgctaatgcccaatggatcggataggattacatcatatccgctacgggagttaaagccaacaaaatccattgaagacaatgctgaaacataaaggcatggcttgctttggggactaaatcagataataagggtggtggacagaagaatagaggcgagaaaggagatgcctcaggagatctcctggatgcgacttacgatgctacnagccaagaataattctgatttttggaattactgcacccagcattttctctcttggttcttcgcagcatcagatggtgttatattactttcagttgcgaaaaaatggatacttttttctagtgtctaataacgaagcatcttggtgcaattatcgcatccatggcn

SEQ ID NO: 58901 - protein, 109 aa, Zea mays
  misc_feature: Ceres CLONE 1513421
  misc_feature: SWISSPROT Homolog: EC 3.4.11.18 Methionyl aminopeptidase
SGSPGLQEFVSPLEKMKASRFIFSEISRKFPIMPFTARALKEKRAHLCLVECMNHELLHPYPVLHDKPGDLVAHIKFTVLLMPNGSDRITSYPLRELKPTKSIEDNAET

SEQ ID NO: 58902 - DNA, 678 bp, Zea mays
  misc_feature: Ceres CLONE 1513422
  misc_feature (204)..(204): n is a, c, t, g, unknown, or other
  misc_feature (231)..(231): n is a, c, t, g, unknown, or other
  misc_feature (376)..(376): n is a, c, t, g, unknown, or other
  misc_feature (377)..(377): n is a, c, t, g, unknown, or other
  misc_feature (378)..(378): n is a, c, t, g, unknown, or other
  misc_feature (379)..(379): n is a, c, t, g, unknown, or other
  misc_feature (385)..(385): n is a, c, t, g, unknown, or other
  misc_feature (386)..(386): n is a, c, t, g, unknown, or other
  misc_feature (396)..(396): n is a, c, t, g, unknown, or other
ggtggcggccgctctaaaataatgggacccccgggctgcaggaattcgtctcacccctagaaaaatatcagctgcattggaactttctcaactccaaatcctgtttctcatactaggtctactatctttgtggtccgtggactttgtatattttggtggtggggtgaaaaacttggttcttgatacaattggtcactatcttanccagaagtatcacaacagagttatccngcctgaagctggtcacttcttgataacttacttgcttggactgcttccaaaagatacaccatctccagcttatatacacttatgaatcaaggattcgcttaatgtgttttttttgccccccccccgggggaaagaaagggggttnnnnaaaatnnttcctttttnttttattctcccccaaaaaaaaaaaaaagaaaaaaggggggcgcggggggttccgccccccatagaaaaaccccccccaaaaagcggggtcttctttttccataaggtccccctccaacacaaaaaaacaaatgttcctaaaaaccccctgctgtgataccaaagcaccccgtacgcgctctcccaaaaactcttttgttttttgggcttttttccccggccaagaatatatccttccccccttttatattttttcgccccttttcctccccccgcggtggg

SEQ ID NO: 58903 - DNA, 666 bp, Zea mays
  misc_feature: Ceres CLONE 1513542
  misc_feature: Encodes the peptide sequence at SEQ ID NO. 58904
aagctggagctccccgcggtggcggccgctctagaactagtggatcccccgggctgcaggaattcgtctcacccctagaaaaagtgctttcttataggtgggttggcttctcctccccctccggttcgggttcgggttcgtgaggttctccggggtaccggttcctgcgtgaccctatcgccatggtccctgctgatgtttactccttctgcttcatgctgcagcctcgcctgggtgcaggacgaccactccctccacaacgccttcagtagctacggcgaggtcctcgagtccaagatcatcctcgatcggtatacgcataggtcccgcgtattcggcttcgccaccttctccacggaggaggctatgcgtaacgccatcgagggcatgaacggcaatgagctggacggccgccacatcaccgtcaacgaggcccactcccgaggccgccgtggaagcttgcgcggtgggtacagtgatggccgtgtaggcggtggataagaagtggccggcgccgtgatgcccgttgcggctacagaggtggcggctgctacggatggcagctgcggctcctgtggtggtggcggcggctaccgctctggcaaccggggaggctgcctactgctactccctacggtaaactggaatgaactgacccgattgggg

SEQ ID NO: 58904 - protein, 101 aa, Zea mays
  misc_feature: Ceres CLONE 1513542
  misc_feature (6)..(77): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MFTPSASCCSLAWVQDDHSLHNAFSSYGEVLESKIILDRYTHRSRVFGFATFSTEEAMRNAIEGMNGNELDGRHITVNEAHSRGRRGSLRGGYSDGRVGGG

SEQ ID NO: 58905 - DNA, 751 bp, Zea mays
  misc_feature: Ceres CLONE 1513550
  misc_feature: Encodes the peptide sequence at SEQ ID NO. 58906
aactattaattatagtactttaacacaattatctttctttcccccctttcgccaaagctggagctccccgcggtggcggccgctctagtactagtggatcccccgggctgcaggaattcgtctcacccctagaaaaaaaagctgggcatcgagcagggggctcattcatccgcacagaccggtacccagctcaagtcacccccgaaacgcaagctacgcgcgcacgccatggcggcggctccagagcggccgctggcggcggacttcgaggtgctgagctacatcagcagcctggtggaggcgttctcggcgttcgactccaacaacgacgggctggtgacggcgcccgaactccggggcctgctggcgtcgctgggcctggtcaagtctgaggccgaggcgcgcgatatgctggtgcgcgccgacgccgaccgcgacggccgcctcagcgtagaggaattcctggacgtgatgaacgctggggaagctcggactgggagcgctaggggcggtgctgcagtctgcgcttccccacgctggaaggtcgcgtgaggtgcgctcggtccggttcgaaaaacactcgcccggggtgctcgaggatctttcggtagcgcctagggacgaaggacttgcccgggctaattggctggagttccctggaaatggttgaattgttaacgggacccacccccccgtttgtagagaaatacaaggctccatggcgcggaactgtggctcaaagggcattagg

SEQ ID NO: 58906 - protein, 107 aa, Zea mays
  misc_feature: Ceres CLONE 1513550
  misc_feature (57)..(85): Pfam Name: efhand Pfam Description: EF hand
  misc_feature (21)..(49): Pfam Name: efhand Pfam Description: EF hand
  misc_feature: SWISSPROT Homolog: EC 2.7.11.1 Non-specific serine/threonine protein kinase
MAAAPERPLAADFEVLSYISSLVEAFSAFDSNNDGLVTAPELRGLLASLGLVKSEAEARDMLVRADADRDGRLSVEEFLDVMNAGEARTGSARGGAAVCASPRWKVA

SEQ ID NO: 58907 - DNA, 767 bp, Zea mays
  misc_feature: Ceres CLONE 1513553
  misc_feature: Encodes the peptide sequence at SEQ ID NO. 58908
  misc_feature (27)..(27): n is a, c, t, g, unknown, or other
  misc_feature (28)..(28): n is a, c, t, g, unknown, or other
  misc_feature (30)..(30): n is a, c, t, g, unknown, or other
  misc_feature (37)..(37): n is a, c, t, g, unknown, or other
  misc_feature (39)..(39): n is a, c, t, g, unknown, or other
  misc_feature (45)..(45): n is a, c, t, g, unknown, or other
tttttttttttttttttttttttattnntnttttttntntttttntttttttctaaactggtgctccccgcggtggcggccgctctagaactagtggatcccccgggctgcaggaattcgtctcacccctagaaaaaaccgcagaaattctccgcaacttcacagcgtatcatcgttttccatcgctcctactcctatcatccagaaaatctgagcggtattgatggcgcccagggcggagaagaagccgggggcgaagaaggtggcggacgaggagccctcggagaatgcggctccggcggagaaggcccccgcggggaagaaggccaaggcggagaagcggctacctgcgggcaagtccgccggcaaggagggcggcgacaagaaggggaggaagaaggcgaagaagagcgtggagacctacaagatctacatcttcaaggtcctgaagcaggtgcaccccgacatcagcgtcgcctccaaggccatgtccatcctgaactccttcttcaacgaccatcttcgagaagctcgccgcggaggccgcccagcttcgccccggttcgaataggaagcccccccttccccccccgctgagaccgggacctcccgttcccgccctccgtcctcccccggtcgaagatcgtcccaggcacctccggtcctcgggaaggggtacccaagggcacgttcacccaaggttttcccgctccaggtctatgaagaggcactttgggagaaaaagcgggccccggcaatgccgacac

SEQ ID NO: 58908 - protein, 115 aa, Zea mays
  misc_feature: Ceres CLONE 1513553
MAPRAEKKPGAKKVADEEPSENAAPAEKAPAGKKAKAEKRLPAGKSAGKEGGDKKGRKKAKKSVETYKIYIFKVLKQVHPDISVASKAMSILNSFFNDHLREARRGGRPASPRFE

SEQ ID NO: 58909 - DNA, 714 bp, Zea mays
  misc_feature: Ceres CLONE 1513554
  misc_feature: Encodes the peptide sequence at SEQ ID NO. 58910
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (44)..(44): n is a, c, t, g, unknown, or other
  misc_feature (51)..(51): n is a, c, t, g, unknown, or other
  misc_feature (55)..(55): n is a, c, t, g, unknown, or other
ttttnnnnntttttttttttttttttttnnnnnnnnnnnnnnanggagggnaggnaaaaagctggaactccaccgcggtggcggccgctctagaactagtggatcccccgggctgcaggaattcgtctcacccctagaaaatatggttttgtttgctagtctattcatctgttgagaactcaagattgttattgttaggacgtgtgaactttggtgttctaggctgctttcagacgccagtgtcgatatactctctttgctttattgttgcggaatttatcgtaatatgttattttaatgttcaagaaaaaaagtaccacaccactccgcgctagctgaggacggtacagcggcacagaggtgcgacgtacgacgacgacgacgcaggcgccacacatggcatcccagctctccgccgccgtgccccggttccacggcctccggggctacgccgcgcccaggtccgcggtggcagcgctgccgtccgtgagggttggcaggaagaggtcgtcgtcgcagggcatccgctgcgactacatcggctccgccaccaacctgatcatggtgaccacgacgaccctgatgctgttcgcggggcggttcgggctggcgccgtcggcgaaccgcaaggcgacggcggggctgaaagctggaggcgcgcgactccggcctgcagaccggtgacccccgccggggttcacccatcgccgaaaa

SEQ ID NO: 58910 - protein, 95 aa, Zea mays
  misc_feature: Ceres CLONE 1513554
MASQLSAAVPRFHGLRGYAAPRSAVAALPSVRVGRKRSSSQGIRCDYIGSATNLIMVTTTTLMLFAGRFGLAPSANRKATAGLKAGGARLRPADR

SEQ ID NO: 58911 - DNA, 660 bp, Zea mays
  misc_feature: Ceres CLONE 1513555
  misc_feature: Encodes the peptide sequence at SEQ ID NO. 58912
tggagctccccgcggtggcggccgctctagaactagtggatcccccgggctgcaggaattcgtctcacccctagaaaaagtgctttcttagaggtgggttggcttctcctccccctccggttcgggttcgggttcgtgaggttctccggggttcgggttcctgggtgagcggatcaagatggcggcgtcggatgatgagtaccgctgcttcgtcggcggcctcgcctgggccacagacgaccactccctccacaacgccttcagcacctactgcgaggtcctcgagtccaagatcatcctcgatcgggagacgcagaggtcccgcggcttcggcttcgtcaccttctccacggaggaggcgatgcgtaactccatcgagggcatgaacagcaaggagctggacggccgcaacatcaccgtcaacgaggcccattcccgcggcggccgtgcaggcggccgcggtggatacggaggtggccatgtaggcggcggctaccgccgttgcgggcgccgtgatgacgctggcggctactgcgggggcgggggctaaagtgcgcggcggcagctacggttggtggtggcggccggctaccgcagtggccaaccgagggggcccgtactgccaactccgacgggaaactggaagaacttacctgttgg

SEQ ID NO: 58912 - protein, 123 aa, Zea mays
  misc_feature: Ceres CLONE 1513555
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAASDDEYRCFVGGLAWATDDHSLHNAFSTYCEVLESKIILDRETQRSRGFGFVTFSTEEAMRNSIEGMNSKELDGRNITVNEAHSRGGRAGGRGGYGGGHVGGGYRRCGRRDDAGGYCGGGG

SEQ ID NO: 58913 - DNA, 653 bp, Zea mays
  misc_feature: Ceres CLONE 1513559
  misc_feature: Encodes the peptide sequence at SEQ ID NO. 58914
tccccgcggtggcggccgctctagaactagtggatcccccgggctgcaggaattcgtctcacccctagaaaaataactatatagtgaagaaatacaacagtccagtaatttatgttactgagaatggcatggatgatgaagacgatcagtccgcaacgattgaccaggtcctaaacgacacgaagagagtcggctacttcaacggatacctcaattcggttgcgcaggcgatcaaggacggggctgatgtccgtgggtacttcgcgtggtcattcctggacaacttcgagtgggctatgggctacaccaagaggttcggcatagtctacgtcgattacaaggacgggctctccaggcaccccaaggcatcggccctctggttctcgcgcctcctcaagggcgaggctgccgaaaacagctatagctagagctgccatagactgagggaacagtccgcggcaagtacagaacattacatacacacatttctcctgtctgttgttgtgttgtgtcttacggtgagtgcacccgtgtatgtatgtatgtatgtatgtaatctcaggatgtgctagtctgtcgttgatccgacgctggctgagaccggttctccaagaacaagaacaaccacaacctcagcaccaaataagctttga

SEQ ID NO: 58914 - protein, 99 aa, Zea mays
  misc_feature: Ceres CLONE 1513559
  misc_feature: SWISSPROT Homolog: EC 3.2.1.21 Beta-glucosidase
MDDEDDQSATIDQVLNDTKRVGYFNGYLNSVAQAIKDGADVRGYFAWSFLDNFEWAMGYTKRFGIVYVDYKDGLSRHPKASALWFSRLLKGEAAENSYS

SEQ ID NO: 58915 - DNA, 664 bp, Zea mays
  misc_feature: Ceres CLONE 1513562
  misc_feature: Pfam Name: DUF1605 Pfam Description: Domain of unknown function (DUF1605)
ggagctccccgcggtggcggccgctctagaactagtggatcccccgggctgcaggaattcgtctcacccctagaaaaagatgtgggaaaagtggacattcatccatcatcagtcagtgcattcgtaaactaattcccgttacctttcttggtttacagtgagaaggtgaagactgctaccatttatgtaagggactccacgaatatatctgactatgcccttctactctttggtggttcgcttagttcgacccaaactggacaaggcattgagatgcttgggggttatcttcatttctcggctccaaagcgtaccataaagttgattcagaaattaataggagaattggacaaactccttcagaaaaagattgaggaacctgcactcgacatcttttcgcaaggaaagggtgttgtggcggcagctgtacaactgctacacagtcaaaatttcgaccattacatgccaaatattacatgttatcaggactagtttcacactatacgaaagcaaaatcagcgaattcttttgtaaatctcacctctgcgtgttagcatatttctgttgctttattttagaaaccagaattttgagcccaggaacacccacaacgatatcgttgccgagaaaaaaaccctcaaggtacccaatttcacccttatag

SEQ ID NO: 58916 - DNA, 651 bp, Zea mays
  misc_feature: Ceres CLONE 1513573
  misc_feature: Encodes the peptide sequence at SEQ ID NO. 58917
tccccgcggtggcggccgctctagaactagtggatcccccgggctgcaggaattcgtctcacccctagaaaaacaaaaggcaaaagctccccaacgaagtgcgagcgacccacgtccacacgacacgaaccaccaccaccaaccagcagccgcaccacgcacccagcgcaaagcgatggcgtcgctcaccatgatggcgtccttcgccgccgtggcggtggccgcgccctcgcgccgcggcaccttcgccgtggtcaggtccgccaaggtcgaccgctgccaggagcccgccacgctagcagcaaccgaggccaggcccgccgccgacggacgccgcgccgtcatgctcgcggctgctgcagcggccgtggcagccatcagcggcgcctgcaccgccatgccgggccccaagaacgggacccccgaggcgaagaataagtacgcggccatctgcgtcaccatgcccaccgccaaggtctgccacaactgagcacgcccgcgttgcacctgcagggccggagggtggtatataatttatgtacgtgccacggggttgttgtccctattgttggttcgagctttaaatgcatgcctgacctaaggccacttaattgctttctgacgacctccgaactgaaaaatatcatgtgc

SEQ ID NO: 58917 - protein, 104 aa, Zea mays
  misc_feature: Ceres CLONE 1513573
MASLTMMASFAAVAVAAPSRRGTFAVVRSAKVDRCQEPATLAATEARPAADGRRAVMLAAAAAAVAAISGACTAMPGPKNGTPEAKNKYAAICVTMPTAKVCHN

SEQ ID NO: 58918 - DNA, 647 bp, Zea mays
  misc_feature: Ceres CLONE 1513575
  misc_feature: Encodes the peptide sequence at SEQ ID NO. 58919
ctggagctccccgcggtggcggccgctctagaactagtggatcccccgggctgcaggaattcgtctcacccctagaaaaaaaaaagctctcccgtttctgctcgcaagtcacacacacagctccggtagatccggccctcgcctctggctccatgaagagattagcttcagacggcagggatcgatactagcaagcaagcaagcatggcgcacgacttgtgcgaggacttggagctcgtcgccgacgacggcggcggcttcgatgactactactgggacgacgacttccatttccacgacgacggcttctccgcctcccctacgacccccggcagcggtggtgcgccccgccagcagcagcagatgggtgatatttcagcctcggactgcaaagaaggcgaagacatgcaggggataccctgggaaagactcaactacaccagggaccagtatcgtcggatgaggctcaaagagtacaagagctaccagaacctcacgaggtcgcacagcgggctacaacaacaggaatgcaaacaggtggagaggaaggacacattctacgagttccatctgaacacgagagccgtcaagtcaacgatagtgcatttccaggtacggtttcaactcggtacttctctgtccacacc

SEQ ID NO: 58919 - protein, 147 aa, Zea mays
  misc_feature: Ceres CLONE 1513575
MAHDLCEDLELVADDGGGFDDYYWDDDFHFHDDGFSASPTTPGSGGAPRQQQQMGDISASDCKEGEDMQGIPWERLNYTRDQYRRMRLKEYKSYQNLTRSHSGLQQQECKQVERKDTFYEFHLNTRAVKSTIVHFQVRFQLGTSLST

SEQ ID NO: 58920 - DNA, 676 bp, Zea mays
  misc_feature: Ceres CLONE 1513582
  misc_feature: Encodes the peptide sequence at SEQ ID NO. 58921
  misc_feature (676)..(676): n is a, c, t, g, unknown, or other
aagctggagctccccgcggtggcggccgctctagaactagtggatcccccgggctgcaggaattcgtctcacccctagaaaaaactaccaccagtaccacaccactccgcgctagctgaggacggtacagcggcacagaggtgcgacgtacgacgacgacgacgcaggcgccacacatggcatcccagctctccgccgccgtgccccggttccacggcctccggggctacgccgcgcccaggtccgcggtggcagcgctgccgtccgtgagggtgggcaggaagaggtcgtcgtcgcagggcatccgctgcgactacatcggctccgccaccaacctgatcatggtgacgacgacgacgctgatgctgttcgcggggcggggcgggctggcgccgtcggcgaaccgcaaggcgacggcggggctgaagctggaggcgcgcgactccggcctgcagacgggtgaccccgccgggttcaccctcgccaacacgctggcctgcagggccatcagccacatcctcgggggtcggcatcatgctcgggctcaagaacaccggcggccctcgaccagatcatccggctagatccctacgcccgtcgttgtttaaaaaccaaaatcagcaaccctccaattggcaccgccgggccggaaaggttgcctggccaggggaagaan

SEQ ID NO: 58921 - protein, 135 aa, Zea mays
  misc_feature: Ceres CLONE 1513582
  misc_feature (49)..(124): Pfam Name: PSI_PSAK Pfam Description: Photosystem I psaG / psaK
MASQLSAAVPRFHGLRGYAAPRSAVAALPSVRVGRKRSSSQGIRCDYIGSATNLIMVTTTTLMLFAGRGGLAPSANRKATAGLKLEARDSGLQTGDPAGFTLANTLACRAISHILGGRHHARAQEHRRPSTRSSG

SEQ ID NO: 58922 - DNA, 695 bp, Zea mays
  misc_feature: Ceres CLONE 1513585
  misc_feature: Encodes the peptide sequence at SEQ ID NO. 58923
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (26)..(26): n is a, c, t, g, unknown, or other
  misc_feature (28)..(28): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (48)..(48): n is a, c, t, g, unknown, or other
  misc_feature (53)..(53): n is a, c, t, g, unknown, or other
  misc_feature (57)..(57): n is a, c, t, g, unknown, or other
  misc_feature (61)..(61): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (69)..(69): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (97)..(97): n is a, c, t, g, unknown, or other
tttttttttnnnnntttttttttttntntnnnnnnnnnnnnnnnnntnttttntttntttntnnnnntnttnnnnnntnnnnnnnnnagcgcgccgnaaaagctggagctccccgcggtggcggccgctctagaactagtggatcccccgggctgcaggaattcgtctcacccctagaaaaattcgccatccatttttcatatcctcactcgccgccgccgccgctcgtccctcgccccatcgcgatggcccggatcaaggtgcacgagctgcgggggaagagcaaggcggatctgcaagcgcagcttagggagtttaagtcggagctctccctgctacgcgtagccaaggtcaccggcggggctcccaacaagctctccaagatcaaggttgtgcgcacctccatcgcgcgcgtgctgaccgtcatctcgcagaagcagaagtcggcgctgcgtgaggcgtacaagaagaagaagctgctcccgctcgacctccgccccaagaagacccgcgccatccgcaggcgcctcaccaagcaccagctctcctttgaagaccgagagggaaaaagaaacgtgagaaatattttcccccatgagggaagtacgcttatccagggccttaaaatcaagtgaaaagaacattttaatccctggcaaaggtttttgccccaagaaagtttacctgggaaattt

SEQ ID NO: 58923 - protein, 129 aa, Zea mays
  misc_feature: Ceres CLONE 1513585
  misc_feature (6)..(64): Pfam Name: Ribosomal_L29 Pfam Description: Ribosomal L29 protein
MARIKVHELRGKSKADLQAQLREFKSELSLLRVAKVTGGAPNKLSKIKVVRTSIARVLTVISQKQKSALREAYKKKKLLPLDLRPKKTRAIRRRLTKHQLSFEDREGKRNVRNIFPHEGSTLIQGLKIK

SEQ ID NO: 58924 - DNA, 862 bp, Zea mays
  misc_feature: Ceres CLONE 1513587-R
  misc_feature: Translation starting site: 241
  misc_feature (862)..(862): n is a, c, t, g, unknown, or other
cctcgagcgtctcgtttttttttttttttttggaaaagaacattgtcttctttgctcaccagcaaccagtttacaaggcaagaaaatccttccgtagacaagccaaggcaacaaaatgtgctactactcggtaggaagtgattatctatgctgatggcccacaactttcttaaacctggaacccacggctgttcctcctgccaccagccttctcgaacttccttcccttggagcgcacatatggtcttggtgtggctgtgcggcactccaggagccttgccgaagtgcctcatcgcctcacgggcattcttggggcccctcgggaggactgtgttatcgccaagtggagcaaagagagcaagctggtcaaatgtgaggaactcccctaaagcattgacaatcctggcccttggcgtctcggtgaacctcaggggagtaaccttcagtgctggaacctcatggatccacttgtcgtccgcgacagtgccaacaatcacaggaatgttcttctccttacacttccatgaacttgacaaagttgcgcatggagattggtgggcgattgcttttgcttctgaacaccctcttgcaaactgattctttgaagtagggcctggttcgccccgacccataaggggaatagtttgacaaagtctctttttattaaaagggggagaacaacatcccctaggcccggggggattcctggtttctacaaccgggcacccagggtcgattgaacattccctctttttattcccccggtagttaaggggttcaattgtcgccgccttagcccgagatccacaccccctaattttgcatgggggcgggggagaaaatatgtcttttacgcccccan

SEQ ID NO: 58925 - DNA, 762 bp, Zea mays
  misc_feature: Ceres CLONE 1513598
  misc_feature: Encodes the peptide sequence at SEQ ID NO. 58926
ggagctccccgcggtggcggccgctctattaactagtggatcccccgggctgcaggaattcgtctcacccctagaaaaagctcgcgggcgctcatctccactcctccgatggcgccgccacccaccagcccctcattcctccgcccgccgccgatgccacaccacccgcaccctcgcctccttttgcgacctccctccgcctctttccgcgacgccgaaatactcggcggtcggggcctctgcaatggtgaggtcggcgaccgcaaagaactcgcatctggttccaccacctcctcggccggggcctctcctcctcgttcgaaagattctcctccggccgcgggtgatcctgacgctttccaacaacgagaagaggggggtgcgggggcttcttcccgtgggaagagacgtcggcctttgaggactatcctaaatcaaaaaaccctgcctcctcccaagaaaagcccaatcataagcccccaagaacagacgtactcccttgccaccccgctggtccgctcagaacaggacccctagcttccttgccacaaggaagggcccgggcgcatgtttccagaatatcccacaaaaaagggccgaaaccataatggacgcaggcggggcatataatccttaacccttttatgaccctattattaaagggcttttcgtgcggcttcctccacgaccggcacaaagctgttgcccaactaaccccttctacaaagacctttacaatccccaccaatgtattgttttggg

SEQ ID NO: 58926 - protein, 142 aa, Zea mays
  misc_feature: Ceres CLONE 1513598
MAPPPTSPSFLRPPPMPHHPHPRLLLRPPSASFRDAEILGGRGLCNGEVGDRKELASGSTTSSAGASPPRSKDSPPAAGDPDAFQQREEGGAGASSRGKRRRPLRTILNQKTLPPPKKSPIISPQEQTYSLATPLVRSEQDP

SEQ ID NO: 58927 - DNA, 680 bp, Zea mays
  misc_feature: Ceres CLONE 1513606
  misc_feature: Encodes the peptide sequence at SEQ ID NO. 58928
ggagctccccgcggtggcggccgctctagaactagtggatcccccgggctgcaggaattcgtctcacccctagaaaaaatggcgcaataattcctttgagctctcccgaatcgggccagcaacaatactcccaatgcgaacccacccattaacgaccacgagtccgctggggttttgcagcgaggaaagacgatgtcgagcggtccacgcggcccattacgaggacgaggccccccggcatctgggaaggggtatgtccgccgcggccccgcccatgcaccgggacacgacgactgtggaaagaccttgcgaaagcctgtcttcgctggtctcgaacatctggatctccaaacggatggtctcaccctccaagcacgggtcctatcagtccgccatgtcctacacaaaccatgagcacatatcgcacgcaaactagtcgtaaagtacctcgactgagacgaaccggcaccgtccacttcaccacgctgcggcgaacagtctacctctgtcatgccagatgcacaagtgatgttcagcacacgttaacactgacatgatgcacgacagctatcatgtgtggtgcagaacaagtggtgagcgcatcgaagtgactacccactgcatctgttcaaggtgcaacatacaagacagtatgtcgactgaggttactctgatcctgg

SEQ ID NO: 58928 - protein, 73 aa, Zea mays
  misc_feature: Ceres CLONE 1513606
MSSGPRGPLRGRGPPASGKGYVRRGPAHAPGHDDCGKTLRKPVFAGLEHLDLQTDGLTLQARVLSVRHVLHKP

SEQ ID NO: 58929 - DNA, 670 bp, Zea mays
  misc_feature: Ceres CLONE 1513608
  misc_feature: Encodes the peptide sequence at SEQ ID NO. 58930
  misc_feature (640)..(640): n is a, c, t, g, unknown, or other
catagctggagctccccgcggtggcggccgctctagaactagtggatcccccgggctgcaggaattcgtctcacccctagaaaaaaccatctttttcttcctcgcgccgccgccgccgtgacggaaggaagaggaggagcaaggagcacgacgcgatgggtcactccaacgtttggaactcgcaccctaagaactacggccctggctcccgcgtctgccgggtctgcgcgaaccctcacggtctgatcaggaagtacgggctcatgtgctgcaggcagtgcttccgcatcaacgccaaggacattggtttcatcaagtaccgttgaagaggccactgtgctgctgtggagaacttcctttttcttaccccccctcctgtgggagggggcctaatttatgccctttacctttttgttcacaacttgagactcatggtgttaactcgacttggtgaaagttttaatcgctactttgggcttgtttggaccacctttaatcagaaaaattgaaatttttctcccacccaacataattggttgcaaccaccgtcgatggtgagctgccccctacatccccggagcagtagtgtgcccgtaactgtcgtttaagcaggcttgcggggccggcgcgggtgctgggnttgttgaagccaccgcagtccgcccttagg

SEQ ID NO: 58930 - protein, 56 aa, Zea mays
  misc_feature: Ceres CLONE 1513608
  misc_feature (3)..(56): Pfam Name: Ribosomal_S14 Pfam Description: Ribosomal protein S14p/S29e
MGHSNVWNSHPKNYGPGSRVCRVCANPHGLIRKYGLMCCRQCFRINAKDIGFIKYR

SEQ ID NO: 58931 - DNA, 661 bp, Zea mays
  misc_feature: Ceres CLONE 1513619
  misc_feature: Encodes the peptide sequence at SEQ ID NO. 58932
aaagctggagctccccgcggtggcggccgctctagaactagtggatcccccgggctgcaggaattcgtctcacccctagaaaaactcgagcctgacccttacgccttcgctcgcgccgccgccgccgccgccgctacgccccgcacctcgcttcatttcgtgtcgccaagatgacgaagcgcactaagaaggcaggaattgttggcaaatatggaaccaggtatggtgctagcttgcgtaagcaaatcaagaagatggaggtatctcagcattccaagtacttttgcgagttctgtgggaagtttgctgtgaagaggaaagcagttggaatttgggggtgcaaggactgtgggaaggtgaaggctggtggtgcttacaccatgaacactgctagtgcggtcaccgtcaggagcacgatccgccgcctgagggagcagactgaagcatgatatagctctttatattattggggtttcctgtagttgctcttgtcaggcatgttgtgggggccttatctagtggaaatgtgggatcactgtactggctgttttgccaagacaatgctcctttatattggtttatgcctcaagatctcaaaattgtgttggcaaaatttgcccctcggttaccgttctgaaactgacaaatgaaattggatcct

SEQ ID NO: 58932 - protein, 92 aa, Zea mays; identical to SEQ ID NO: 7812
  misc_feature: Ceres CLONE 1513619
  misc_feature (2)..(91): Pfam Name: Ribosomal_L37ae Pfam Description: Ribosomal L37ae protein family

SEQ ID NO: 58933 - DNA, 615 bp, Zea mays
  misc_feature: Ceres CLONE 1513621
  misc_feature: Encodes the peptide sequence at SEQ ID NO. 58934
atagctggagctccccgcggtggcggccgctctagaactagtggatcccccgggctgcaggaattcgtctcacccctagaaaaactcgagcctgacccttacgccttcgctcgcgccgccgccgccgccgccgctacgccccgcacctcgcttcatttcgtgtcgccaagatgacgaagcgcactaagaaggcaggaattgttggcaaatatggaaccaggtatggtgctagcttgcgtaagcaaatcaagaagatggaggtatctcagcattccaagtacttttgcgagttctgtgggaagtttgctgtgaagaggaaagcagttggaatttgggggtgcaaggactgtgggaaggtgaatgctggcggtgcttacagatgagcactgcttatgcggtcaccgtcaggacccccatcccccccctgagggagcagactgaagcatggatatagcctcttatattattggggtttcctggaagttgctcctggccacgctgttgcggggggcccttatctagggggaaatgtcggaatccccgctcccgccccggtcttgcccaagacaaggcgcccctatattttgggggttatcgccccacggaccccccaac

SEQ ID NO: 58934 - protein, 70 aa, Zea mays
  misc_feature: Ceres CLONE 1513621
  misc_feature (2)..(71): Pfam Name: Ribosomal_L37ae Pfam Description: Ribosomal L37ae protein family
MTKRTKKAGIVGKYGTRYGASLRKQIKKMEVSQHSKYFCEFCGKFAVKRKAVGIWGCKDCGKVNAGGAYR

SEQ ID NO: 58935 - DNA, 655 bp, Zea mays
  misc_feature: Ceres CLONE 1513627
  misc_feature: Encodes the peptide sequence at SEQ ID NO. 58936
agtggatcccccgggctgcaggaattcgtctcacccctagaaaaacactcgtctcatctcttccatacgaccataccctacctccaaattcccaattctcaacctctcctccgagttcgagtgaccatgtcggggcgcggaaagggcgggaaggggctgggcaagggcggcgcgaagcgtcaccgcaaggtcctccgcgacaacatccagggcgttacgaagccggcgatccggaggctggcgagaaggggtggcgtgaagcgcatctcggggctcatctacgaggagacccgcggcgtgctcaagatcttcctcgagaacgtcattcgcgacgctgtcacctacacggagcacgtccgccgcaagacccccaccgcaatgcacgtcgtctacacgctcaagcggcaggtccgcaccctctacggattttggcggctgaagggtcaggggggtcccccagctgcctgacggtacgttgcacaaacccctgggtccgaggcccccaaaatggaaagaaggcgagagttctatcttgcccatagagccttaatttccataagacttataccctcctaaaactcctagtgccctttggtccaccgatagaaccctcaccaactttggaaccggcaatttccctatggatcatgaaaac

SEQ ID NO: 58936 - protein, 113 aa, Zea mays
  misc_feature: Ceres CLONE 1513627
  misc_feature (25)..(94): Pfam Name: Histone Pfam Description: Core histone H2A/H2B/H3/H4
MSGRGKGGKGLGKGGAKRHRKVLRDNIQGVTKPAIRRLARRGGVKRISGLIYEETRGVLKIFLENVIRDAVTYTEHVRRKTPTAMHVVYTLKRQVRTLYGFWRLKGQGGPPAA

SEQ ID NO: 58937 - DNA, 738 bp, Zea mays
  misc_feature: Ceres CLONE 1513633
  misc_feature: Translation starting site: 171
  misc_feature (1)..(1): n is a, c, t, g, unknown, or other
  misc_feature (88)..(88): n is a, c, t, g, unknown, or other
  misc_feature (111)..(111): n is a, c, t, g, unknown, or other
  misc_feature (193)..(193): n is a, c, t, g, unknown, or other
  misc_feature (242)..(242): n is a, c, t, g, unknown, or other
  misc_feature (254)..(254): n is a, c, t, g, unknown, or other
  misc_feature (406)..(406): n is a, c, t, g, unknown, or other
  misc_feature (407)..(407): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (431)..(431): n is a, c, t, g, unknown, or other
  misc_feature (463)..(463): n is a, c, t, g, unknown, or other
  misc_feature (464)..(464): n is a, c, t, g, unknown, or other
nagccgctggagctccccgcggtggcggccgctctagaactagtggatcccccgggctgcaggaattcgtctcacccctagaaaaaantcacaattcacagcgctcaagtntctcgcgcccacagccaaatttttctccactcaatcgcggcataagctgcactgcagccatggacgccagcggagccggtancaaggcgaagaagggggcggctgggcgcaaggctggcggccccagaaanaaatcggtgtcncggtccctcaaggccgggctgcaattccccgtcgggccggatcgcgggcgacggaaagaaggggcggtacccccattttctgggcacccggcgcccccgtctaaactcgcctttttttttccccccccccccgggggtaaagaaaagggggnntnnnnnnnnnaaannnnnnnaaantatttttataaaaaaaaaaacaaacaaatacnncaaaattttgggggggggggggatatctaacagaatcatttaaacttttgggaaaaggcgttgaacggtcggggccacattgaacccccacgggggggggaacacgtccgaactataaacaccggggtcccccccccccccaaaaggcgacgccaaaaaagacctggcggagcccggccgcaggcagggagagcacaactaccgccactaaacggcacctcagaatcaccaagcacgccctaagcgggcgcgtcgccctaataaatagaccccg

SEQ ID NO: 58938 - DNA, 658 bp, Zea mays
  misc_feature: Ceres CLONE 1513635
  misc_feature: Encodes the peptide sequence at SEQ ID NO. 58939
  misc_feature (658)..(658): n is a, c, t, g, unknown, or other
aagctggagctccccgcggtggcggccgctctagaactagtggatcccccgggctgcaggaattcgtctcacccctagaaaaagccatcagaatcagaccaccacacgcccgaggcccgactgctagcgcctgagcccaagacccatggccatggccgccgccaccgtcgcagcgtcactgcccgtggcgcaagggctcaggaagcccctctgcgccggcagcaacgcgccgtcgctccgggccgtcgcgggcgcgccccgtcgtctgtcggccaggaccaggatggccgtcgtccgggcgtccgcacaaaagcagcactcggccaaggagtgggcggccgcagctgccgtggcagcagcgctagtgctgcccgaggtcgcagaggccgcaccggagatctccccgtcgctcaagaacttcctcctcaacatcgtctccggtggggtcgtgctcgtcgccatcgtcggcgccgtcgacgccgtctctaacttcgatcccgtcaggcggggttgagctgcatgcgacattgtgcgtcgccgtattgtacctacgtactgagatctctccccccgtgtgcttcccaatgaagacagtgtctaatgcgtgaatgtgtaaatttcatttcatgccatctgtatgcatgacacggattcaacn

SEQ ID NO: 58939 - protein, 122 aa, Zea mays
  misc_feature: Ceres CLONE 1513635
MAMAAATVAASLPVAQGLRKPLCAGSNAPSLRAVAGAPRRLSARTRMAVVRASAQKQHSAKEWAAAAAVAAALVLPEVAEAAPEISPSLKNFLLNIVSGGVVLVAIVGAVDAVSNFDPVRRG

SEQ ID NO: 58940 - DNA, 609 bp, Zea mays
  misc_feature: Ceres CLONE 1513636
  misc_feature: Encodes the peptide sequence at SEQ ID NO. 58941
atagctggagctccccgcggtggcggccgctctagaactagtggatcccccgggctgcaggaattcgtctcacccctagaaaaaacgcacctgctccattacccgtctgccgtcggcataacataatcgtcgtcgcgtgcagtccccattcccttttccagtggtctgttgctcgcgcttcgtccagcttccccggaagaggtagcacggcaagggcagaggatgagtgaccccaagtacgcctacccctaccccgcgcaaggttactaccaggggccgtaccagggcccgccggtgatggcgccgccgcagtacgccgcgccgccgcccagaagggagccgagcttcctggaaggctgcctggccgcgctgtgctgctgctgcttgatcgacgagtgctgctgcgacccgtcatcatcttcgtcagctagactagacgaagaagaacctattggtatatataaatagggatggtatccccgttggactccttagctttatttccctggcaaccccttttaaaagccccaaaaaaggaatcctgtatatctccgggtccaaaattggggggggggggttttccccgggcccaaagggggaaattgggcc

SEQ ID NO: 58941 - protein, 81 aa, Zea mays
  misc_feature: Ceres CLONE 1513636
MSDPKYAYPYPAQGYYQGPYQGPPVMAPPQYAAPPPRREPSFLEGCLAALCCCCLIDECCCDPSSSSSARLDEEEPIGIYK

SEQ ID NO: 58942 - DNA, 663 bp, Zea mays
  misc_feature: Ceres CLONE 1513639
  misc_feature: Encodes the peptide sequence at SEQ ID NO. 58943
  misc_feature (409)..(409): n is a, c, t, g, unknown, or other
acagctggagctccccgcggtggcggccgctctagaactagtggatcccccgggctgcaggaattcgtctcacccctagaaaaaaattccgtctcgttctgcagtgattccacaccgcaggtgggcagccatgatggcgtgcgccctcgccgtcgcctggcctgcagcgtctctggcgccatccggcaagaggaacctctccggcggccgtcccccatggctgccgtctcccagaccttcaggcagcagaagggcgtcactgctgctgccccgccggcgctcgcagaagacggcgttcgtggtgggtggtgccgcgagcttttgcacggcctcgctgaagcgatcgccgagaatgcgaggccacgcacaacaggtttgtgcagcgcggaggagacgggcggacatccantccgacacgtatgtgctgatggaacccggcatggaccaggcctttgtgtccagggaagaccctgaagaaaggctcaagggctggctcaaaaactgggccgagggacaccctgcctccagaccttggccaaagttcgggccggtcgaacaaggcccgtctccgtacctcggacaagatccgtgtggcaaagcgccaataacggacgggaaaaacctttgggtcccggtgggagggggggaccaaattccaaaacg

SEQ ID NO: 58943 - protein, 177 aa, Zea mays
  misc_feature: Ceres CLONE 1513639
  misc_feature (93)..(93): Xaa is any aa, unknown, or other
MMACALAVAWPAASLAPSGKRNLSGGRPPWLPSPRPSGSRRASLLLPRRRSQKTAFVVGGAASFCTASLKRSPRMRGHAQQVCAARRRRADIXSDTYVLMEPGMDQAFVSREDPEERLKGWLKNWAEGHPASRPWPKFGPVEQGPSPYLGQDPCGKAPITDGKNLWVPVGGGDQIPK

SEQ ID NO: 58944 - DNA, 740 bp, Zea mays
  misc_feature: Ceres CLONE 1513640
  misc_feature: Encodes the peptide sequence at SEQ ID NO. 58945
cggcgccacggcggcgacgagaagtggcgagccccgagagcgggtttagttagaggctacgggcggtcgggcgcggcggcggcggcggccatgagcagcgggagcgagagcactaccgccagcaggtggcccgagctggccacgctgcgcgcgctggcgcgcgacgccgcggagcagcttcggctgccgcgggccggcacgtcggcgtcggcgtcgtcgccgtggcgcgggcgcgaggaccacctccacggccacggcaagacggccaaggtgatgcacctgctgctctggggacccaagtgaagcggcgagaggccaccgtaccgccgggctctcccgctggcgttgctcgttttgctctgcctgcaatccgccccgcacggactgtactgtacctatatatacacctacatactacgacgtgcacctgtactacgacgtgctgctgtaccatactaaatactagtgcgctgctgctcccttgccttcttgcttgcaccagccactccgcttttttgctcgaacgatcgactgctcgtgtcgcgtcgggccacggccggtcgtcagtttgggtgtgtccactccactgtaaagctccttttttgggtactccctgcatgccaaagttagcggacgtgtactaggtgtggttcggagcagcaggttgtattacttaccaccccctctgtgatgtaagaacgcgtgctgaaattatcagtcgacaaaaaaaaaaaaaaaaa

SEQ ID NO: 58945 - protein, 70 aa, Zea mays; identical to SEQ ID NO: 55415
  misc_feature: Ceres CLONE 1513640

SEQ ID NO: 58946 - DNA, 639 bp, Zea mays
  misc_feature: Ceres CLONE 1513648
  misc_feature: Translation starting site: 486
  misc_feature: SWISSPROT Homolog: EC 5.2.1.8 Peptidylprolyl isomerase
aagctggactccccgcggtggcggccgctctagaactagtggatcccccgggctgcaggaattcgtctcacccctagaaaaagtgctctctcagaggtgggttggcttctcctccccctccggatagagctcccgttcgtggaggctctccggggtgcagtttcagagggtgaaggaataagtatggcgacgtcccgatgttaactgccgccgctcctgccgtggcctcacctggagaacagacgacaactgcctccacaacgccttctgcacctacagataggtcctcgatccccagatcatcctcgatcaggagacgcagaaggcccgaggtttccgcttcttcaccttctccactgaggaggcgatgcggaacgccatctagggcataaacagaaaagagctggacagccgcaaatcaccgtcaacgaggcccagtcccgcggcggccgtagaggcgacttgcagggggtacagtgctggccatggatgctgctgccaccgcgtgggcaggcgccgtgatggcggcacctgctacggcggtggcggccgcagataccgtgacactcggcagctacagtggctggtggcgtcggctactggcagtggcaactgtcggacgcagctacggctactccg

SEQ ID NO: 58947 - DNA, 822 bp, Zea mays
  misc_feature: Ceres CLONE 1513653
  misc_feature (1)..(1): n is a, c, t, g, unknown, or other
  misc_feature (21)..(21): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (350)..(350): n is a, c, t, g, unknown, or other
  misc_feature (461)..(461): n is a, c, t, g, unknown, or other
  misc_feature (664)..(664): n is a, c, t, g, unknown, or other
  misc_feature (822)..(822): n is a, c, t, g, unknown, or other
ntttttttttttttttattcntcaacgcggggtctannntnnnnntcttnnnnnaatccctaggctccccgcggtggcggccgctctatatacttttggatcccccgggctgcaggaattcttctcacccctagaaaaaaaccaccgacagacaacatggccgcctccgcctccaccgtctccggactcgccggcgcctccctggacagccgttcggcgttctctcaccagcttcacacggggcagcgcgggtgtccgcgacgaaccccctgatgaccaggaacttggagagtaatgtcagggactacctgcctgacgactccccgggaccggctgcggacggacctgancgccatcagcttggggggcaattaacttgctgggttgccgcctgcgtcctgggcgatcacgggtaacatgtttttgggggatcctttctcctagaggggatggggaaatgntattgcttcatatatagcggcacgtcggggggtggagtggtccccatgtatgagcggcggccttagtagggccgcgggacccctccatccacgtttgcctcggtagttttaccccgttatgtatttaacttgaaaaccgcttgttgtcgaggattcgctgagcgatttataccgatgaaagctggaatgtatcttcatacttnttgtacagccgcaataggacgattattgataggcctttcactctccccattgtaataacctattgctctaagaaccccggcgctcccgctctcacctcattagtcacctttccctacgatcccgctgtgggttaacaaccgtgagtagctgagtcggn

SEQ ID NO: 58948 - DNA, 580 bp, Zea mays
  misc_feature: Ceres CLONE 1513660
  misc_feature: Encodes the peptide sequence at SEQ ID NO. 58949
  misc_feature (248)..(248): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (453)..(453): n is a, c, t, g, unknown, or other
  misc_feature (454)..(454): n is a, c, t, g, unknown, or other
  misc_feature (455)..(455): n is a, c, t, g, unknown, or other
  misc_feature (456)..(456): n is a, c, t, g, unknown, or other
  misc_feature (457)..(457): n is a, c, t, g, unknown, or other
  misc_feature (458)..(458): n is a, c, t, g, unknown, or other
  misc_feature (516)..(516): n is a, c, t, g, unknown, or other
  misc_feature (524)..(524): n is a, c, t, g, unknown, or other
atagctggagctccccgcggtggcggccgctctagaactagtggatcccccgggctgcaggaattcgtctcacccctagaaaaaagcggcctcaccaagtcaccatcaccacccgcaccacacacgagcacacgcgacgactggacaagggcgaaggaggtagccaatccggcggcgatgggcggcggcggcgcacatggcggcaccacctacaagggctacaccatcccgcacaatcagcgctggcnacacccgtcgccggcaaggggcctctgcgcccgtgatggtggttcctggggttttcctacagggggctaaacccagggatggggggccttcccccccccttggggggttttggggcggttcaaacccccttttttggggggggggggggggggagagaaaaannnatatataatttaaaaaacaccccccccccccccccccccnnnnnnttttttgttttttttttttttttctccccaccccccccgcgaagaaaaaaaaagaaanaaaaaagnctttttcttcctccccccccacaaaaaaatttttttctcccttggggggggggggg

SEQ ID NO: 58949 - protein, 46 aa, Zea mays
  misc_feature: Ceres CLONE 1513660
  misc_feature (24)..(24): Xaa is any aa, unknown, or other
MGGGGAHGGTTYKGYTIPHNQRWXHPSPARGLCARDGGSWGFPTGG

SEQ ID NO: 58950 - DNA, 636 bp, Zea mays
  misc_feature: Ceres CLONE 1513666
  misc_feature: Translation starting site: 135
tctgaactagtggatcccccgggctgcaggaattcgtctcacccctagaaaaaaacaacagcgaacacatctcctcgcatttcttcccatccgatccccccttcgcaaccaaaaccccaactcgccccgcatcgatggcgcccaaggccgagaagaaacccgcggcgaagaagccggcggaggaggagcccgcggccgagaaggcgcccgccgggaagaagccgaaggcggagaagcgggtccccgctggcaagtccgctgccaaggaaggcggcgagggcaagaggggcaagaagaagggcaagaagagcgtggagacctacaagatctacatcttcaaggtgctgaagcaggtgcacccggacattggcatctcctccaaggccatgtccatcatgaactcccttcttaacgatatcttcgagaagctcgctgctgaggccgccaagctcgcgcgctataacaagaagcctaccattcacctcccgtgagatcccgacctccgtgcgcctcggcccttcccggggagctctcccaagccgcccgtctcccgagggcacccaaggccgtccaccaagttccccctcggcgctaaggagggacggcgcgccctttgcaggaatccgcccccggggg

SEQ ID NO: 58951 - DNA, 648 bp, Zea mays
  misc_feature: Ceres CLONE 1513668
  misc_feature: Encodes the peptide sequence at SEQ ID NO. 58952
atagctggagctccccgcggtggcggccgctctagaactagtggatcccccgggctgcaggaattcgtctcacccctagaaaaaaacccttagatgcgccgccgactccgacaacatcatcttcatacgcacgagctcgcgagaatcaaccgggcctaagatgttggtttgtcaagacctcctatctgacgacgagatcctgtcgaattcatgtaaccttctcagagctccagaactgcgtcctgaggaaggccgaggtaaagcgggtcccccaaggtcccgctaatgtagaccttgggacctatccttcctcctagaggagtgagaataaccgggttcactacacacccctgaacgtggctgatattgttcacacatcccgtctacaccgagcaacctccttttgactcatcccatttaactctgtacactcagaaaattcatcatcaatctcaccgccgtgtcggagcctaatgaagccgatgactacccaaagggtgtcgagggatgcaccaagtttctccttagcgatctgaatgacctgcaacttcttgccttctagagcatgatcgactaagcgtccgtggtattcgcctactacaaggagggcgccactagtccgacattcctctgatctctctcatggtc

SEQ ID NO: 58952 - protein, 41 aa, Zea mays
  misc_feature: Ceres CLONE 1513668
MLVCQDLLSDDEILSNSCNLLRAPELRPEEGRGKAGPPRSR

SEQ ID NO: 58953 - DNA, 659 bp, Zea mays
  misc_feature: Ceres CLONE 1513680
aagctggagctccccgcggtggcggccgctctagaactagtggatcccccgggctgcaggaattcgtctcacccctagaaaaaaacgagcgctcgctccgtgttttgtgaacatcaatcaaacccctgccgtgtgtctgtgcaagttggtggatctcgccgcagcatctccaccatgttggaccatatcatggacaatcttatcggtgagtttgacgaggccttctacctcttcgaccaggaccgccatggctggaacgactccctatatgtaggagcggtcatggcttgctggggctaaagctgttccgagactgatctgcgctgcatcgtcgctgtaccagactgctatggcaactgcttgatcgatgtgcgacagtttcagagccgtatatgctcgcatgatgagagagcccgactctagacgaatacctcactgaactgtttgccgtgtatgactgcgatagagacggcttcatgtcagactccgagctccgccatgtcatgagagatcttgttgatgagctatatcgagaggcgccgactagatgatccgtgaggatgatggcgatggcgatggccgaattgcttcggaggtttttgtgacggctgaatgctcaaataggcccgaaaaactgggttcattggacaaagcattgg

SEQ ID NO: 58954 - DNA, 636 bp, Zea mays
  misc_feature: Ceres CLONE 1513685
  misc_feature: Encodes the peptide sequence at SEQ ID NO. 58955
ctccccgcggtggcggccgctctagaactagtggatcccccgggctgcaggaattcgtctcacccctagaaaaaatacggcataccacactagagccgccgccgccgacgtttacatcgcaccataccctagccctcgtcagcggcggcttccagctcatcctgccatgacattcaagcggaggaatggcggacgcaacaagtacgggagcggccacgtcaagtacatcagctgctccaactgcgccaaatgctaccccaaggataaggctatcaaacggctcttggtgaggaacattgttgagcaggctgccgtgagatatatgcaggaggcctgtatacatgtatcggatatgttctacccaaattgtatgcaaaagttcatcactgtgtactcacgtgcaatccatgcgcacattgtccgggtccgctctcgtgagaacaggaggaaccgtgagcccccacagcgcttcacacgccgagatgatggcccaaggcctggtcatggcccgccgcgcccatgcggtgcagctcctgcagctgcagctgctgctgctcctcgtacctaaattatggaattacgttctgcgcttaattctgcgaaacattacctgtcttgacaaaccattgtgactgc

SEQ ID NO: 58955 - protein, 133 aa, Zea mays
  misc_feature: Ceres CLONE 1513685
  misc_feature (1)..(118): Pfam Name: Ribosomal_S26e Pfam Description: Ribosomal protein S26e
MTFKRRNGGRNKYGSGHVKYISCSNCAKCYPKDKAIKRLLVRNIVEQAAVRYMQEACIHVSDMFYPNCMQKFITVYSRAIHAHIVRVRSRENRRNREPPQRFTRRDDGPRPGHGPPRPCGAAPAAAAAAAPRT

SEQ ID NO: 58956 - DNA, 772 bp, Zea mays
  misc_feature: Ceres CLONE 1513692
  misc_feature: Encodes the peptide sequence at SEQ ID NO. 58957
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (13)..(13): n is a, c, t, g, unknown, or other
  misc_feature (16)..(16): n is a, c, t, g, unknown, or other
  misc_feature (17)..(17): n is a, c, t, g, unknown, or other
  misc_feature (19)..(19): n is a, c, t, g, unknown, or other
  misc_feature (21)..(21): n is a, c, t, g, unknown, or other
  misc_feature (22)..(22): n is a, c, t, g, unknown, or other
  misc_feature (35)..(35): n is a, c, t, g, unknown, or other
  misc_feature (36)..(36): n is a, c, t, g, unknown, or other
  misc_feature (40)..(40): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (703)..(703): n is a, c, t, g, unknown, or other
ttttttttnnntnttnntntnnttttttttttttnntttngtaccatcnnncttaaaagctggaactccccgcggtggcggccgctctagaactagtggatcccccgggctgcaggaattcgtctcacccctagaaaaaaaccccaccgcagcacagcgccggcaaccgccgccatcgatcgatcgcccggaaactgacctctaccgatgtctggagccggcgaggaggataagaagcccgcggagggcggcgcccacatcaaccttaaggtcaagggacaggatggcaatgaggtgttctttcgcataaagaggtccacccagctgaagaagctgatgaacgcctattgcgaccgccagtctgtggacatgaatgccattgcattcctgtttgatggccgcaggcttcgcggcgagcagacccctgatgagctggagatggaggacggcgaccagatcgacgccatgcttcaccagaccggaggcagcgttcctagcaccacctaaaagcagcagctgcggagcctcgttttgctctccgcccctgcgtagtactaaaccaaaagggaaaaaagccttttttaaggaaactttgtgaatgctcctgggctcccttgtggccattgcttgagggacaatcccttagcccctttattttagaggggaaatgggttttgggaaaccttttggttccctgcgccgncaggaaaaacaaaaataaaaaacccccgaagcaccccccccctaggggtcaccccccaatatttcccgg

SEQ ID NO: 58957 - protein, 99 aa, Zea mays
  misc_feature: Ceres CLONE 1513692
  misc_feature (21)..(91): Pfam Name: ubiquitin Pfam Description: Ubiquitin family
MSGAGEEDKKPAEGGAHINLKVKGQDGNEVFFRIKRSTQLKKLMNAYCDRQSVDMNAIAFLFDGRRLRGEQTPDELEMEDGDQIDAMLHQTGGSVPSTT

SEQ ID NO: 58958 - DNA, 517 bp, Zea mays
  misc_feature: Ceres CLONE 1513697
  misc_feature: Encodes the peptide sequence at SEQ ID NO. 58959
  misc_feature (190)..(190): n is a, c, t, g, unknown, or other
catagctggagctccccgcggtggcggccgctctagaactagtggatcccccgggctgcaggaattcgtctcacccctagaaaaaaactgcccttttcggagatctcgccgcctccgccgtcgaacttccgtcgcccccctatcccgcgtccgggcttacccgatggcacggctgcactgggcttgaggnccgtcctgccgctggggatcatcggcggcatgctctgcatcatgggcaacgcccagtatttcatccacaaggccgcgcacggcaggccgagcacatcgggaacgaatatgtggacgtcgccatggagcgccgcgacaagaagctcgtggaacaatcctccgcaactagggtattgatccaacctcaaacttttctggaaggtgaacaaacctccttcaaaaacccaaaaaatactgcgcctttttggttccccggaaaaattgggaacccaaaaacttggtttggtttgccttttaaaaaatacaaacagttccgaaaaaaaaactc

SEQ ID NO: 58959 - protein, 48 aa, Zea mays
  misc_feature: Ceres CLONE 1513697
MLCIMGNAQYFIHKAAHGRPSTSGTNMWTSPWSAATRSSWNNPPQLGY

SEQ ID NO: 58960 - DNA, 556 bp, Zea mays
  misc_feature: Ceres CLONE 1513704
  misc_feature (448)..(448): n is a, c, t, g, unknown, or other
  misc_feature (449)..(449): n is a, c, t, g, unknown, or other
  misc_feature (450)..(450): n is a, c, t, g, unknown, or other
  misc_feature (451)..(451): n is a, c, t, g, unknown, or other
  misc_feature (452)..(452): n is a, c, t, g, unknown, or other
ggagctcaccgcggtggcggccgctctagaactagtggatcccccgggctgcaggaattcgtctcacccctagaaaaatccaaacccaacgcggcaaacggcttcctcaccccccctcccctcgccatggccgtccccacctccacctcctccccgctacccctcctcttcctccatcgctgcaccgcaaactctagcccctcggttctctccttcccgtcctccctccgacggagcgtcccctccgggtccccggggcccgcgggcccgaccccccccccgcaaaaagaaactcccttttttttaaagaaggggaatccccaaaagggccccctgaaaggggggaagagaaaatttagaaaaatttttccccccccccccccaccccttccctattcattttgggcccacccccactacggaacgacggaggggacggggggggggnnnnnaggcggggggggggggggttacgaaaaaataacacaaaaaaaaaaaaacacgcggccgtgccgttcttcgcggcgggagaacctcaacctccaaaccacccccc

SEQ ID NO: 58961 - DNA, 621 bp, Zea mays
  misc_feature: Ceres CLONE 1513708
  misc_feature: Encodes the peptide sequence at SEQ ID NO. 58962
  misc_feature (448)..(448): n is a, c, t, g, unknown, or other
  misc_feature (472)..(472): n is a, c, t, g, unknown, or other
ggagctccccgcggtggcggccgctctagaactagtggatcccccgggctgcaggaattcgtctcacccctagaaaaaacggagaaaaagaaagaggagctcggacaaggcagcgccatcgttcggtttccttgctgaattcccgatcgctcgcccgctcgaaaagaaagaagctagcttttagcatggcgtctctggcgttcggcagcaccgtagcggcggccgtggcggcgacctcggggaggacgcggccggcgcgccggtccgtgctggtcgtgccgcccgctgccagcaggggcggcccggcgccggccaaggaggagaagggcctcggcgagaccatcttcggcttcatcttcaagaagaccagctggtggagacggacccgctcctcacaaggtcggcgccgcgccggccgccgcctcccgcgccaagacgaccgccggcnagaaggctgccggcggcgacgacngcggcagcggcgggggggttcaacttcgggcgggctcggcgggctccttcgccaagaaaaaccacctgaacgtggcctttgtttaagggattggccaaccccaaagctggggatttggctttttgagggggaaaaaggtttgccccatt

SEQ ID NO: 58962 - protein, 145 aa, Zea mays
  misc_feature: Ceres CLONE 1513708
  misc_feature (88)..(88): Xaa is any aa, unknown, or other
  misc_feature (96)..(96): Xaa is any aa, unknown, or other
MASLAFGSTVAAAVAATSGRTRPARRSVLVVPPAASRGGPAPAKEEKGLGETIFGFIFKKTSWWRRTRSSQGRRRAGRRLPRQDDRRXEGCRRRRXRQRRGGSTSGGLGGLLRQEKPPERGLCLRDWPTPKLGIWLFEGEKGLPH

SEQ ID NO: 58963 - DNA, 867 bp, Zea mays
  misc_feature: Ceres CLONE 1513712
  misc_feature: Encodes the peptide sequence at SEQ ID NO. 58964
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (33)..(33): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (867)..(867): n is a, c, t, g, unknown, or other
ttttttttttttnnnnnnnntttttattttttnttnnnatannnnnnatttttataaaataatcgggagctccaccgcggtggcggccgctctagaatagtggatcccccgggctgcaggaattcgtctcacccctagaaaaacacgtcgaggtactgcagaaaaaagaaccgcaaaatccgatccaatttttcgtaatcgattagttaacatggtggttaaccgtattatgaaagacggaaaaaaatcattggcttatcaaattctctatcgagccgtgaaaaagattccacagaagacagaaacaaatccactattggttttacgtcaagcaatacgtagaagtactccccatataggaggtaaaaacaagacgtaataaaaaaaggatcgaacgcggaaaaggtccgattggaaataggaatcctaaccaaggaaaaaaccccttggccatttcccgttgggtttatttaaaaaacaatcccccaaaaaggccgtcccggggtccgaaaaatattgggcttttttcacaaaatttaaaagtttcccgaaaattaaggtaagaaaagcgcgtgcccaaaaaagggaaaatggggggggggggcccccataaccccaaaaaaagaggaaaagcgcccctccccctaaaaaatggggcgccaaaaggccaaaaaaaaaaagactcctttttggcccaatatttttcccggtttaaaaccccccggagaaaaagaagaacctttaggggtgttgggtgaaacacaccaggggggttccccctataacaattcccgcgaacgggggaaaaaagaaaatctccatttagaaaggggggaaatcccgaaacaaaaataattattttttttn

SEQ ID NO: 58964 - protein, 55 aa, Zea mays
  misc_feature: Ceres CLONE 1513712
MVVNRIMKDGKKSLAYQILYRAVKKIPQKTETNPLLVLRQAIRRSTPHIGGKNKT

SEQ ID NO: 58965 - DNA, 498 bp, Zea mays
  misc_feature: Ceres CLONE 1513716
  misc_feature (258)..(258): n is a, c, t, g, unknown, or other
  misc_feature (466)..(466): n is a, c, t, g, unknown, or other
  misc_feature (474)..(474): n is a, c, t, g, unknown, or other
aagctggagctccaccgcggtggcggccgctctagaactagtggatcccccgggctgcaggaattcgtctcacccctagaaaaaaaacccatcagcttctcccgctcgtcctcctcctctcctcctggacagcagagcacggcacaacacaccgagaaagaacaagcagccgccaccggagctcagaaccaccatcagcagcagcagcacacccggtcaaccttccacacacgcgcgcacacacacatgagacgtcgncagcagagggcaacagcaagcgggatcggcggcggcggcgtcctccgccgtgagcttcgaggactacctgccggggttgattgggcggaaccggggcttgggggccgaaaaggaaacgggggcctgatgcggaagctggcgagcggggtcccggctgctgatggaaccgggccccccgggctcatccacctttcgaaaagagccctcnccggcccnccaccgcggccgcttgctgggccc

SEQ ID NO: 58966 - DNA, 663 bp, Zea mays
  misc_feature: Ceres CLONE 1513717
  misc_feature: Encodes the peptide sequence at SEQ ID NO. 58967
  misc_feature (306)..(306): n is a, c, t, g, unknown, or other
  misc_feature (389)..(389): n is a, c, t, g, unknown, or other
  misc_feature (393)..(393): n is a, c, t, g, unknown, or other
  misc_feature (394)..(394): n is a, c, t, g, unknown, or other
  misc_feature (464)..(464): n is a, c, t, g, unknown, or other
catgctggagctccccgcggtggcggccgctctagaactagtggatcccccgggctgcaggaattcgtctcacccctagaaaaagcaccgccatctctgctctgctctcgcaacgcaagcacacgcccggccgcctgccacagttgccatggcgaccatagccacgatggcgctgctgaagccccccgcctaggccgcggcgcggtctgcgccgtccaccaggaggggtagcgtctcgctgcgcgtccggacggggcaggccgccaagaaggctgcggtgtccgcgtccgcctcgtccacgatggngggcgccttcttcgcggcgctggagtcgacacccgacgctgcgctggcgtatttcttggcccccgcggacgggggaggggacnaccnncaccagctggtgttcgtcttgacgacacccgcccatcatgggggtgctgtacaacttcctgcagccggcnctgatccaggtgaaccgattggacagcatcccagccgtggcccctggcctgggcctactggcccccgtcgccggggatcgggtgcccctcccagaggcctacccccgccggtggggcagaccctcacagcatttttaccaccaccgcgggccgccaaacaaggccaataggacttcccgcgcgggtaaaacgtggggtg

SEQ ID NO: 58967 - protein, 77 aa, Zea mays
  misc_feature: Ceres CLONE 1513717
MGVLYNFLQPALIQVNRLDSIPAVAPGLGLLAPVAGDRVPLPEAYPRRWGRPSQHFYHHRGPPNKANRTSRAGKTWG

SEQ ID NO: 58968 - DNA, 699 bp, Zea mays
  misc_feature: Ceres CLONE 1513725
  misc_feature (376)..(376): n is a, c, t, g, unknown, or other
  misc_feature (377)..(377): n is a, c, t, g, unknown, or other
  misc_feature (378)..(378): n is a, c, t, g, unknown, or other
  misc_feature (380)..(380): n is a, c, t, g, unknown, or other
  misc_feature (381)..(381): n is a, c, t, g, unknown, or other
  misc_feature (382)..(382): n is a, c, t, g, unknown, or other
  misc_feature (383)..(383): n is a, c, t, g, unknown, or other
  misc_feature (384)..(384): n is a, c, t, g, unknown, or other
  misc_feature (387)..(387): n is a, c, t, g, unknown, or other
  misc_feature (388)..(388): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (393)..(393): n is a, c, t, g, unknown, or other
gggccggcgctctagaactagtggatcccccgggctgcaggaattcgtctcacccctagaaaaaaccaggcaccagcatagatctcgtgctcgccactattattctgcacagcaacgcatcagccttctggaaccatctcgccgccgccacaccacaatccacaacccgtcgaagcgaagcaagcaatggccggagtcggatcgaaggccctcgccgttgccgccgttctggcggccgtctccttctcggtggccgccgcggccgatgccccccgcgcccaggcccgtctcgccgcccgtgttgttttcttcacccttcgccgggggttctggaagatttttttttccccaacaacccggggaaagaaagggggannnannnnnatnnnnntntttttttttataaataaacaaaaaaaaaaaaacacccccacggggggggggggggctaaatttatttttttggtaacccccattccccccctctctcgccccagttgagcacttatttcggggggctgaaaaccctcccatcacccccctttttcttacacacaactggctgtttctcccagagcaccgcccggcgctttaccacaattccccactcatccactcgtacagtccctgtgcagaagtaacccccccgccccccaaatgaacaccttatatatccacgtgccaccctcctgccaaacc

SEQ ID NO: 58969 - DNA, 572 bp, Zea mays
  misc_feature: Ceres CLONE 1513728
cgcggtggcggccgctctagaactagtggatcccccgggctgcaggaattcgtctcacccctagaaaaaattctatattatatttaggtcgcagctacccgtgaatctcctattttgaaaaggtcactgcttttttatttcattctatattctatattatatttttgtaatattcagtctcgtttaattgctttcagacttaatgttagataattgtttacattttctacaattcagtctggactaattgctttgggactaatgttggagatatccatatgtatctgcgtctaagcatttttcatttgtatttatcatgttttgtcaatagggatacttgtttcttgtaagtctgttagcatgtttgaaccatagcaattggcggacgtgtgtaaaactgcagtatgatggataccactattcatcaaccgaaattatggcgcgcttcaatcgtggctacgctgatggggaactggatccgtttatgggggggcctttgaaacccggggggtggggaaaaaaaatgggggggaaaacccctttttgttttaaaaaaaaggggggcgttttta

SEQ ID NO: 58970 - DNA, 644 bp, Zea mays
  misc_feature: Ceres CLONE 1513732
  misc_feature: Encodes the peptide sequence at SEQ ID NO. 58971
  misc_feature (609)..(609): n is a, c, t, g, unknown, or other
ccgcggtggcggccgctctagaactagtggatcccccgggctgcaggaattcgtctcacccctagaaaaaagcggggcacagactgagaagccaatggcgctgtcccgctccctcgcgcgccccgcgcgcctcgccgtttccgccggcgcaggagccaggaagctacccgcagccagcctcgcattcccggcgaaatcgttcttcggggcgccgctggccgccaccgcggcctccgtcgcgtcaccgctcccgcgcaagacggccacctccaccacctcgctcgaggtcgtcacggcgggaaagaagggctacaagatgaagacgcacaacgcgtcggctagacggttccgggtgacggtcaggggcaagatcatgcggcggtgcttcggtccgcagcacttgctcgccaagaagatcacctagcgcaagaacaggctctcgaagatggtgcaagtcaaccagagtgactacaagcgtgttactggtgcactgcccgacctcagagtgaatagggaagcagactgagagctacgtggtcttcaaagatcgttaagtttcgttgcaccaaattgtaattctgtgcatcttgcactgtattgccttctcgnaatactgaggcatcgtttcgaagacagcgaagaca

SEQ ID NO: 58971 - protein, 109 aa, Zea mays
  misc_feature: Ceres CLONE 1513732
MALSRSLARPARLAVSAGAGARKLPAASLAFPAKSFFGAPLAATAASVASPLPRKTATSTTSLEVVTAGKKGYKMKTHNASARRFRVTVRGKIMRRCFGPQHLLAKKIT

SEQ ID NO: 58972 - DNA, 609 bp, Zea mays
  misc_feature: Ceres CLONE 1513733
  misc_feature: Encodes the peptide sequence at SEQ ID NO. 58973
  misc_feature (339)..(339): n is a, c, t, g, unknown, or other
  misc_feature (349)..(349): n is a, c, t, g, unknown, or other
  misc_feature (417)..(417): n is a, c, t, g, unknown, or other
  misc_feature (439)..(439): n is a, c, t, g, unknown, or other
  misc_feature (442)..(442): n is a, c, t, g, unknown, or other
  misc_feature (472)..(472): n is a, c, t, g, unknown, or other
  misc_feature (473)..(473): n is a, c, t, g, unknown, or other
  misc_feature (481)..(481): n is a, c, t, g, unknown, or other
  misc_feature (484)..(484): n is a, c, t, g, unknown, or other
  misc_feature (505)..(505): n is a, c, t, g, unknown, or other
  misc_feature (508)..(508): n is a, c, t, g, unknown, or other
  misc_feature (511)..(511): n is a, c, t, g, unknown, or other
  misc_feature (549)..(549): n is a, c, t, g, unknown, or other
ggcggccgctctagaactagtggatcccccgggctgcaggaattcgtctcacccctagaaaaagtgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggangaggcgatgncgaacgccatcgagggcatgaacgggcaggagctggggacggcgcacatcacccgtcacgaggcccantcccccgcgcgccgtgaaggcngcngcggtgggtacggtggtggccgtggaagcnngcgctacngcngtgggcggcgccctgatggcngcngcngctacggcggtggcgggcgcggctacggtgggcgcgcngctaccgtggtggttggcggcgcttacgcggggggaaccggggcggcgctacggaactcc

SEQ ID NO: 58973 - protein, 149 aa, Zea mays
  misc_feature: Ceres CLONE 1513733
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (59)..(59): Xaa is any aa, unknown, or other
  misc_feature (63)..(63): Xaa is any aa, unknown, or other
  misc_feature (85)..(85): Xaa is any aa, unknown, or other
  misc_feature (93)..(93): Xaa is any aa, unknown, or other
  misc_feature (94)..(94): Xaa is any aa, unknown, or other
  misc_feature (104)..(104): Xaa is any aa, unknown, or other
  misc_feature (107)..(107): Xaa is any aa, unknown, or other
  misc_feature (108)..(108): Xaa is any aa, unknown, or other
  misc_feature (115)..(115): Xaa is any aa, unknown, or other
  misc_feature (116)..(116): Xaa is any aa, unknown, or other
  misc_feature (117)..(117): Xaa is any aa, unknown, or other
MAASDVEYRCFVGGLAWATDDHSLHNAFSTYGEVLESKIILDRETQRSRGFGFVTFSTXEAMXNAIEGMNGQELGTAHITRHEAXSPARREGXXGGYGGGRGSXRYXXGRRPDGXXXYGGGGRGYGGRAATVVVGGAYAGGTGAALRNS

SEQ ID NO: 58974 - DNA, 609 bp, Zea mays
  misc_feature: Ceres CLONE 1513738
  misc_feature: Encodes the peptide sequence at SEQ ID NO. 58975
gctctagaactagtggatcccccgggctgcaggaattcgtctcacccctagaaaaacccagaaaacaaccttatcggcctatctatccttctatccccattcccatcccgagacaggagaaggcaaggatgctgctcctgagctcccccttcgtgtccgtgtcgccgccgccgccgccgctcagctcccatggcgctcgcccggggctgcggatcgaggcggccaggcagctgacgggccgggtggtgacgaccaaggcgaacaagactgtcggggtggaggtggtgcgcctggctccacagcccaagtacaagcgcccggagcccatcaagaacaagaaccaggcgcacgaccccgacaaccacttcacggtcgacgacgtcgacgagctccaaacctcccgtcccatctccaagacgaagcacttcctcgccatcccgctcccgccccgcgacagtcggcgcaagtctcagctcctaccgccgctacagtccgacgacgaccatgagccgtcctcacgagagtgattgattgtgattgattgctgcctgtctatggcttcgtcgtaagctcatctccatcacaggtgctgcctcccacttccaaatg

SEQ ID NO: 58975 - protein, 132 aa, Zea mays
  misc_feature: Ceres CLONE 1513738
  misc_feature (37)..(105): Pfam Name: Ribosomal_S17 Pfam Description: Ribosomal protein S17
MLLLSSPFVSVSPPPPPLSSHGARPGLRIEAARQLTGRVVTTKANKTVGVEVVRLAPQPKYKRPEPIKNKNQAHDPDNHFTVDDVDELQTSRPISKTKHFLAIPLPPRDSRRKSQLLPPLQSDDDHEPSSRE

SEQ ID NO: 58976 - DNA, 639 bp, Zea mays
  misc_feature: Ceres CLONE 1513742
  misc_feature: Encodes the peptide sequence at SEQ ID NO. 58977
  misc_feature (287)..(287): n is a, c, t, g, unknown, or other
  misc_feature (382)..(382): n is a, c, t, g, unknown, or other
tctgaactagtggatcccccgggctgcaggaattcgtctcacccctagaaaaaatcgcactcgcgtctctttcctattcgcgccgccgccgctgctgcaagcgccagctcgccgtcgtccgaatagtacactctaacgccgccatggggcgtatgcacagccgcgggaagggtatctcgtcgtcggcgctgccgtacaagaggacgcctcctacctggctgaagaccgccgcctccgacgtggaggagatgatcacaaaggcagcgaagaagggacagatgccgtcncaaatcggcgtcctgctccgtgaccagcacggtatcccccttgtcaagaccgcccccggggggggggggggggggcatcctcaaggcccatgggnctggcacccgaaatcccggaagacctgtaccttcctcttcgggagggggggggcaataaggaacccctttgagagggaaaggaaggccaaaaactcttaattccggctccctccttggcaaaagcaggatccccccccttggccgcaaataaaagggaccaaaaaactttccccccccggggaaataccaatccccccctgggggggcttttggggggcccagaccaggagacctccgctaggggccgtgggaaccc

SEQ ID NO: 58977 - protein, 112 aa, Zea mays
  misc_feature: Ceres CLONE 1513742
  misc_feature (1)..(60): Pfam Name: Ribosomal_S13_N Pfam Description: Ribosomal S13/S15 N-terminal domain
  misc_feature (80)..(80): Xaa is any aa, unknown, or other
MGRMHSRGKGISSSALPYKRTPPTWLKTAASDVEEMITKAAKKGQMPSQIGVLLRDQHGIPLVKTAPGGGGGGHPQGPWXWHPKSRKTCTFLFGRGGAIRNPFERERKAKNS

SEQ ID NO: 58978 - DNA, 622 bp, Zea mays
  misc_feature: Ceres CLONE 1513745
  misc_feature: Encodes the peptide sequence at SEQ ID NO. 58979
ggtggcggccgctctagaactagtggatcccccgggctgcaggaattcgtctcacccctagaaaaaacgcacctagggttttcgcgccgccgccgcagccgcaacaatgccgtcacacaagaccttccggatcatgaagaagctggcgaacaacatgcgcctgaaccgccccatcccctactggatccgcatgcgcactgacaataccatcgcgtactacgccaagcgcaggatctggctgccgcaccgagctcggcttctgagcgtcgggattgggcggctgctgcgtccgaaggctagggtctaagagctatcttctgttttatcattgtctctgtttctgtaagctagcaagtgatgctgtgatgcttttattaagattctgatgagtggtgacgttaagagaaaattggcaccactgtgttgtaccccaagattccttgcagcattgctatgctgagtaacgaaccctttatcttattatatatgccgtgttgcagtgattgtggtccagaatctgcacttcatgcgagacgctcgaggtacccaattcgccctattgtgagtcgtattacgcacgctcacttgaccgtcgtcttacaacatcgtgactggggagacc

SEQ ID NO: 58979 - protein, 66 aa, Zea mays
  misc_feature: Ceres CLONE 1513745
  misc_feature (9)..(54): Pfam Name: Ribosomal_L39 Pfam Description: Ribosomal L39 protein
MPSHKTFRIMKKLANNMRLNRPIPYWIRMRTDNTIAYYAKRRIWLPHRARLLSVGIGRLLRPKARV

SEQ ID NO: 58980 - DNA, 649 bp, Zea mays
  misc_feature: Ceres CLONE 1513749
  misc_feature: Encodes the peptide sequence at SEQ ID NO. 58981
aaagctggagctccccgcggtggcggccgctctagaactagtggatcccccgggctgcaggaattcgtctcacccctagaaaaaatcctactgtcacacacacacaaagaaaagacaagtggattaaacacccaacagctgctgcatcgtttgcctccattatgtttgctccaaggggtcaaatatccttccaagaagcaatctctaggtgccaagaccaaggcattcctatatcccacaagtatggaaaagaagatccttggattacaccaatttggggccttaaagttaaacagcaagtgcccgaaccaccttattataaaataaaccccgctggccattgccctcatgatgaggtccatgacgttataaactacttgctccgcgggtggctgaagaacctcaagactgaaggatcaacccacctgccgtttctagaaaaacgaacctatacgtaagcgtgtggcatccaggaagctggagtttgccacaaaaggatcaaggaactcagttagtgtgcgactctatggtaccaagattaccatatgaagccagataagatcattcttaaacacacctgctcacaatacacggatagtcttgagaaaatacatcctcaactccaataaatctcaatcttaaaaccttt

SEQ ID NO: 58981 - protein, 98 aa, Zea mays
  misc_feature: Ceres CLONE 1513749
MFAPRGQISFQEAISRCQDQGIPISHKYGKEDPWITPIWGLKVKQQVPEPPYYKINPAGHCPHDEVHDVINYLLRGWLKNLKTEGSTHLPFLEKRTYT

SEQ ID NO: 58982 - DNA, 634 bp, Zea mays
  misc_feature: Ceres CLONE 1513754
  misc_feature: Encodes the peptide sequence at SEQ ID NO. 58983
ctccccgcggtggcggccgctctagaactagtggatcccccgggctgcaggaattcgtctcacccctagaaaaaccctagaaaaagaataggatcgaaaaccctaatccgtctccctcctatcgcactcgcgtctctttcctattcgcgccgccgccgctgctgcaagcgccagctcgccgtcgtccgaatagtacactctaacgccgccatggggcgtatgcacagccgcgggaagggtatctcgtcgtcggcgctgccgtacaagaggacgcctcctacctggctgaagaccgccgcctccgacgtggaggagatgatcacaaaggcagcgaagaagggacagatgccgtcgcagatcggcgtcctgctccgtgaccagcacggtatcccccttgtcaagagtgtcaccggcagcaaaatcctccgcatcctcaaggcccatgggctggcacccgaaatcccggaggacctgtacttcctcataaagaaggcggtggcgataaggaagcaccttgagaggaacaggaaggacaaagactctaaattcaggctcattcttgtcgagagcaggatccaccgccttgcccgctactacaagcgcacaaagaagcttccccccacgtgggaatacg

SEQ ID NO: 58983 - protein, 141 aa, Zea mays
  misc_feature: Ceres CLONE 1513754
  misc_feature (1)..(60): Pfam Name: Ribosomal_S13_N Pfam Description: Ribosomal S13/S15 N-terminal domain
  misc_feature (65)..(141): Pfam Name: Ribosomal_S15 Pfam Description: Ribosomal protein S15
MGRMHSRGKGISSSALPYKRTPPTWLKTAASDVEEMITKAAKKGQMPSQIGVLLRDQHGIPLVKSVTGSKILRILKAHGLAPEIPEDLYFLIKKAVAIRKHLERNRKDKDSKFRLILVESRIHRLARYYKRTKKLPPTWEY

SEQ ID NO: 58984 - DNA, 651 bp, Zea mays
  misc_feature: Ceres CLONE 1513756
  misc_feature: Encodes the peptide sequence at SEQ ID NO. 58985
  misc_feature (422)..(422): n is a, c, t, g, unknown, or other
  misc_feature (568)..(568): n is a, c, t, g, unknown, or other
  misc_feature (597)..(597): n is a, c, t, g, unknown, or other
tggcggccgctctagaactagtggatcccccgggctgcaggaattcgtctcacccctagaaaaagcgaccctcccacaggaaaccagtgccctaacggcgccgagggcaggttcgtcaggcgtccaaaaccctagttcccaagtcctatataatcagagagctaggtgaaatcctacggatcggttccaacaccagccgccgtcatgtcgaagcgaggtaggggaggttcggctgggaacaagttccgcatgtcactgggtctaccggtggcggccacggtgaactgcgcggacaacacgggcgccaagaacctctacatcatctccgtcaagggcatcaagggccgcctcaaccgcctcccgtccgcctgtgtcggcgacagggtcatggccaccgtaaagaagggaaagcccgacctcangaagaaagtgatgcccgccgtcatcgtccgccagcgcaagccgtggcgtcgcaaggacggtgtctacatgtacttcgaagataatgctggagtgattgtgaatcccaagggtgagatgaaaggttctgcaatcactgggactatcnggcaaggagtgtgctgacctttggcctangatcgccagtgcagcaaatggcatcgtttgagagcttgttgggatgtgtttaga

SEQ ID NO: 58985 - protein, 126 aa, Zea mays
  misc_feature: Ceres CLONE 1513756
  misc_feature (19)..(126): Pfam Name: Ribosomal_L14 Pfam Description: Ribosomal protein L14p/L23e
  misc_feature (73)..(73): Xaa is any aa, unknown, or other
  misc_feature (122)..(122): Xaa is any aa, unknown, or other
MSKRGRGGSAGNKFRMSLGLPVAATVNCADNTGAKNLYIISVKGIKGRLNRLPSACVGDRVMATVKKGKPDLXKKVMPAVIVRQRKPWRRKDGVYMYFEDNAGVIVNPKGEMKGSAITGTIXQGVC

SEQ ID NO: 58986 - DNA, 641 bp, Zea mays
  misc_feature: Ceres CLONE 1513759
  misc_feature: Encodes the peptide sequence at SEQ ID NO. 58987
atagctggagctccccgcggtggcggccgctctagaactagtggatcccccgggctgcaggaattcgtctcacccctagaaaaaataagacagcccgtcagcccctctcgtttttcatccgccttcgcctccaaccgagtgcgctccacgcctcctccaggaaagcgagagcttctgcataagaacaacaaatcaaaagcttgatcagctcggtgccaacaaaacctcaacaaccaagtttcatgtctgatctcaacgtccagcttccatctgcctttgatccgtttgctgaggaaaatgctgaggactctggtgctggtcctggaacgaaggattatgtgcatgtgcgcatccagcagcgcaacggcagaaagagtctgactacagtccagggtctgaagaaagagttcagctataacaagatcctcaaggatctgaagaaagaattctgctgcaatggtactgtacttcaagaccctgagctaggccaggtcattcagctccaaggtgatcagcgcaagaatgttgctactttcctagttcaggctgggattgcgaagaaagagaacatcaagattcacgggttctaagggacctgtaaatgcttgtgccctatattggtgtgcctccacatattttgg

SEQ ID NO: 58987 - protein, 115 aa, Zea mays
  misc_feature: Ceres CLONE 1513759
  misc_feature (27)..(108): Pfam Name: SUI1 Pfam Description: Translation initiation factor SUI1
MSDLNVQLPSAFDPFAEENAEDSGAGPGTKDYVHVRIQQRNGRKSLTTVQGLKKEFSYNKILKDLKKEFCCNGTVLQDPELGQVIQLQGDQRKNVATFLVQAGIAKKENIKIHGF

SEQ ID NO: 58988 - DNA, 648 bp, Zea mays
  misc_feature: Ceres CLONE 1513761
  misc_feature: Encodes the peptide sequence at SEQ ID NO. 58989
cgcggtggcggccgctctagaactagtggatcccccgggctgcaggaattcgtctcacccctagaaaaaatcgcatccatccaccacgcaccccaccaacccatacccataccagaggctctctgattttacttctcagcggtagatcggctgagcgagcgagcgagcgaggcacacgggtagaaaagcaagatgtcggacggcacggcgacctgcatcgacatcatcctcgccatcatcctgccgccgctcggggtcttcttcaagttcggctgcggggttgagttctggatctgccttatcctcaccttcttcggctacctccccggcatcatctacgccgtctgggccatcaccaagtagccggccggagcagagcaaccacggccccctgcaatgactccgtcgcgtgcgttagcatgcaatgtcttgagatgtgattccttccttctttggttagttgctgctgctcctgctggtgtatccagtccttttaaatatcttgattagtttgctcggctgaagaaatcaggacgcctgtcctggggttcctgctcacctgcatggactttgtacaaccaattccgcccctggacttgcctgccccctttccctcaaaaaaaaaaaaaaaaaccgagacgcctcgag

SEQ ID NO: 58989 - protein, 56 aa, Zea mays; identical to SEQ ID NO: 52841
  misc_feature: Ceres CLONE 1513761
  misc_feature (6)..(56): Pfam Name: UPF0057 Pfam Description: Uncharacterized protein family UPF0057

SEQ ID NO: 58990 - DNA, 667 bp, Zea mays
  misc_feature: Ceres CLONE 1513765
  misc_feature: Encodes the peptide sequence at SEQ ID NO. 58991
  misc_feature (176)..(176): n is a, c, t, g, unknown, or other
  misc_feature (342)..(342): n is a, c, t, g, unknown, or other
  misc_feature (343)..(343): n is a, c, t, g, unknown, or other
  misc_feature (351)..(351): n is a, c, t, g, unknown, or other
  misc_feature (352)..(352): n is a, c, t, g, unknown, or other
  misc_feature (353)..(353): n is a, c, t, g, unknown, or other
  misc_feature (359)..(359): n is a, c, t, g, unknown, or other
  misc_feature (360)..(360): n is a, c, t, g, unknown, or other
gccggaattcctctcacccctagaaaaagtctccatccaattcacaggctcaccacaccaaccagcaagcaaaaattccccaatcctctcgtctccgcggcgaatatgtcggggcgcggcaagggcggcaagggcctgggcaagggcggcgcgaaacgtcaccggaaggtgctgcncgacaacatcccagggatcacgaagccggcgatccggaggctggcgcggcgggtcttcgtgcagcgcatgtcggggctcatctacaaggagatcttttgtcgtgctcaaaatcttcctggaaaaagttttttttttcccccctaaccaggagggaagaaagggggnnaaaaaaannntctccnntcttaaaacctcccccccaaacaaaaaaaaaccaaaaccccaacccgtggggggggtccccacaccaaaagttttgccctggacccccgttaccacctcctacatttaggcttcgcctcttggcggcatcaacccctccccccccacgttatccaggggtgggggtgcaaaaaaacccgccgtttacaccgagaccccctcgccttgcatccccaccctacccctccctcctggaatacatctataaatacatgtcactactccccccgcgggcccctgtcttgcttccgaaacacacttcgcctag

SEQ ID NO: 58991 - protein, 71 aa, Zea mays
  misc_feature: Ceres CLONE 1513765
  misc_feature (24)..(24): Xaa is any aa, unknown, or other
MSGRGKGGKGLGKGGAKRHRKVLXDNIPGITKPAIRRLARRVFVQRMSGLIYKEIFCRAQNLPGKSFFFPP

SEQ ID NO: 58992 - DNA, 651 bp, Zea mays
  misc_feature: Ceres CLONE 1513767
  misc_feature: Encodes the peptide sequence at SEQ ID NO. 58993
ggagctccccgcggtggcggccgctctagaactagtggatcccccgggctgcaggaattcgtctcacccctagaaaaaatattccttcgcttccgtcaggtcgggtccgcagcctccccctctcgcagatccccacctgctccgccgccggccaccgcgttgctcccctcggcagccaggatgacagaagtaccatttctgccacgtgagaggctcttcaagcagcaacattacttccagaacttgaccaagcacacctacctgaaagggcgctacgacgtgatcacctccgtcgccatcccccttgcactcgctgcctccagcatgttcatgattgggcgtggagtttacaacatgtctcatggggttgggaagaaagagtgatcttccactggttaactattgtttctgcttggcatggaagtcataccgtcgagactgcgaagtcctcttcgcttgcaaaataatacggccaaataacaattcgactacattttcgcatcaattttctgtttgtatttgtgggtgtgaagtggcagtaacttgaaaatcagcactgtcactgttttggttagttactccattcctttcgtcttttgtgtcccctttcaatagaagcaagctggccttgtacttcctccattctttttt

SEQ ID NO: 58993 - protein, 67 aa, Zea mays; identical to SEQ ID NO: 37080
  misc_feature: Ceres CLONE 1513767
  misc_feature (9)..(62): Pfam Name: COX7a Pfam Description: Cytochrome c oxidase subunit VIIa

SEQ ID NO: 58994 - DNA, 737 bp, Zea mays
  misc_feature: Ceres CLONE 1513768
  misc_feature: Translation starting site: 383
  misc_feature (41)..(41): n is a, c, t, g, unknown, or other
  misc_feature (43)..(43): n is a, c, t, g, unknown, or other
  misc_feature (46)..(46): n is a, c, t, g, unknown, or other
  misc_feature (269)..(269): n is a, c, t, g, unknown, or other
  misc_feature (332)..(332): n is a, c, t, g, unknown, or other
  misc_feature (342)..(342): n is a, c, t, g, unknown, or other
  misc_feature (390)..(390): n is a, c, t, g, unknown, or other
  misc_feature (391)..(391): n is a, c, t, g, unknown, or other
  misc_feature (453)..(453): n is a, c, t, g, unknown, or other
  misc_feature (454)..(454): n is a, c, t, g, unknown, or other
  misc_feature (455)..(455): n is a, c, t, g, unknown, or other
  misc_feature (472)..(472): n is a, c, t, g, unknown, or other
  misc_feature (539)..(539): n is a, c, t, g, unknown, or other
  misc_feature (540)..(540): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (607)..(607): n is a, c, t, g, unknown, or other
  misc_feature (608)..(608): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (647)..(647): n is a, c, t, g, unknown, or other
  misc_feature (648)..(648): n is a, c, t, g, unknown, or other
  misc_feature (678)..(678): n is a, c, t, g, unknown, or other
  misc_feature (679)..(679): n is a, c, t, g, unknown, or other
  misc_feature (696)..(696): n is a, c, t, g, unknown, or other
  misc_feature (697)..(697): n is a, c, t, g, unknown, or other
  misc_feature (699)..(699): n is a, c, t, g, unknown, or other
  misc_feature (700)..(700): n is a, c, t, g, unknown, or other
  misc_feature (714)..(714): n is a, c, t, g, unknown, or other
aaagaaggggccggcggagagacgagaaagaaaattgggangnggngcacccatggtgataagatataaactccgcggcgggggggccgctctagaatagtggataccccggggtgcgggaattcgtctcacccctagaaaaaaagccacctacaccaccaccccgccggccacactcgtctttctcacgagccacaggcacaggcagggtctcgagctcactccacccatcgcaggggatggcgtcatcgttcgccgtggcaacggtnccgtcgctagcggccccggcggccaaaaaacgggccggcggcgtcacgtacgtagagggaatnaacccctacncgagcaccaaaaaaccacaaaaagtaaaacaagctttaaaatggcgannaacgccgaaaacgccgtcgcaaagttaaaatcccccctccccacccggggggagagaaagannnaagtaaaaaaaaatganggccccacgaggaaaacgacgcgcaaaaacaacaaaaaccgggggacacaattagacaagaggccgnngagagagcggatggagagaaagaacaaaagtaggtnnncccccacacagagggcacaaaggttaagnnagatacgaagtgnnnnccaaaagcagaagaaaagcgcanntagcgatacaaagataaagaaaagaaaagnnaggaaagaaaaaaagcnncnncggaacagacggtncagatggactaaagacaaacacg

SEQ ID NO: 58995 - DNA, 631 bp, Zea mays
  misc_feature: Ceres CLONE 1513770
  misc_feature: Encodes the peptide sequence at SEQ ID NO. 58996
  misc_feature (102)..(102): n is a, c, t, g, unknown, or other
  misc_feature (362)..(362): n is a, c, t, g, unknown, or other
  misc_feature (364)..(364): n is a, c, t, g, unknown, or other
  misc_feature (365)..(365): n is a, c, t, g, unknown, or other
  misc_feature (366)..(366): n is a, c, t, g, unknown, or other
  misc_feature (374)..(374): n is a, c, t, g, unknown, or other
  misc_feature (492)..(492): n is a, c, t, g, unknown, or other
  misc_feature (572)..(572): n is a, c, t, g, unknown, or other
  misc_feature (597)..(597): n is a, c, t, g, unknown, or other
  misc_feature (598)..(598): n is a, c, t, g, unknown, or other
  misc_feature (601)..(601): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (616)..(616): n is a, c, t, g, unknown, or other
  misc_feature (617)..(617): n is a, c, t, g, unknown, or other
gctctagaactagtggatcccccgggctgcaggaattcgtctcacccctagaaaaaatttttgcagtgctagctggtgatcctcaaacatccaacgacgatnagaaggctgaagctcagcccaagggccatactggcaagacagttttgttcgtcctcctaggagtgggggccgtcattctgttgtcatttttcattttccagtattggcagaagaagaaaagggaggaacaacatgcacgtctactaaagctatttgaaaaggatgatgacattgaggttgaacttggtcttatagactgataatcttcaatgtacagcaagagtatctttgctgccccccctttgcggggggtggggtgnannnttttcacnttaatgtataaaatttgttgtatttaaacttggcggacctccccccgaaagttctattgtatttcccctttttatgaacatctctgcgggcgggggggggcttgaaaaaaaatctaangaggaaatatctcggttttgcaaatcatccccttgattttttaaagttttctgaaaaataaataatcctggggggggggnaaaaaaaaaaaaaaaaaaaaaaaannaantttattnnnngcccnntatagtcatccttc

SEQ ID NO: 58996 - protein, 99 aa, Zea mays
  misc_feature: Ceres CLONE 1513770
  misc_feature (34)..(34): Xaa is any aa, unknown, or other
SRTSGSPGLQEFVSPLEKIFAVLAGDPQTSNDDXKAEAQPKGHTGKTVLFVLLGVGAVILLSFFIFQYWQKKKREEQHARLLKLFEKDDDIEVELGLID

SEQ ID NO: 58997 - DNA, 659 bp, Zea mays
  misc_feature: Ceres CLONE 1513771
agctccccgcggtggcggccgctctagaactagtggatcccccgggctgcaggaattcgtctcacccctagaaaaacccgccccaccaaaggataccgcagaccagtgcgtcaccgtacggccaaagggagataccacctcccatctagcggccgtccacagagcaccacagagtccactgacatcgaccgacgcaagcttacatctgaccaatttctctcgaggcgtctcaggtaaagatgactccacttccactctctcatcctcttctgttcttcctgtctccgtcttcaatcctggagcataagcgagagacccgtggccttttacatccaggtgttcttatctgctgtgacttcttcggtctggctctagttctacgagtgtactcactactactcactacgctggtattgaagagacgtgtctttttctacacctcccttgctcaagtgagtgctgtcctgaacggatctaaccaggactgccatctgcttattactcgtggctgtggggtgccgccagtatcttcccttgtccttgggttgctagagacctcacaacctcgagcccctcttagacacacgctcgacgcaccgaattctccctatcagcgagtagtatatacggagggtgactgcccgaagggttccaacgcc

SEQ ID NO: 58998 - DNA, 747 bp, Zea mays
  misc_feature: Ceres CLONE 1513773
  misc_feature: Encodes the peptide sequence at SEQ ID NO. 58999
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
tttttttttttttttttttttttttttttnnnnnnnnnnnccagaaaaactcaaaactggaactccacgcggtggcggccgctctagactagtggatcccccgggctgcaggaattcgtctcacccctagaaaaagctctgatagcttgctccaggacgtacgtacgtacgtagatcgatccatcgatcgctagctagctgacgaccatggcgtccctctcctctgccgccatcaccgccccttccttcacggccgcgcccgctcgcgcagtggtcagcaggaggtccttcaccgtgcgtgcctctctccgcaaggccactgccaccgccgccgtggccgttgccgccagcgtcctgcttgccggcggcggcgccatggcccaagaggtgctgctgggcgcaggcgacggcgggctcgtcttcgagcccagccagttcaccgtcaaggccggcgacaccaccaccttcaagaaacacgccggcttcccgcacaacgtcgtgttcgacgaaaacgatgtgccgagcggcgtcgacgcctcccagatctcgccaggagagtaccctcaacgcgccggggggagaacttaatccatcacccctcaaccgtgcccgggaaaccttacgggtttcttactggcgtagcccccacccaagggaacaatggaaatgggttctgttaaggaatcaccacttccaacctcaaaacctctacccgtatacccagttttaaattggccttttcttcaa

SEQ ID NO: 58999 - protein, 126 aa, Zea mays
  misc_feature: Ceres CLONE 1513773
  misc_feature (59)..(123): Pfam Name: Copper-bind Pfam Description: Copper binding proteins, plastocyanin/azurin family
MASLSSAAITAPSFTAAPARAVVSRRSFTVRASLRKATATAAVAVAASVLLAGGGAMAQEVLLGAGDGGLVFEPSQFTVKAGDTTTFKKHAGFPHNVVFDENDVPSGVDASQISPGEYPQRAGGRT

SEQ ID NO: 59000 - DNA, 646 bp, Zea mays
  misc_feature: Ceres CLONE 1513776
  misc_feature: Encodes the peptide sequence at SEQ ID NO. 59001
aaaagctggagctccccgcggtggcggccgctctagaactagtggatcccccgggctgcaggaattcgtctcacccctagaaaaaggagagctgagtgagatggcacaaaccatggcgtccatgaccggcctctcgcagggcgttctgcccagcaggcgcgccgccaacagggccaggacggccgccgtcgtcagggcgtccgccgaggcgcaggcgggccgccgcgccgtgctcgggctggtggccactggcatcgtcggcggcgccttgtcgcaggcggtgcacgccgagaccgtcaagaccatcaagatcggagccccgccgccgccctccggtggactccccgggactctgaactctgaccaggcgagggacttcgacctccccttgaaggagcggttctacctgcagccgctgccgccggcggaggcggtggcaagggtgaaaacgtcggcgcaagacatcatcaacctcaagccgctcatcgacaagaaggcgtggccgtacgtccagaacgacctccgcctccgggcctccttactgcgctacgacctcaagacgtcatcgcttccaagcccaaggaaggagaagcaaaccctcaaggagctcaccgggaagctcttcagcaccatccgacaatcttga

SEQ ID NO: 59001 - protein, 181 aa, Zea mays
  misc_feature: Ceres CLONE 1513776
  misc_feature (13)..(178): Pfam Name: PsbQ Pfam Description: Oxygen evolving enhancer protein 3 (PsbQ)
MAQTMASMTGLSQGVLPSRRAANRARTAAVVRASAEAQAGRRAVLGLVATGIVGGALSQAVHAETVKTIKIGAPPPPSGGLPGTLNSDQARDFDLPLKERFYLQPLPPAEAVARVKTSAQDIINLKPLIDKKAWPYVQNDLRLRASLLRYDLKTSSLPSPRKEKQTLKELTGKLFSTIRQS

SEQ ID NO: 59002 - DNA, 715 bp, Zea mays
  misc_feature: Ceres CLONE 1513778
  misc_feature: Encodes the peptide sequence at SEQ ID NO. 59003
  misc_feature (591)..(591): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (635)..(635): n is a, c, t, g, unknown, or other
  misc_feature (637)..(637): n is a, c, t, g, unknown, or other
  misc_feature (640)..(640): n is a, c, t, g, unknown, or other
  misc_feature (641)..(641): n is a, c, t, g, unknown, or other
  misc_feature (643)..(643): n is a, c, t, g, unknown, or other
ctccccgcggtggcggccgctctagaactagtggatcccccgggctgcaggaattcgtctcacccctagaaaaaatccaattcactccactcatcttttcgcgtttagaacctctaaaatttcccccactcgccagtcgcagcagcacctgtagccatggacgccagcggagccggtagcaaggggaagaagggtgcggccgggcgcaaggcaggcggccccaggaagaagtcggtgacgcggtccgtcaaggccgggctgcagttccccgtcggccggatcgggggctacctgaagaagggccggtactcccagcgcgtggggcactgggcgcccccgtttaatttttttgcccccccccaaggggggggggggggggaggttttggaattgtaaaaagaaacccccccacaaagaaacaaagaaaaatgcggaatcattaccggggggcggggttgccgtggcgtacctccaatcgacaaaggggtcttcggggaaaagttgtgagggtggggtgtaatcattgggaggaagaggaagcatcactcacccgagaaggcgaggtgggggggtcctctgttctcaaaaaanggggaccaagtgtgcggggnnnnnnnnnnnnnnnannngggggnanggnncncaagggtcccgccgagggaggggagggctcattggacccgcgcgaaccgtggtctcaggagcgcgatggtat

SEQ ID NO: 59003 - protein, 79 aa, Zea mays
  misc_feature: Ceres CLONE 1513778
MDASGAGSKGKKGAAGRKAGGPRKKSVTRSVKAGLQFPVGRIGGYLKKGRYSQRVGHWAPPFNFFAPPQGGGGGEVLEL

SEQ ID NO: 59004 - DNA, 612 bp, Zea mays
  misc_feature: Ceres CLONE 1513785
  misc_feature (331)..(331): n is a, c, t, g, unknown, or other
  misc_feature (433)..(433): n is a, c, t, g, unknown, or other
  misc_feature (497)..(497): n is a, c, t, g, unknown, or other
  misc_feature (504)..(504): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (581)..(581): n is a, c, t, g, unknown, or other
  misc_feature (582)..(582): n is a, c, t, g, unknown, or other
  misc_feature (584)..(584): n is a, c, t, g, unknown, or other
  misc_feature (594)..(594): n is a, c, t, g, unknown, or other
atagctggactccccgcggtggcggccgctctagaactagtggatcccccgggctgcaggaattcgtctcacccctagaaaaaagactactcatccgtcgccccacgcccccacggaagtttcggcggcgccggcgtgctcgtgatctcaaccaaggcgtgcctccgctccggtcacccgtctccacgcaaccatgtcgagaaggaagaccagggcagcccaagggaggagaacgtcactcttggacccactgtccgtgaaggagagtatgtcttttggtgtcactcacatccctggcatccttccaatgaacacccttcattccatattncactgaattttggtcctgggcaagggaaaaatcctgggtttcgggaatccacccgcgcggcccccgaaaaggtggaaaaggggggggaaccccctttaaccnaaatttccccttccccccctctttttaacccgcctggcccctaatagagggagatttgtggaangggtggncataccccactaaaaagaaaaaaagaggagnnncgagcaagcacacaagaaggactgcggcgcgccttcttcctccnncncccccacagnaagaagaagaacaaagcg

SEQ ID NO: 59005 - DNA, 656 bp, Zea mays
  misc_feature: Ceres CLONE 1513788
agctccccgcggtggcggccgctctagaactagtggatcccccgggctgcaggaattcgtctcacccctagaaaaaagacgcaaaggcgccctgcctttggacgtcggacagccatccctccgagcttgtctcgtctattcctcatctcgcggatggcggcgacgtccgatctctgttgctgcccggtctgatgatttcttggacgcacgacgaacgcgagttggaaggaggtctggaggtggacgggctttgggcagcgggggagctgggcgccagcagtgtcgaactcgaaccctaccaaatcacagatattaattttgagagctgtgaagtagaaaactctaatctttggaggagactttctgaatctgcatcaaaagttgagtgtggtgagaatcttacgtacaagtcaacaactgatgttagtttatttttatttttgtggataagaaaatgctttgcttaatgcaagcaagtctgattgtaaggtactcctctttagatctgatttttgtcaccatcattagcctgtaagcaagcaagaactcattttgtgagcaagcagtatatgttccactgttggagctaaaaaaaaaaaaaaaacgagacgctcgaggtaccccattcgccctatagtgagtcgtattacgcgcgc

SEQ ID NO: 59006 - DNA, 559 bp, Zea mays
  misc_feature: Ceres CLONE 1513792
  misc_feature: Encodes the peptide sequence at SEQ ID NO. 59007
  misc_feature (343)..(343): n is a, c, t, g, unknown, or other
ggagctccccgcggtggcggccgctctagaactagtggatcccccgggctgcaggaattcgtctcacccctagaaaaagtcttgtgttgttcggagcgggcagcagcacacagccccatcccaatcctagtcgatcttcttcccctcctcaaggaagaaaagaagctgaaccatggggaagagaaagtcagctgctaagccacctcctaagaagcggatggacaagcttgacactgtcttttcctgcccattctgcaaccacgggagtagtgttgagtgccgaattgacatgaagaatctgattggcgaagcatcttgtagaatctgtcatgcaaaactttcngcacaactgttaatgactcactgaggctagggatatatatagtcgatcgattgatgattgtcagcgtgtacacactgttcgaagagacgatgatgcctgagcttggcacatgtgatgaactgctacatagaaatcgaaaggtatgtgcatgtattctcggatgccatagcctttatgcaaccatggctggaataacgtactggctgactgaaatgg

SEQ ID NO: 59007 - protein, 64 aa, Zea mays
  misc_feature: Ceres CLONE 1513792
  misc_feature (8)..(61): Pfam Name: Elf1 Pfam Description: Transcription elongation factor Elf1 like
MGKRKSAAKPPPKKRMDKLDTVFSCPFCNHGSSVECRIDMKNLIGEASCRICHAKLSAQLLMTH

SEQ ID NO: 59008 - DNA, 626 bp, Zea mays
  misc_feature: Ceres CLONE 1513796
  misc_feature: Encodes the peptide sequence at SEQ ID NO. 59009
  misc_feature (396)..(396): n is a, c, t, g, unknown, or other
  misc_feature (403)..(403): n is a, c, t, g, unknown, or other
  misc_feature (410)..(410): n is a, c, t, g, unknown, or other
aaaagctggagctccccgcggtggcggccgctctagaactagtggatcccccgggctgcaggaattcgtctcacccctagaaaaacccccttccctctcttccgcctccgattgagtggctcaccttctttcccagccagcacgagcttgcaagcaagcgagctcctgagatttcagctcgcttctcctccagaggtcgagcagaccagactcctccgaccgaagctctaccacttcccagttatcctgtccaggaactgcttggccggagatccaaacaaacctctgtgttggggttctccggggttccttgcgctggagggaggtttcgttctcgctggccatggtttggctgtttatccccccccgcagggggggggagggggaatctctganctttatnaaaatcnccactcacctgagcagctcctgcttccctcactcgttgtgggtggtcttcctctacggggtttatgggatccccaaacttggcctcccccggatccgccatttccccctggcctctctccggtcacctaaacttttccctcctttttgggttcccccaaaatcggcaaaaaaaccccctagggggagcgggaaagatccttttcaaggaaactagg

SEQ ID NO: 59009 - protein, 93 aa, Zea mays
  misc_feature: Ceres CLONE 1513796
  misc_feature (18)..(18): Xaa is any aa, unknown, or other
  misc_feature (20)..(20): Xaa is any aa, unknown, or other
  misc_feature (23)..(23): Xaa is any aa, unknown, or other
MVWLFIPPRRGGEGESLXFXKIXTHLSSSCFPHSLWVVFLYGVYGIPKLGLPRIRHFPLASLRSPKLFPPFWVPPKSAKKPPRGSGKDPFQGN

SEQ ID NO: 59010 - DNA, 662 bp, Zea mays
  misc_feature: Ceres CLONE 1513799
  misc_feature: Encodes the peptide sequence at SEQ ID NO. 59011
tggcggccgctctagaactagtggatcccccgggctgcaggaattcgtctcacccctagaaaaacctatcctctccccgcccgcccgtgccgccgccgcggcttcccttcctctcccgagccaagatgaatgttgaaaagctcaagaagatggcaggtgctgtgcgcaccggggggaagggtagcgtgcgcaggaagaagaaggcagtccacaagactacaaccacagatgacaaacggcttcaaagcaccttgaaaagaataggagtgaacagcattcctggtattgaagaggtcaacatctttaaggatgatgttgttattcagtttgtaaatcctaaagtgcaagcgtcaattggtgctaatacatgggtggtcagtggaactccacagacaaagaggctgcaagatctgcttccgtcgattatcaaccagcttgggcctggacacctggacattctgcggaggctcccaaaacaattccagaaaccggcctctggtgcttctggggccaaagcttggtgcccgcgcttggggctgtttcaggagcatgatgatgaacttccctgagcttgtcccttggaaaaactttttaggaaggccgcggaaaaaaaaaaaggagtcccccagaattttggctaccttgcctgcccggtggttaaa

SEQ ID NO: 59011 - protein, 147 aa, Zea mays
  misc_feature: Ceres CLONE 1513799
  misc_feature (34)..(92): Pfam Name: NAC Pfam Description: NAC domain
MNVEKLKKMAGAVRTGGKGSVRRKKKAVHKTTTTDDKRLQSTLKRIGVNSIPGIEEVNIFKDDVVIQFVNPKVQASIGANTWVVSGTPQTKRLQDLLPSIINQLGPGHLDILRRLPKQFQKPASGASGAKAWCPRLGLFQEHDDELP

SEQ ID NO: 59012 - DNA, 692 bp, Zea mays
  misc_feature: Ceres CLONE 1513802
  misc_feature: Encodes the peptide sequence at SEQ ID NO. 59013
tacccgcggtggcggccgctctagaactagtggatcccccgggctgcaggaattcgtctcacccctagaaaaaacccggcagtcacacctcgaaagcaacagcaagtcagcaacctacctagctagagctatcactatatcagtatcaggtacctagacctagcagcagccacacccacaccgtacgtcggcatggctaggtggtcgtcgtcagctctggtcgccgtcctcgtggtcctggccgcggcggtggcgtgctccgcggcgcgccccgtccccgcgcagcagcagcaggcggtagaggacgtgaagcggccggacacgctgcacgaggggacggtgctgatcccggggatggggcgctacgagatcggcagccactacatcccggacatcggcgggctggaccacagcatccccgccgccacccacggccagttcctccccggggccgacgacacctgggtgcccaaccccggcttcgaggtccccaacccccttctggccgggggcggccactccctggaacacgtacccggcgcttggcgaaggggggctcttcgggccgatcctgaactgccgaagcggccgcccgcccgcccctggaaaaaaataattacttacttagcgctcccctcgggggcttgcctaggtaataaaataggcgttgaactttaagattagggccgtgg

SEQ ID NO: 59013 - protein, 161 aa, Zea mays
  misc_feature: Ceres CLONE 1513802
MARWSSSALVAVLVVLAAAVACSAARPVPAQQQQAVEDVKRPDTLHEGTVLIPGMGRYEIGSHYIPDIGGLDHSIPAATHGQFLPGADDTWVPNPGFEVPNPLLAGGGHSLEHVPGAWRRGALRADPELPKRPPARPWKKIITYLALPSGACLGNKIGVEL

SEQ ID NO: 59014 - DNA, 638 bp, Zea mays
  misc_feature: Ceres CLONE 1513805
  misc_feature: Encodes the peptide sequence at SEQ ID NO. 59015
acccgcggtggcggccgctctagaactagtggatcccccgggctgcaggaattcgtctcacccctagaaaaagtctgcgcttccaacggtagctaactccaaggcaagcatccttggtccattgttggcctcgctcatcaatcagctgtgtctcagcaggaggcgttgcggccatggcggcttcgaagcccatcttgtatagcgcgtggatcagctcctgctccttccgagtccggatcgccctcaacctcaaaggtgtggattatgagtacagggctgtgacaaggaacgatctagattacgaaaagatcaatccaatcaagtatgttccagcattggttgatggggattttgttgtttctgactccctggcaatcatattgtatcttgaagataaatatcctcaacaccctcttttgcctcaagatctcaaaaagaaagctataaatctgcagattgcaaatatagtttgttcaagcattcaacctcttcaatgttatgctgtaattggtctgcttgatggcaccttaggctctaaccagagccttcagattgttcggaattacaccgacaagggatttaaagcaatcgaaaaacttctgggaaggttgtgacagtaaatatgctactggagacca

SEQ ID NO: 59015 - protein, 146 aa, Zea mays
  misc_feature: Ceres CLONE 1513805
  misc_feature (4)..(74): Pfam Name: GST_N Pfam Description: Glutathione S-transferase, N-terminal domain
  misc_feature: SWISSPROT Homolog: EC 2.5.1.18 Glutathione transferase
MAASKPILYSAWISSCSFRVRIALNLKGVDYEYRAVTRNDLDYEKINPIKYVPALVDGDFVVSDSLAIILYLEDKYPQHPLLPQDLKKKAINLQIANIVCSSIQPLQCYAVIGLLDGTLGSNQSLQIVRNYTDKGFKAIEKLLGRL

SEQ ID NO: 59016 - DNA, 652 bp, Zea mays
  misc_feature: Ceres CLONE 1513807
  misc_feature: Encodes the peptide sequence at SEQ ID NO. 59017
  misc_feature (392)..(392): n is a, c, t, g, unknown, or other
  misc_feature (408)..(408): n is a, c, t, g, unknown, or other
aaagctggagctccccgcggtggcggccgctctagaactagtggatcccccgggctgcaggaattcgtctcacccctagaaaaaaccacgctgtgagtgactcggtcgcatcttccccattctccatcgacgcaccggcggcggcgcaagtgaagcgaagaggaaaggaagctacgagatgtcggcgaccactgcagcggtgcccttctggcgggcggcggggatgacctacatcggctactccaacatctgcgctgcgctggtccggaactgcctcaaggagcccttcaagtctgaggccgcgtcccgcgagaaggttcatttctccatttccaagtggacggatggcaagcaggagatccctactgtccgcacagaagcggatgactaanggctggcgccttggcnacataatccttcctacagatgatttgaaacgtcctttgcaggttctgggacttgttatttaagtgggcctgattttgtaacaatgctgaaaaaaaaataccttttttgcgacaatggtctttttacaatgggcaggtggttttcgttagccaattggcccttgccctacccctaaacaaggaaggggaactaaagggaatggcttcccttttgggccactttgggaaatatgtggcttgggcgg

SEQ ID NO: 59017 - protein, 70 aa, Zea mays
  misc_feature: Ceres CLONE 1513807
  misc_feature (9)..(57): Pfam Name: ATP-synt_Eps Pfam Description: Mitochondrial ATP synthase epsilon chain
MSATTAAVPFWRAAGMTYIGYSNICAALVRNCLKEPFKSEAASREKVHFSISKWTDGKQEIPTVRTEADD

SEQ ID NO: 59018 - DNA, 839 bp, Zea mays
  misc_feature: Ceres CLONE 1513809
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (30)..(30): n is a, c, t, g, unknown, or other
  misc_feature (31)..(31): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (267)..(267): n is a, c, t, g, unknown, or other
  misc_feature (270)..(270): n is a, c, t, g, unknown, or other
  misc_feature (271)..(271): n is a, c, t, g, unknown, or other
  misc_feature (272)..(272): n is a, c, t, g, unknown, or other
  misc_feature (273)..(273): n is a, c, t, g, unknown, or other
  misc_feature (278)..(278): n is a, c, t, g, unknown, or other
  misc_feature (279)..(279): n is a, c, t, g, unknown, or other
  misc_feature (280)..(280): n is a, c, t, g, unknown, or other
  misc_feature (282)..(282): n is a, c, t, g, unknown, or other
  misc_feature (283)..(283): n is a, c, t, g, unknown, or other
  misc_feature (285)..(285): n is a, c, t, g, unknown, or other
  misc_feature (286)..(286): n is a, c, t, g, unknown, or other
  misc_feature (287)..(287): n is a, c, t, g, unknown, or other
  misc_feature (839)..(839): n is a, c, t, g, unknown, or other
aaaannnnnnnnnnnnnnnnaacaaccccnnccagggnnnnnnntttgtnnnnttaaaactggggctccccgcggtggcggccgctctagaactagtggatcccccgggctgcaggaattcgtctcacccctagaaaaaataaagaaagctgaaggctccacacagacaactccgtagagctccctgctttgttcagacttcagagcccttcctcttgagtacgtgcaaagtggagatacttgaacaaggatctcctccctattagnggnnnnccggnnngnntnnnccccacctaaagagaaacgaacatttttattattatattgattacgatttgctttgacagaatgaattaaaaaaagagggatggggaggcggcgggcggggttctgtcggttgttgtggaattgatcctggggtgcccgtgttatctgacggtggggctccccgcgggcgtgcgggaggcctgttcgccaactgcccgcccccccgcacggtataatgttttagattagatatcatattaattcaataattaatgttttataattgtcatttcctatatagggtgggggtatgggatactatattaatatattttatcgtaatataagaaaagagaaagagagcagcgagagggagggggtaagggcggcatggaggtgtgtgttgttgaacgcacgcagacggggaaagaggtaagcgggagggggtttttaggttggagatattttactttgggtggactgttcgagatagactaggtataatatatatgtgatggtggtatgcgaatgtggaagcgcttgcctgccgatcgtaaataaaccgacatatn

SEQ ID NO: 59019 - DNA, 651 bp, Zea mays
  misc_feature: Ceres CLONE 1513814
  misc_feature: Encodes the peptide sequence at SEQ ID NO. 59020
  misc_feature (572)..(572): n is a, c, t, g, unknown, or other
tggagctccccgcggtggcggccgctctagaactagtggatcccccgggctgcaggaattcgtctcacccctagaaaaaatcacacagcaatccacacaagcacttcgacgtcacacgggcgctgcgcacagacaacccaagcgtcggcaccaatggcttactaccaggaggtggactactgctcggaggaggtgaggtcggtggccccggccggcttctgccgccacggcggcggcgtccagcagcacgtcgtcaaggagaagttcgaggaggtcgacacggtctcacgcgccggcgccaaccaccaccaccaccatggtcaccacggcggccacggcttcttggtgcgcgagaccagggtcgaagaggacatcatcacctgcaccggcgagttccacgagcgcagggagagcttccttgccagggctaactgatccgcccggcggccggcatccacgcccgttcgtgcttgcctgcgtgccttatgtatgtctgtggttgactggttgtgcaggatcatcatacttggctatcgtacgtgcacgcactcagctcctgtacgattacgacnataagctcgtgacgtgcataaacttcttcgtagtactactacctagaaaaaaaaaaaaaaacgagacgctcgaggtacc

SEQ ID NO: 59020 - protein, 93 aa, Zea mays
  misc_feature: Ceres CLONE 1513814
MAYYQEVDYCSEEVRSVAPAGFCRHGGGVQQHVVKEKFEEVDTVSRAGANHHHHHGHHGGHGFLVRETRVEEDIITCTGEFHERRESFLARAN

SEQ ID NO: 59021 - DNA, 649 bp, Zea mays
  misc_feature: Ceres CLONE 1513817
  misc_feature: Encodes the peptide sequence at SEQ ID NO. 59022
  misc_feature (570)..(570): n is a, c, t, g, unknown, or other
aaagctggagctccccgcggtggcggccgctctagaactagtggatcccccgggctgcaggaattcgtctcacccctagaaaaaagagcttcgccgaggaggccaggattatggctattcctggtcagtgctcctcctgcgtattatacgtcttccaccgtgatgatgcagctccaccgagggcacagccacctgccgtgccagtgccaaggcgcacgaacagcgcagtgcatgacgttgcacgtggacacagctgccggcagcaggaccatcagggtggccatcgatacccagatcttcaaggcttccgacaccaggccaatcatgctcttcgactgcgtctgcaacctctgcaacgagcggcgtctgcttcgtgaggtagcactactccagcaggagcctccaggttgatgccgctgcacagcgagtccgataggaaactcctgcaaagagaaggaaggccccatgacgaaatctccaaagattggtctcgtaaaaaaaaaagggtcctttgctccacgcctagaagccgaggcttagggaaaaatggaggagcctcaaacctttganctttcccgaacgtgccacccgtgtttcctccaagtttccggccccccggggttcccagaaatgaaaatttcccccgcaa

SEQ ID NO: 59022 - protein, 82 aa, Zea mays
  misc_feature: Ceres CLONE 1513817
MMQLHRGHSHLPCQCQGARTAQCMTLHVDTAAGSRTIRVAIDTQIFKASDTRPIMLFDCVCNLCNERRLLREVALLQQEPPG

SEQ ID NO: 59023 - DNA, 639 bp, Zea mays
  misc_feature: Ceres CLONE 1513819
  misc_feature: Encodes the peptide sequence at SEQ ID NO. 59024
gatagctggagctccccgcggtggcggccgctctagaactagtggatcccccgggctgcaggaattcgtctcacccctagaaaaaatcttgctctgaacgcattcctcccatctcccaagacctcctcagacccgagaagcgcagctgcggccatggacgccaccggcactggagctggagggaaggcgaagaagggagcggccggtcgcaaggccggcgggccgaggaagaagtcggtgacgaggtccgtgaaggccgggctccagttccccgtcggccgcatcgggcgctacctcaagaagggccgctacgcgcagcgcgtcggcagcggtgcccccgtctacctcgcggccgtcctggagtacctcgccgctgatgtcctggagctcgccggcaacgctgccaaggacaacaagatgacgcgcatcgtcccgcgccacgtgctgctggcgatccgcaacgacgaggagctcgggaagctgctgaccggggtgaccatcgcccacgggggcgtgttggccaacatcaacccggtcctgctgcccaagaaaacagcggaaaaaggctccagcgccgggagcaagaagggcaagccccccagaaaggccgccaagtcccccaagaagggctaggggttt

SEQ ID NO: 59024 - protein, 159 aa, Zea mays
  misc_feature: Ceres CLONE 1513819
  misc_feature (31)..(104): Pfam Name: Histone Pfam Description: Core histone H2A/H2B/H3/H4
MDATGTGAGGKAKKGAAGRKAGGPRKKSVTRSVKAGLQFPVGRIGRYLKKGRYAQRVGSGAPVYLAAVLEYLAADVLELAGNAAKDNKMTRIVPRHVLLAIRNDEELGKLLTGVTIAHGGVLANINPVLLPKKTAEKGSSAGSKKGKPPRKAAKSPKKG

SEQ ID NO: 59025 - DNA, 620 bp, Zea mays
  misc_feature: Ceres CLONE 1513828
  misc_feature: Translation starting site: 102
  misc_feature (615)..(615): n is a, c, t, g, unknown, or other
atagctggagctccccgcggtggcggccgctctagactagtggatcccccgggctgcaggaattcgtctcacccctagaaaaaactacgccaaactgcacaatggcaccacaaaccatgctcctcggcgtctgtgccgtgctgatggtggtcggcgtcaccaacgccgcggagggccaggtggcgtctgtcgtcatgcgcctggctaggtgcgccgacagcacgaagaacaacatgatagctgacgccggtttcaagggtcttcaggtggctatcaagtgcaagaacagcaacggcaagtacgatacaaaggccgtgagtgagatccaaagctccgagagccttcaccgtcccactcgcctccgacctccaaggagacgactgccacgcgcagctccacagcgccgaccataacgcaccttgccctgagcaggagacgtccaggatcgcgcccatgtcatgcggcactttcatcgccgtgcctgatcagatgcactacacgtactcgtagtgcgcatcagcatttctctgctccccgatcaagaagcacattgttagatctcctccacaatgcacccactacgagtgcccgagtaccacccggtgactgaccaangctaa

SEQ ID NO: 59026 - DNA, 666 bp, Zea mays
  misc_feature: Ceres CLONE 1513830
  misc_feature: Translation starting site: 189
aaaactggagctccccgcggtggcggccgctctagaactagtggatcccccgggctgcaggaattcgtctcacccctagaaaaaagtattctgctcaagcacaccgcagaaaaagaaaaagaaaaggcaaaggcaaaggaatcccaatcaggcaagcaaaaaggaagaaccaggtgctgcggccggagatgtcgtcccagctgatcgaggagcaccggtcgggcgcggaggtgcacgtcgggcacgagctgtgcgagcgcaagtcgcgcgagttcatggtggaagctgggcctccccgaacgggctcctcccgctgcccaggctccgacgaggtgggctacaacccggtccacggggttcgtgtggctgcggcaggccgccggcctgacccacaccttcgggtccatccggcaagcaggtgtggtacgacagggaggtgacggcgttcgtggagccggggcggatgcacggcctccccggggtgaagagcaaggagctcctcatctgggtcacatctccgaaatcgtcctcagcccctccggcaccaagatcgtgttccgcacccccgcggggctcggccgcgccttccctgtcaccgccttccagctcgagccccgcgcggcccgaggggaccacaggagagggccaaagacgcccccgccgccc

SEQ ID NO: 59027 - DNA, 493 bp, Zea mays
  misc_feature: Ceres CLONE 1513833
  misc_feature: Encodes the peptide sequence at SEQ ID NO. 59028
  misc_feature (325)..(325): n is a, c, t, g, unknown, or other
  misc_feature (374)..(374): n is a, c, t, g, unknown, or other
ccccgcggtggcggccgctctagaatagtggatcccccgggctgcaggaattcgtctcacccctagaaaaaaaccaccgtaccccgacccctcgagaacaatggccaccgtcctatgcagcccccgcgcgccggccttcttcttctcgacgtcctccctccgtgccgcgacggagcccaccgccgtggcgctgcctgcggtcaacgtgggcatcatgggccgtatcgccagcacatgagcaggctgcgcgcgcaggccacctacaacgtgaacctgatcacgacggaacgtcgatgtggcactgctggtgcccaacgacatgtancatctgtatcatgccgaggaggacagcatcgacctagcctactcctgcngtcgcggggttctgctccttctgcgccggccaaggtcgtctgcgggctctcttgaccctttcggaccagaacttacttccaaggagggggcaaaaagcgccgacccgtttggggtgcct

SEQ ID NO: 59028 - protein, 45 aa, Zea mays
  misc_feature: Ceres CLONE 1513833
MATVLCSPRAPAFFFSTSSLRAATEPTAVALPAVNVGIMGRIAST

SEQ ID NO: 59029 - DNA, 772 bp, Zea mays
  misc_feature: Ceres CLONE 1513835
  misc_feature: Encodes the peptide sequence at SEQ ID NO. 59030
agccactccgtcttgtgttacacattccacgcaatggcgtcctctcctctggcaccaaccaggacctgctcgcccctagtgcccaggctgccccgccgcccctcgctcccatccccgtgtaggtctccccgtcgcagtgcacggtggccgcgcttggcgtcagtcagagcgactccgggcagcagctggaccgcggcggcgacggaggagcagaagaggtgcctgagatgcggtggctcttaccgagacgaggagaaccacccgaccgcctgcgccttccatggccacgtcacaggcgagaaggggctgttctccctgtcgccgccgcaccagggcatcgacggcgagtggagcgacaagagcggggtcatcgtgtaccgctggaacgacgaggggagccggcccaacacaggccgcgctaactggaagaggcgctggagctgctgccaggagcgcgaggaggacgcgccgccgtgccagcgcgggtggcacgtctcctacgacgacggctacaccctcttctaggtcgccctctacccgtggcctggccgtggggagcagcaggagatataaggtgccaaactacgtccatgtttattacttggagtatagtacacagaagatatatgttggttgcctcaacgaaataagcaagggcagcaccgcagcagcatcaaaacctggaggaccactttgaagtttgagatgtagtggttgtaaatgaaaatcacgtaataaaaaaaacagaattcaggaaaaaaaaaaaaaaaaa

SEQ ID NO: 59030 - protein, 163 aa, Zea mays
  misc_feature: Ceres CLONE 1513835
MASSPLAPTRTCSPLVPRLPRRPSLPSPCRSPRRSARWPRLASVRATPGSSWTAAATEEQKRCLRCGGSYRDEENHPTACAFHGHVTGEKGLFSLSPPHQGIDGEWSDKSGVIVYRWNDEGSRPNTGRANWKRRWSCCQEREEDAPPCQRGWHVSYDDGYTLF

SEQ ID NO: 59031 - DNA, 616 bp, Zea mays
  misc_feature: Ceres CLONE 1513840
  misc_feature: Translation starting site: 149
  misc_feature (189)..(189): n is a, c, t, g, unknown, or other
  misc_feature (190)..(190): n is a, c, t, g, unknown, or other
  misc_feature (198)..(198): n is a, c, t, g, unknown, or other
  misc_feature (209)..(209): n is a, c, t, g, unknown, or other
  misc_feature (228)..(228): n is a, c, t, g, unknown, or other
  misc_feature (235)..(235): n is a, c, t, g, unknown, or other
  misc_feature (236)..(236): n is a, c, t, g, unknown, or other
  misc_feature (313)..(313): n is a, c, t, g, unknown, or other
  misc_feature (314)..(314): n is a, c, t, g, unknown, or other
  misc_feature (316)..(316): n is a, c, t, g, unknown, or other
  misc_feature (317)..(317): n is a, c, t, g, unknown, or other
  misc_feature (321)..(321): n is a, c, t, g, unknown, or other
  misc_feature (322)..(322): n is a, c, t, g, unknown, or other
  misc_feature (378)..(378): n is a, c, t, g, unknown, or other
  misc_feature (379)..(379): n is a, c, t, g, unknown, or other
  misc_feature (380)..(380): n is a, c, t, g, unknown, or other
  misc_feature (381)..(381): n is a, c, t, g, unknown, or other
  misc_feature (382)..(382): n is a, c, t, g, unknown, or other
  misc_feature (408)..(408): n is a, c, t, g, unknown, or other
  misc_feature (412)..(412): n is a, c, t, g, unknown, or other
  misc_feature (414)..(414): n is a, c, t, g, unknown, or other
  misc_feature (415)..(415): n is a, c, t, g, unknown, or other
  misc_feature (421)..(421): n is a, c, t, g, unknown, or other
  misc_feature (455)..(455): n is a, c, t, g, unknown, or other
  misc_feature (462)..(462): n is a, c, t, g, unknown, or other
  misc_feature (506)..(506): n is a, c, t, g, unknown, or other
  misc_feature (551)..(551): n is a, c, t, g, unknown, or other
  misc_feature (552)..(552): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
ggagctccccgcggtggcggccgctctagaactagtggatcccccgggctgcaggaattcgtctcacccctagaaaaacggaatcaactaccagcctcccagcgtcgtccccggcggtgacctggccaaggtgcagcgtgccgtgtgcatgatctccaactccaccagtgttgtggaggtcttctcccnngcatttgnaccaacaaagntttccgaacctcatgtacngccaagnncgcgccttcgtgcactgggtacgtcggtgaaggtatggaaggaaggccaaattctccaaaggtccccggaaaaattnntnntggnngggtgtgggcgttgtgtctcccccctttatggggggagggagtcccccttttattnnnnntttttttccccttccccaaataaaantttntnntttttntaaatttttcaaaacaaaaaaaaaaaaagggggncgggggnttccgcctctttttatttttattttttacaaaaaaaaaagaagnttggagagagaggcgccccgccccacccacggcgggttttggcannaaaaaannnnaaaaaacaaaaaaatccccccccctctttcgtaatgagggcgcgccagagaccc

SEQ ID NO: 59032 - DNA, 789 bp, Zea mays
  misc_feature: Ceres CLONE 1513855
  misc_feature: Encodes the peptide sequence at SEQ ID NO. 59033
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
nnnnnnnnnnnnnnnnnnnnnnnnnngggggggggaaaaatcnnnnnnnntcactctggtactccccgcggtggcggccgctctagactagtggatcccccgggctgcaggaattcgtctcacccctagaaaaaacgttatcgcgcacatctcctgatcctcgttcctctccgccccgcttgcgccgcgcctccgcccccgtctcctgtgagatcagctccggcggcacgcggatatgactacttcaaggcgtcttgctgacaggaagagtgcaaagttccagaagaacatcacaaagaggggttctgtgcctgagaccacggtgaaaaagagcaatgactaccctgttggacctatagttcttggattcttcatttttgtgggcattgaatcatccttgttccagataatcaggacacccacaaggggggggctgggcctgaatttccctgagctaaaaacccgaaattttattctgtaccatgaaactggggagggcactaatctggggttgttgtaccaaaacttgtttcactgggatattgtgagtggcgaaaggttcacctaacctgttcctggtttggcacgaatcctaaaggagctttaaaactggaatggtggttaacccatgcctataggggtgaaaaatatttttataacattaagggggaaataaaccctttgaagccccccagggcgaacgccaactccccaatccccccccctagataaaaataaaggacgggtttaggccggcatatagcagaatgtaattaataaaactacgtg

SEQ ID NO: 59033 - protein, 110 aa, Zea mays
  misc_feature: Ceres CLONE 1513855
  misc_feature (1)..(64): Pfam Name: RAMP4 Pfam Description: Ribosome associated membrane protein RAMP4
MTTSRRLADRKSAKFQKNITKRGSVPETTVKKSNDYPVGPIVLGFFIFVGIESSLFQIIRTPTRGGLGLNFPELKTRNFILYHETGEGTNLGLLYQNLFHWDIVSGERFT

SEQ ID NO: 59034 - DNA, 713 bp, Zea mays
  misc_feature: Ceres CLONE 1513856
  misc_feature: Encodes the peptide sequence at SEQ ID NO. 59035
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
nnnnnnnnnnnnnnnnnnnnnnnnnnggggnnnnnnttattttnnnnntcaaactggggctccccgcggtggcggccgctctagaactagtggatcccccgggctgcaggaattcgtctcacccctagaaaaatccagtcggatctccctctccgaaatcaaggtagcgtacaccgctgcagtttctagagacctctctgccgctcgtgatcccactagtaacaatgcctgccctcgccaagcccgcctcccgcaccgccaagcccgccgcggctccgaagccgaagcctgccgccgcctagacgaaggcggccaccggtggtgcctcccacccgccttacttcgagatgatcaaggaggctatcacggcgctcaaggagaggaccggctccagctcgcaagcgatcgccaagtatgtgggggacaagcacggcgcgtctctgccggccaagttcaagaaaatgctttcgatcctgctccgtggggccgcgcccaagggcgagctcgtgaagggcaaagcttcataaaagctctcggacgccgccaagaaggcatcccccgagacgaaggcttaagccggcaaaggcccgccgctgccaaggaccaccggccccaagcccgcccaaggtcgcccgcccgccaattccaaataatgcaggggggttgccaagccaaaaaaaaggaccgctgccggcttggggaccaattcccca

SEQ ID NO: 59035 - protein, 59 aa, Zea mays
  misc_feature: Ceres CLONE 1513856
  misc_feature (1)..(59): Pfam Name: Linker_histone Pfam Description: linker histone H1 and H5 family
MIKEAITALKERTGSSSQAIAKYVGDKHGASLPAKFKKMLSILLRGAAPKGELVKGKAS

SEQ ID NO: 59036 - DNA, 538 bp, Zea mays
  misc_feature: Ceres CLONE 1513857
  misc_feature: Encodes the peptide sequence at SEQ ID NO. 59037
  misc_feature (342)..(342): n is a, c, t, g, unknown, or other
  misc_feature (343)..(343): n is a, c, t, g, unknown, or other
aaatctggagctccccgcggtggcggccgctctagaactagtggatcccccgggctgcaggaattcgtctcacccctagaaaaaaaagcataccgaccttccttgcattttctcaataccttgaacaactaagcaagtccaatgtctcatgcccagccccttcgtttacaggcccagtggaaacacgtcgatattcaggataaccaagccaatgctatgaaggaaacaggaaccagtggtgggtatggctccccaatgaaagatgacaagaacaaggatgtggatacaatagcttccaaacttcatcaagccttaagcaccggggctttggggcccctcccnngaaaaaacacaaccatgtaccaacctttcccttaaagggtttgctaggggaaaaaatccattactttttttcctttggctggccccaaaaaaaccaaaaggcccccaaatcaaaaaaaaaaaaggcgcctttgacaccctgggaattttttggaaaggaacccctttttttgaaaccctattgggaaaaaaaaaa

SEQ ID NO: 59037 - protein, 78 aa, Zea mays
  misc_feature: Ceres CLONE 1513857
  misc_feature (68)..(68): Xaa is any aa, unknown, or other
MSHAQPLRLQAQWKHVDIQDNQANAMKETGTSGGYGSPMKDDKNKDVDTIASKLHQALSTGALGPLPXKNTTMYQPFP

SEQ ID NO: 59038 - DNA, 692 bp, Zea mays
  misc_feature: Ceres CLONE 1513869
  misc_feature: Encodes the peptide sequence at SEQ ID NO. 59039
ggagctccccgcggtggcggccgctctagaactagtggatcccccgggctgcaggaattcgtctcacccctagaaaaaatcaccaagttttggattccaccatgggcaccgctagaccaggccacacccgctcagcctcctcagttgcacaaccttctccccatctgctcagcctcggctgacattcccgcgaagtgccttctcacggctctaattgatggaccaagtcctcgccctcgtggtcccgctccacgccctctatcttcgacgccggggccacggcgcaagctacggccacgtctgccaaacgcactccagcgacagcgacacgcacgacgggcttcatcacgccgacgcctgccactgcgactatggcctccacgtcctctgctcccacgatggccccagtgccctcacccaccggcggaatgcctgccacacagccccatcggcgcgggagctggtagacaacgcgatagccccagacggaggcgcggcagctctgtactctggctgccacacccagtgacagagaagagatcctcacctcatcatcctgcgccgccgacggcagtctcgtggccatcattagcaccgtggtagcctccagaagggttctacatccgccaagaacgtgtgacatcagatatgtcggtggaaccgtggaggacctacagatgcatgctttgacc

SEQ ID NO: 59039 - protein, 31 aa, Zea mays
  misc_feature: Ceres CLONE 1513869
MASTSSAPTMAPVPSPTGGMPATQPHRRGSW

SEQ ID NO: 59040 - DNA, 674 bp, Zea mays
  misc_feature: Ceres CLONE 1513870
  misc_feature: Encodes the peptide sequence at SEQ ID NO. 59041
aagctggagctccccgcggtggcggccgctctagaactagtggatcccccgggctgcaggaattcgtctcacccctagaaaaaagtgtaacctagccacacgacgcatccgcggttcatcggcctcgcaggaaacgagcgtcgagcaaaaggtcgaattctcaactctcaagcaccagcaggaatcgagcgagcgagcgagcagtgtccgccccccatggccatggtcgcgtccacctccttcgcgtaccacaagccgcgtttcgcggtggtgtgcaggaagaacagggacggccgggacagggagcgggacggcaaggagcacaagcaccccttcaaggtcgtcgagatcacgccgcctccgcggtgcctcggcgtccgctgcttccccaccaacatccactgccacaagagcgtgacgatcgaggggcaggcgtacacggtgtcggcggtgacgcaccggtaccagctgcgcaaggtgcggtacgagccgagcgagaaacgcctctacgttcctctccaccggggggaaacatcctccacctcttacctcccagaaactggttccaaccaggccctaagctacccaaatctgggaatctgggaatgggcaaatcaaagaatccgctttccctccgggggttgggatataaccttagcccttttttttggggg

SEQ ID NO: 59041 - protein, 152 aa, Zea mays
  misc_feature: Ceres CLONE 1513870
MAMVASTSFAYHKPRFAVVCRKNRDGRDRERDGKEHKHPFKVVEITPPPRCLGVRCFPTNIHCHKSVTIEGQAYTVSAVTHRYQLRKVRYEPSEKRLYVPLHRGETSSTSYLPETGSNQALSYPNLGIWEWANQRIRFPSGGWDITLALFFG

SEQ ID NO: 59042 - DNA, 688 bp, Zea mays
  misc_feature: Ceres CLONE 1513878
  misc_feature: Encodes the peptide sequence at SEQ ID NO. 59043
  misc_feature (456)..(456): n is a, c, t, g, unknown, or other
  misc_feature (457)..(457): n is a, c, t, g, unknown, or other
  misc_feature (661)..(661): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (671)..(671): n is a, c, t, g, unknown, or other
  misc_feature (674)..(674): n is a, c, t, g, unknown, or other
aagctggagctccccgcggtggcggccgctctagaactagtggatcccccgggctgcaggaattcgtctcacccctagaaaaactgagggaacttttaatttctgggacaggccaacttgggaggttgaagagcaaatcgaatacaggaactaccaaacatgccagtacaacactactccgcaggaagcttttacagtggctcaagatatcatgaagacgatgctagaaaagggggtcaatgctggtgttggtgcaatgcgatcagtcgatgagacatatggcgtaagagagacaaccaagacggttgctactgccactggaagaacggcagcaaaggtggtaaatggcatcgtcaccagcagctacttctctgcaggagccatgatcttgtctgatgctcttactagggctgccaaggccgcggcagatctggccgctcatggtaggcagaattnnagtgaaaatagacataaaattcatccttttgcagtactaaacatgaggacgaccaccttcaagggatgttgcttgatgtatatttatgacaccacaaccgtgtcgtaaaataaaaaggagcacgacccctgcgttttggaaacaatgggttggtctgaaaaagtttgattattggcgaaaggaagccaatggatcgtggcaaanccaaannntntanaggcaaaaaatcca

SEQ ID NO: 59043 - protein, 117 aa, Zea mays
  misc_feature: Ceres CLONE 1513878
  misc_feature (82)..(82): Xaa is any aa, unknown, or other
MKTMLEKGVNAGVGAMRSVDETYGVRETTKTVATATGRTAAKVVNGIVTSSYFSAGAMILSDALTRAAKAAADLAAHGRQNXSENRHKIHPFAVLNMRTTTFKGCCLMYIYDTTTVS

SEQ ID NO: 59044 - DNA, 667 bp, Zea mays
  misc_feature: Ceres CLONE 1513880
  misc_feature: Encodes the peptide sequence at SEQ ID NO. 59045
aagctggagctccccgcggtggcggccgctctagaactagtggatcccccgggctgcaggaattcgtctcacccctagaaaaaatcccctccctgttctgttccactctccctcttcctcactcccttccccgcctcctcttgccgtacgccacgtctcgagtcccctcgccctctcctcgcctgcgcgctgatccaccgaccgaccgctcgcgacgagtcaaaggggcgaggacccctcgacctcttcctcccagcaacccagcgagcatgacgtgtaccggcggcggccgcggcggcggcgagcactactcgcggcaggtccgcgagctctgcgcgctgctgctcgccatcgtgtacccctccccggcgccgccgcggcagccggtgtcgacgatgtcccctgccacggccgcggccatgctcctcggcgcgtcggtggcgctcatgctctgcggctccgtcaccttcgccatcggcttcctcctcatgccctgggtcgccggcctcacgctcctcttcggcttcgccggctccgtcaacaccctctcctcctcggggctgttcctctgcagcggcagcgggaccaaccagccccccgccgcgggtccctgcaagcacacgcggggacggatcgttcatccggctcgggctgccggggccccaaa

SEQ ID NO: 59045 - protein, 132 aa, Zea mays
  misc_feature: Ceres CLONE 1513880
MTCTGGGRGGGEHYSRQVRELCALLLAIVYPSPAPPRQPVSTMSPATAAAMLLGASVALMLCGSVTFAIGFLLMPWVAGLTLLFGFAGSVNTLSSSGLFLCSGSGTNQPPAAGPCKHTRGRIVHPARAAGAP

SEQ ID NO: 59046 - DNA, 676 bp, Zea mays
  misc_feature: Ceres CLONE 1513891
  misc_feature: Encodes the peptide sequence at SEQ ID NO. 59047
ctccccgcggtggcggccgctctagaactagtggatcccccgggctgcaggaattcgtctcacccctagaaaaagcggcggaaggagaagtgcaaggaagcaggcggccaccatggtgaagggacgcacgggacagcgcgtcaggctctacgtccggggcaccatcctcggatacaagaggtccaagtcgaaccagtacgagaccacgtcgctcgttcagatcgagggggtgaacaccaaggaggacgtcgcgtggtacgctggcaagcgcatggcgtacatctacaaggctaagaccaagagcagcgagacccgctacaggtgcatctggggcaaggtcacccgcccgcacggcaactcgggcgtcgtccgcgccaagttcaagtccaacctcccgcctgagtccatggggcgcaaggtcagagtgttcatgtacccgagcagcatctaaggttaggtttttgttggagtaaaggtggactctaaatggccatgcttagttcttctctctgagcttaaaatgccatgtgttggcaacttagattgttcatgtactgaacctgttgaagttctaccaaaatttgttgtcgaacggctgaacagttgtcctaatgttatgctataaacagagcttatttccccccgtgccaaaaaaaaaaaaaaaaacgagacgctc

SEQ ID NO: 59047 - protein, 112 aa, Zea mays
  misc_feature: Ceres CLONE 1513891
  misc_feature (12)..(106): Pfam Name: Ribosomal_L35Ae Pfam Description: Ribosomal protein L35Ae
MVKGRTGQRVRLYVRGTILGYKRSKSNQYETTSLVQIEGVNTKEDVAWYAGKRMAYIYKAKTKSSETRYRCIWGKVTRPHGNSGVVRAKFKSNLPPESMGRKVRVFMYPSSI

SEQ ID NO: 59048 - DNA, 677 bp, Zea mays
  misc_feature: Ceres CLONE 1513895
  misc_feature: Encodes the peptide sequence at SEQ ID NO. 59049
  misc_feature (544)..(544): n is a, c, t, g, unknown, or other
ctggagctccccgcggtggcggccgctctagaactagtggatcccccgggctgcaggaattcgtctcacccctagaaaaattctctgtcgccttcgcccctccaaggttctctgattccagacgcaaccctgcggctgcggggtcaaggagccagagggggtgcacagcgatcgttctgccggagatcgaaaccctcagctagggtctgaggcgccgggctgcggccgccgagatgtcgacgccggcgaggaagcggctgatgcgggacttcaggcgcctgcagcaggacccgcccgccgggatcagcggcgcgccgcacgacaacaacatcatgctctggaacgccgtcatattcgggccggatgatacgccttgggacggaggcacgttcaagcttaccttgcagtttacagaagattacccaaacaagccaccaactgttcggttcgtctctaggatgtttcatccaaacatatatgctgatggaagcatctgcttggatatcctacagaaccagtggagtcctatatatgatgttgctgncatcttgacttctattcagtccctgctgtggggatcaaacccggactcccctgcaaactcagaaagccgcagactggtcatcgagaacaaacgggaatacacccccaaatcccccaaatttgggaaccaaact

SEQ ID NO: 59049 - protein, 148 aa, Zea mays
  misc_feature: Ceres CLONE 1513895
  misc_feature (8)..(145): Pfam Name: UQ_con Pfam Description: Ubiquitin-conjugating enzyme
  misc_feature: SWISSPROT Homolog: EC 6.3.2.19 Ubiquitin--protein ligase
  misc_feature (104)..(104): Xaa is any aa, unknown, or other
MSTPARKRLMRDFRRLQQDPPAGISGAPHDNNIMLWNAVIFGPDDTPWDGGTFKLTLQFTEDYPNKPPTVRFVSRMFHPNIYADGSICLDILQNQWSPIYDVAXILTSIQSLLWGSNPDSPANSESRRLVIENKREYTPKSPKFGNQT

SEQ ID NO: 59050 - DNA, 730 bp, Zea mays
  misc_feature: Ceres CLONE 1513901
  misc_feature: Translation starting site: 148
  misc_feature: Pfam Name: PsbW_2 Pfam Description: Photosystem II reaction centre W protein (PsbW)
aaagctggagctccccgcggtggcggccgctctagaactagtggatcccccgggctgcaggaattcgtctcacccctagaaaaaagccacggagagcaaaggcagcacactcagctatccagcaaaagagatcgagacgcaggagtcatggccaccgtcagcgccgccgtggtgaccaccatcgttgcccgcgccgcgatcgccaggcccaatgctctagggctgcctgcgctgagggcgaggagcgagagggtgcggtgcacctacgccaaggacgcggccccagtcagcaccaagggcgcaggcgcgtcgctgctcgccgcagcgggtgcggtgaccgcgtcggcggggcccgcgctggcgctcgtggacgagcgcatgtccacggagggcaccgggcttgaacctcgggctcagcaacaacctgctggggtggatcctcctgggggtcttcggcctcatctggtccctctacaccatctacacctctgacctcgacaaggacgaggagtccggtgggctctcgctctagatccacccccccccctgttaatgatcttgaatgtaaacatggtgggccggtcatcggcgggacatttaagaccatgggctattttgctttttaagaatccatccatctcctggtaaataaaggtttgggagaacttcgcctaccgccttgtaaaactactgcccataaaacaacccttttggcgaagaaaaaaaaaag

SEQ ID NO: 59051 - DNA, 699 bp, Zea mays
  misc_feature: Ceres CLONE 1513906
  misc_feature (652)..(652): n is a, c, t, g, unknown, or other
aagctggagctccccgcggtggcggccgctctagaactagtggatcccccgggctgcaggaattcgtctcacccctagaaaaatagtactgcttaactagaactaatcaatattttctttgttcagtgcattcaacgaaacaatcctgattttgggtaattagcagcagcaatacatgatacgtccttgctgaagcctgaacttgattgtcatggaaactggcagtgatttccaaaaaaagaagaagaaagaaacgaactatttaccgacacagctcctcgactactattcattcacacctttctgcgagttctccttcccgattaatgtcgcctacttgtgcagctcattgcttgtggcgtcgctgtggccacctacaacgacggggcaacggatttcacacacacgcctgcttacaagaatcccaatcacaggagttccctgaggagtcggattcatcgagcgctgatgtgttcgaaggcaaacccgactgaggtagcaccagctcttgagtaggactagcaaggaggcccgggggagaaaacttgtctgtcatatcaaggctttagccccagccctttctcgtttggccttaaagaggaaaaaaggttttggttaaaaaccggaaggctaccaaaatttggctgggttnccaacaaactttatttgccccccccgcgggattcgcagccgtctttt

SEQ ID NO: 59052 - DNA, 540 bp, Zea mays
  misc_feature: Ceres CLONE 1513909
  misc_feature (183)..(183): n is a, c, t, g, unknown, or other
  misc_feature (291)..(291): n is a, c, t, g, unknown, or other
ggagctccccgcggtggcggccgctctagaactagtggatcccccgggctgcaggaattcgtctcacccctagaaaaagtgctttcttagaggtgggttggcttctcctccccctccggttcgggttcgggttcgtgaggttctccggggttcggtttcgtgggtgagcggatcgagatggcnggcgtcggatgttgagtaccgctgcttcgtcggcggcctcgcctgggccacggacgaccactccctccacaacgccttcagcacctacgggcgaggtcctcgagtccnagatcatccctcgattcgggagacgcagagggtccggcgggcttcggctttcgtccaccttctccccggagggagggcaatcggaaacgccccttcaagggggctttaaaccgcgaaagggaaatttttgggaaagggccccccaaaatttttccccttttaaaagagggccccacccccccccggggcccctttaaaaaccgcccccccgggggtacccggggggggcccccgaaaaggggggggttt

SEQ ID NO: 59053 - DNA, 687 bp, Zea mays
  misc_feature: Ceres CLONE 1513911
  misc_feature: Encodes the peptide sequence at SEQ ID NO. 59054
ggagctccccgcggtggcggccgctctagaactagtggatcccccgggctgcaggaattcgtctcacccctagaaaaaaggccacttacctgcagtcaccactcccaagccagtacccacagtcctacgagcagtcgcacgcaagtgtcaagagacaaaacggtcgacatggctcgcacgcaatctgccgtagcggtcgccgtggtggccgcggtgctgctgctggcagcggcggcgacgacctcggaggccgccatcacctgcgggcaggtgagctccgccatcgcgccctgcctctcctacacccgcggcacggggtccggcccctccgcgtcctgctgtagcggcgtcaggaacctcaagagcgccgccagcaccgccgccgacaggcgcgccgcctgcaactgcctcaagaacgctgccaggggcgtcagcggcctcgacgccggatacgcccgcagcatcccctccaagtgcggcgtcagcatcccctacaccatcagcacctccaccgactgcttcagggttgagctaaaacctagaccacgcgcgacgacggccgccctgatcgatcgaccaatcattcccgccgttcgcggcgggccggatcatcgatcggcctcagtgatgatatccatcaatctacccggtgaggatcaagggctacctggccaaccgccaatgaac

SEQ ID NO: 59054 - protein, 173 aa, Zea mays
  misc_feature: Ceres CLONE 1513911
  misc_feature (32)..(117): Pfam Name: Tryp_alpha_amyl Pfam Description: Protease inhibitor/seed storage/LTP family
MARTQSAVAVAVVAAVLLLAAAATTSEAAITCGQVSSAIAPCLSYTRGTGSGPSASCCSGVRNLKSAASTAADRRAACNCLKNAARGVSGLDAGYARSIPSKCGVSIPYTISTSTDCFRVELKPRPRATTAALIDRPIIPAVRGGPDHRSASVMISINLPGEDQGLPGQPPMN

SEQ ID NO: 59055 - DNA, 701 bp, Zea mays
  misc_feature: Ceres CLONE 1513917
  misc_feature: Encodes the peptide sequence at SEQ ID NO. 59056
ctggagctccccgcggtggcggccgctctagaactagtggatcccccgggctgcaggaattcgtctcacccctagaaaaaaacgctctccgccgccacttctcctccggcatcgacgaggcgaagccccagcgcccgagtccctctccctgctcccacgacccatggcggcggatatggcgtacgcgccgccgatgaaggcgggcaaggccgggttcgaggctggcatgatggatccgcagcacaggatccgcatcacgctctcctccaagagcgtcaagaacctcgagaaagtctgcggggatctggtgaagggcgccaagggtaaggagctcaaggtcaagggccccgtgcggatgcctaccaaggtgctccacatcaccaccaggaagtctccctgtggagaaggtaccaacacctgggatcgctttgagatgaggatttcacagagggtgatcgatctcgtcagtacaccagacgtttgtcagcagatcacctcaatcaccattgaacccaggtgtcaggtttgaggtgactatcagtgacgcttaatatggtaggcttatcatttcaaaaggcttctaggggaacagaaattttcaatcctaaggggaaaacttgggtaccaagggatcccaggtttttcctattcaaagttataaaatcttatccggggtttcccggaaatggatttacccggtt

SEQ ID NO: 59056 - protein, 121 aa, Zea mays
  misc_feature: Ceres CLONE 1513917
  misc_feature (28)..(121): Pfam Name: Ribosomal_S10 Pfam Description: Ribosomal protein S10p/S20e
MAADMAYAPPMKAGKAGFEAGMMDPQHRIRITLSSKSVKNLEKVCGDLVKGAKGKELKVKGPVRMPTKVLHITTRKSPCGEGTNTWDRFEMRISQRVIDLVSTPDVCQQITSITIEPRCQV

SEQ ID NO: 59057 - DNA, 641 bp, Zea mays
  misc_feature: Ceres CLONE 1513918
  misc_feature: Encodes the peptide sequence at SEQ ID NO. 59058
  misc_feature (247)..(247): n is a, c, t, g, unknown, or other
  misc_feature (255)..(255): n is a, c, t, g, unknown, or other
  misc_feature (298)..(298): n is a, c, t, g, unknown, or other
  misc_feature (308)..(308): n is a, c, t, g, unknown, or other
  misc_feature (315)..(315): n is a, c, t, g, unknown, or other
ctccccgcggtggcggccgctctagaactagtggatcccccgggctgcaggaattcgtctcacccctagaaaaaattcgttgcagtagtcgcagctgacggacgactgaaccaccgacagacaacatggccgcctccgcctccaccgtctccggcctcgccggcgcctccctggccagccgcccggcgttctccaccagcttcacgcggggcagccgggtgatcgcgaagaaccccctgatgagcangaacctgnacagaaatgcaggatcacctgcatgacgttttcccgggactgncttgcgaggnacctgancgtcattcgctttcggctcattcgatggatggggcgttcaaagttcccgggcattaaagggaaaaggcttcgggggttttttttttccaaaattgggcaaagattgggccaattttccaaagcccccgccggtaaccttcaaattttggggggggaaaagaaaagggaccctgggcccttttacagggggccccccttgggcaaaaataattttggggggggggcgcagaaatttttttaaaaaagaaagccgctataaaacaaaacccccccccccggggggcccttttggggggggggccccccccaaaaaaacctgtttgggg

SEQ ID NO: 59058 - protein, 51 aa, Zea mays
  misc_feature: Ceres CLONE 1513918
  misc_feature (41)..(41): Xaa is any aa, unknown, or other
  misc_feature (44)..(44): Xaa is any aa, unknown, or other
MAASASTVSGLAGASLASRPAFSTSFTRGSRVIAKNPLMSXNLXRNAGSPA

SEQ ID NO: 59059 - DNA, 704 bp, Zea mays
  misc_feature: Ceres CLONE 1513922
  misc_feature: Encodes the peptide sequence at SEQ ID NO. 59060
ggagctccccgcggtggcggccgctctagaactagtggatcccccgggctgcaggaattcgtctcacccctagaaaaaggaacgtgttaggcggccgacctcaggcctcaccccttcccacggaggcccccgaccccgagtcgccattgcttgccctcgctcggctcgatccccactctaccgtgccagccaccaaccccgcccgcgcctccgctactaaagccgaggcctcacccaccaggccaccgccatgctcctccccttcctcagatcccacccgctcctccaccacgccgctcgcctgtcctccccgcgcactcgcctgatcctccgccgcgacttgctcccgctcgcgcgctcccggcctatccgcatggcggcccattccggctccggctccggcgccagctcccctgccccagcgccgcctgctgccgtggtgcaaaagtcaaagatcaaattttgccctgcttgtggaagtccaacgaaattggccatacctgatggtgatgagaagatgagggctgtttgttcttcttgtggaggagttcactacgaaaacccaaaaatggttgttggttgccttgtggagcacgataataaggttctcctttgcagaagaaagattgaaccggcttatggtctttggacacttcctgctggttatttagaggtgggggagtctgctgctgaaggagcctcta

SEQ ID NO: 59060 - protein, 110 aa, Zea mays
  misc_feature: Ceres CLONE 1513922
  misc_feature: SWISSPROT Homolog: EC 3.6.1.22 NAD(+) diphosphatase
MAAHSGSGSGASSPAPAPPAAVVQKSKIKFCPACGSPTKLAIPDGDEKMRAVCSSCGGVHYENPKMVVGCLVEHDNKVLLCRRKIEPAYGLWTLPAGYLEVGESAAEGAS

SEQ ID NO: 59061 - DNA, 675 bp, Zea mays
  misc_feature: Ceres CLONE 1513953
  misc_feature: Translation starting site: 193
aagctggagctccccgcggtggcggccgctctagaactagtggatcccccgggctgcaggaattcgtctcacccctagaaaaaaccttgccatcacctcctcgcctagcctgccactgccagcaggtgccaccgccatctctgctctgctctcgcaacgcaagcacacgcccggccgcctgccacagttgccatggcgaccatagccacgatggcgctgctgaagcccgccgccaaggccgcggcgcggtcggcgccgtccaccagcagcggcagcgtctcgctgcgcgtccggacggggcaggccgccaagaaggctgcggtgtccgcgtccgcgtcgtccacgctggcgggcgccttcttcgcggcgctggcgtcgtcgcccgacgctgcgctggcggaacgtcgtggcggcggcggacgccggcggcgacagccgcggccagctgctgctcgtcgtggtggcgcccgccatcgggtgggtgctgtacaacatcctgcagccggcgctgaaccagctgaaccgcatgcgcagcagccaggccgtggccgctggcctgggcctcggcgccgccgccgccgggatggcggccccgcccgaggcctccgccgccgtggtgcaggacctcgcagcaatcgccgccgccgcgcccgccgacgacagccgcggcctcct

SEQ ID NO: 59062 - DNA, 706 bp, Zea mays
  misc_feature: Ceres CLONE 1514154
  misc_feature: Encodes the peptide sequence at SEQ ID NO. 59063
  misc_feature (399)..(399): n is a, c, t, g, unknown, or other
  misc_feature (453)..(453): n is a, c, t, g, unknown, or other
  misc_feature (706)..(706): n is a, c, t, g, unknown, or other
ccgcggtggcggccgctctagaactagtggatcccccgggctgcaggaattcgtctcacccctagaaaaaacagcccctacgtgatccgcgccaaggtggcgctggggctgaaggggctcagctacgagttcgtcgaggaggacctctcccgcaagagcgacctgctgctgaagctcaacccggtgcacaggaaggtgcccgtgctggtccacggcggccgccccgtgtgcgagtcgctcgtcatcctgcagtacgtcgacgagacctgggcaggcaccgggacccctctcctccccgccgacgcctacgaccgcgccatggctcgcttctgggcagcctacgtcgacgacaagttctacaaggagtggaaccggctgttctggtcgacgacggcgganaaggcggcggaagcgctcggcgtcgtcgtccccgtggtggagacgctggagcangcgtttcagggagtgctccaaagggaaaccctttcttcggcggcgacgccggtcgggctcgtggacatcccgctcggggagcttcttgggggtggatcaaggggggtggacaaggccggccggcgttaaagcttctggacaaaggccaagttcccggcctttgaacggcttgggcggagccgcttctttggcgggggaacccccttggaaggaagtgaagggcggaccccccgaaaggcttgtttgaaccccn

SEQ ID NO: 59063 - protein, 87 aa, Zea mays
  misc_feature: Ceres CLONE 1514154
  misc_feature (27)..(27): Xaa is any aa, unknown, or other
  misc_feature (45)..(45): Xaa is any aa, unknown, or other
MARFWAAYVDDKFYKEWNRLFWSTTAXKAAEALGVVVPVVETLEXAFQGVLQRETLSSAATPVGLVDIPLGELLGGGSRGVDKAGRR

SEQ ID NO: 59064 - DNA, 683 bp, Zea mays
  misc_feature: Ceres CLONE 1514173
  misc_feature: Encodes the peptide sequence at SEQ ID NO. 59065
  misc_feature (572)..(572): n is a, c, t, g, unknown, or other
  misc_feature (609)..(609): n is a, c, t, g, unknown, or other
aaagctggagctccccgcggtggcggccgctctagaactagtggatcccccgggctgcaggaattcgtctcacccctagaaaaaactgccagcaggtgccaccgccatctctgctctgctctcgcaacgcaagcacacgcccggccgcctgccacagttgccatggcgaccatagccacgatggcgctgctgaagcccgccgccaaggccgcggcgcggtcggcgccgtccaccagcagcggcagcgtctcgctgcgcgtccggacggggcaggccgccaagaaggctgcggtgtccgcgtccgcgtcgtccacgctggcgggcgccttcttcgcggcgctggcgtcgtcgcccgacgctgcgctggcggacgtcgtggcggcggcggacgccggcggcgacagccgcggccagctgctgctcgtcgtggtggcgcccgccatcgggtgggtgctgtacaacatcctgcagcgggcgctgaaccagctgaaccgcatgcgcagcagcccagccgtggccgctggcctggggctcggcgccgccgcccgccggaatgccgccccgcccgaggncctccgccgccgtggtgcaggacctcgcagcaatcgncgccgccgccgccggccaagacagcccgcggcctcttctggtcatcggcgtcgcgcccccattgcctggggccc

SEQ ID NO: 59065 - protein, 173 aa, Zea mays
  misc_feature: Ceres CLONE 1514173
  misc_feature (80)..(114): Pfam Name: PsbY Pfam Description: Photosystem II protein Y (PsbY)
  misc_feature (137)..(137): Xaa is any aa, unknown, or other
MATIATMALLKPAAKAAARSAPSTSSGSVSLRVRTGQAAKKAAVSASASSTLAGAFFAALASSPDAALADVVAAADAGGDSRGQLLLVVVAPAIGWVLYNILQRALNQLNRMRSSPAVAAGLGLGAAARRNAAPPEXLRRRGAGPRSNRRRRRRPRQPAASSGHRRRAPIAWG

SEQ ID NO: 59066 - DNA, 736 bp, Zea mays
  misc_feature: Ceres CLONE 1514182
  misc_feature (1)..(1): n is a, c, t, g, unknown, or other
  misc_feature (216)..(216): n is a, c, t, g, unknown, or other
nagagctggagctcaccgcggtggcggccgctctagaactagtggatctcttgggctgcaggaattcgtctcacccctagaaaaaaggggccatcagatccaagaagagggaagagcaccaaggaccttcggcgcccgttcaggatccacatcttcccgagcgagttcttggttgacctcttcctcttcggaccacctccaaggctcttggtgtancttgccactctcaccaatcaatttttcctgtctgatctccaccttccgatcccaactgccttccattccttcccagagggggaagacgggtaattttcgtcccctcctcgcgccaatgaactccttaaacccgccccattttttttcccccccccccggggggggggggggggcctccccacccccttcaacctcccccccccccctaaactcaaaaacattaaaaacgttccccgcctcccccgccgcgcccagtcatccctacacccgatcccgggcttcagccccgcgacacgcgctccctctccgccctcccttactaccaatcaccccacgtccttcgcgccatcccccccgatcactcccttatcatctttaattgcgccccatcacccgccctcaaatctataccccacccgccccccccactaattaatttcattaccgcccgcgcccgtggactatctcctaccgagcccgccccccccctgttttattccgccccccccccctccccccg

SEQ ID NO: 59067 - DNA, 685 bp, Zea mays
  misc_feature: Ceres CLONE 1514186
  misc_feature: Translation starting site: 135
  misc_feature (363)..(363): n is a, c, t, g, unknown, or other
  misc_feature (395)..(395): n is a, c, t, g, unknown, or other
cgcggtggcggccgctctagaactagtggatcccccgggctgcaggaattcgtctcacccctagaaaaacttctccgcgcactccacccaactcgccgccgccgctgccaacgccgcctgctgccgcagccgccatgggggcgtacaagtatgtgtcggaactatggaggaggaagcagtcggacgtgatgcgcttcgtgcagcgcgtgcgctgctgggagtacaggcagcagccgtccatcgtccgcctcaccaggcccacccgccccgacaaggcccgtcgtctcggctacaaggccaagcagggatatgttgtctaccgtgtccgtgtgaagcgtggtggcaggaagaggcctgtgcccnagggtattgtctatggcaagcccaagcaccanggtatcacccagctcaagttccagaagaacaagaggtctgtcgctgaggagagagctggacgtaaccttggtggactgagggttcttactcctactgggtgaatgaagatagtacctacaagtactttgagatcatctttgtggacgttgcccccaagccatccaacctgacccgaggatcaactggctatgcaaccctggtgccaagcaccggggagctccgggggctccactcaccaagaaaaaattaccggggtctgggtggaaggggcccccccacacaaaaacag

SEQ ID NO: 59068 - DNA, 740 bp, Zea mays
  misc_feature: Ceres CLONE 1514193
  misc_feature: Encodes the peptide sequence at SEQ ID NO. 59069
ctccccgcggtggcggccgctctagaactagtggatcccccgggctgcaggaattcgtctcacccctagaaaaaagtagtgtcatcccgtcttccctcacccagtcaccctgacgggacggcaagcggcggaggcgctgtcatccgctggtcccttttctttccgcgcgcatggcgagagtcttggccgccgtctggccgatcgttaaaggctgcatcaccggcggcgtgttcggcatcaccatcgccgactggagcgcctcctacgtcaccttgcacggcgcctccatgcaccccaccttcgacccgcagcaggccgaatgcgctctggtagataaacgctgcctccaccgctaccacttctcccgcggggacgtcgtcgtcttcaggtcgcccaccccccatcgggaagtggtggtgaagaggctgattgcgctgcctggggattgaacccagatcccggagaaacaggagatccggccgatcccccaagggcgctgctgggttgaaggggacaatgcccccaccagctttaaccccgatcctattggcccggttcctatggggccggtaacgggccagggtccccccataattctgggccccccacccaaattggccaaaatttacagggaaatgcccccagagaagggatggtgcccccggggccccggaaaggttgggtaactccggcattcccttttccccttggaagggtttaggaaaatcccttttggaaat

SEQ ID NO: 59069 - protein, 92 aa, Zea mays
  misc_feature: Ceres CLONE 1514193
  misc_feature: SWISSPROT Homolog: EC 3.4.21.89 Signal peptidase I
MARVLAAVWPIVKGCITGGVFGITIADWSASYVTLHGASMHPTFDPQQAECALVDKRCLHRYHFSRGDVVVFRSPTPHREVVVKRLIALPGD

SEQ ID NO: 59070 - DNA, 684 bp, Zea mays
  misc_feature: Ceres CLONE 1514195
  misc_feature: Encodes the peptide sequence at SEQ ID NO. 59071
  misc_feature (497)..(497): n is a, c, t, g, unknown, or other
  misc_feature (535)..(535): n is a, c, t, g, unknown, or other
  misc_feature (541)..(541): n is a, c, t, g, unknown, or other
  misc_feature (615)..(615): n is a, c, t, g, unknown, or other
aaagctggagctccccgcggtggcggccgctctagaactagtggatcccccgggctgcaggaattcgtctcacccctagaaaaaagccatggatgagggggtcttcttatgacccgtgcaccgaaaggcactccaccgtgtactacaaccgcccggaggtgcagcgggctctccacgccaacgtcaccgccggcgccggcgccatgaactacacgtgggcgacctgcagtgacaccatcaacaacaactggggagattcacccaagtccgtgctccacatctacaaggaactcattgcagccggactcagaatatgggtcttcagtggagatacggacgcggtagtccccttgacagcgacaaggtactccatcgacgccttgaaccttccaaccgtcgtcagctggtacccttggtacgacgccaaggagcagcagaagcagcagcaggaggttggtggatggagccaggtgtacgaggggctgaccctggtgacngtccgaggggcggggcacgaggttcctctcccacgccngaggcnagcgctcatcctgtttcgccacttcttgcgtgggaaacctatgccgcctaagaacgaactgctgtgtatgtaantagtgttgttttatcggcgttattaatgatgcaaaataaaatatcgcccgctttcgcctaaaaaaaaaa

SEQ ID NO: 59071 - protein, 173 aa, Zea mays
  misc_feature: Ceres CLONE 1514195
  misc_feature (1)..(161): Pfam Name: Peptidase_S10 Pfam Description: Serine carboxypeptidase
  misc_feature: SWISSPROT Homolog: EC 3.4.16.6 Carboxypeptidase D
  misc_feature (148)..(148): Xaa is any aa, unknown, or other
  misc_feature (150)..(150): Xaa is any aa, unknown, or other
MRGSSYDPCTERHSTVYYNRPEVQRALHANVTAGAGAMNYTWATCSDTINNNWGDSPKSVLHIYKELIAAGLRIWVFSGDTDAVVPLTATRYSIDALNLPTVVSWYPWYDAKEQQKQQQEVGGWSQVYEGLTLVTVRGAGHEVPLPRXRXALILFRHFLRGKPMPPKNELLCM

SEQ ID NO: 59072 - DNA, 649 bp, Zea mays
  misc_feature: Ceres CLONE 1514201
  misc_feature: Encodes the peptide sequence at SEQ ID NO. 59073
  misc_feature (131)..(131): n is a, c, t, g, unknown, or other
  misc_feature (435)..(435): n is a, c, t, g, unknown, or other
cgcggtggcggccgctctagaactagtggatcccccgggctgcaggaattcgtctcacccctagaaaaaacatccaaaattcccagtccgcgatacaagaccaatccaatccccagcggaagtgggaagcnagtttcatttccttccttgcagctagcagcgatgattcttgtggcgatagtggcggagctgctcgaggagtacaccgcgctggtggcgcgggtgctggagcagctgctcaacgacgcgccgttcccgcgccggatgcgcttcctcatgctgcggagcctccccttcgtgccgccgcctctgcccccgccgccgccgccgcacgccctccacgttaccacccgagtctgattatgggctccatttttctcaggggtttcagcctactgcccgccatggccgcccacccactagcctgcgcttgangcagctagtagtagatactgtaggttgaccagtgatccacggtgtgttccccgctttcccttttggctgtggatttccaatggctaaactacacggtgctggaaaggaatcaattaattccggcttttgaagccccccatttgggggaaaaatttttggaaaaacgggaccctggggaaaaaatttttcctttggcaaaaaaaaaaaaaaaaag

SEQ ID NO: 59073 - protein, 65 aa, Zea mays; identical to SEQ ID NO: 44442
  misc_feature: Ceres CLONE 1514201

SEQ ID NO: 59074 - DNA, 668 bp, Zea mays
  misc_feature: Ceres CLONE 1514222
  misc_feature: Encodes the peptide sequence at SEQ ID NO. 59075
  misc_feature (316)..(316): n is a, c, t, g, unknown, or other
  misc_feature (387)..(387): n is a, c, t, g, unknown, or other
  misc_feature (389)..(389): n is a, c, t, g, unknown, or other
cagagctggagctccccgcggtggcggccgctctagaactagtggatcccccgggctgcaggaattcgtctcacccctagaaaaaaaacaaggagcgctacatccaggccagcagtttccatttgcaatccgaccccatcttcatcccgttgtcgcagcagcagccatccaagcagcgatggacggcggcaagaagagccggaacccgcacatgcctccgcggactaccgcagcgaccgcaagtcagcctccgggatgagcggcgaccccaagaagggcggccgcggcggcaagttcacctgggagggcgccaacnactacggctacggctacgccgacgaggacctcggcctcatctccaagaaaggcaacatgaggaggcggacncnctagccaggtccagggaggcccccccgctaagaaggacgacgaccagtaggccttcgccgcctcggctcgcccgcccggtcccgtcaatcgccagcaaaaaccaacaagcccttctggctggttaaattcaggaatcggttcgaatctcagggtggaaaaaccaggaaccggggggggttagggggcccggcctcccagataaggaaggggaacgccccggctagacacgagacacgcccccagaagccctggggggggataggagggggccaggcacg

SEQ ID NO: 59075 - protein, 44 aa, Zea mays
  misc_feature: Ceres CLONE 1514222
  misc_feature (21)..(21): Xaa is any aa, unknown, or other
MSGDPKKGGRGGKFTWEGANXYGYGYADEDLGLISKKGNMRRRT

SEQ ID NO: 59076 - DNA, 719 bp, Zea mays
  misc_feature: Ceres CLONE 1514232
  misc_feature (719)..(719): n is a, c, t, g, unknown, or other
agagctggagctcaccgcggtggcggccgctctagactagtggatcccccgggctgcaggaattcgtctcacccctagaaaaacaatggagcggctacacaaggccccgtggcgatcacaaaaaaggagcctatatccatgtactagaattattcagtttcactccacatcgtgatgttttatttttacttttgtcgtgctataacggatagcgctcctcgttggcgccactggcgggtggttctgcctctggtctggtgtgtttgtgtgtggtcacacttgccagccagcagaggcgcctgcttgtacctagattactgtttccattgtcgtcatcatcggctaacattgtcataatgtcagtttggggaatgttaaatttacgtaattatttgtgttccccccccccccgtgggaaaaaaaatcacaatgacgcaatacattgtgttggttgttatggaggtaagcattagggcccttaatctgggccatcacgataaatgcccagaagagacatgagcccggcccttctccgacgccccccattctccccctataaggagaggatttaaaccccccccccagggggcccattttttaaaaaaacctgatagggaaaaaaaaccccggggactcccccaccaatcattgcgtagcagacagaaacttccccttttttttcccgagggggggagaaacaacaagaaaaaaatccgccn

SEQ ID NO: 59077 - DNA, 693 bp, Zea mays
  misc_feature: Ceres CLONE 1514236
  misc_feature: Encodes the peptide sequence at SEQ ID NO. 59078
gctctgaactagtggatcccccgggctgcaggaattcgtctcacccctagaaaaaaaccaaggagcgctacctccaggccagcagtttccatttgcgatccgaccccatcttcatcccgttggcacagcatcagctgtcccagcggcgatgcacggccggcagaagacctggaccccgcatatgcctccgcggactaccgcagcgaccgctagtccgcctccgggatgagcggcgaccccaagaacggcggccgccgcgggaaggttcacctggaagggcgccgactactgcggtaccgggtacttccgacgaggacctggggggtcatctcggagaaaagggaacaccaccagcggacgggagtatacagggttagtgccgccccccccccccccaagaagggaggactaaccagccgggactcggggccggcgggtttcgccaatctcgggccccgccaacccgcaaggaaagcgcgtgggaggcctttgcttttccgtgcccgtccctacgcgtgcgggggcggttcgtacggagggatttatttttgccccgatgcggcgtttacggcgtatggggtccccgcccattgtacctacctcctttgtgtttgggccagagcggtgcgtgccgggatgcttgtgaggggtaagcccagcgcccccgggaccgctacttgttagacccccgcg

SEQ ID NO: 59078 - protein, 152 aa, Zea mays
  misc_feature: Ceres CLONE 1514236
MSGDPKNGGRRGKVHLEGRRLLRYRVLPTRTWGVISEKREHHQRTGVYRVSAAPPPPKKGGLTSRDSGPAGFANLGPRQPARKARGRPLLFRARPYACGGGSYGGIYFCPDAAFTAYGVPAHCTYLLCVWARAVRAGMLVRGKPSAPGTATC

SEQ ID NO: 59079 - DNA, 667 bp, Zea mays
  misc_feature: Ceres CLONE 1514248
  misc_feature: Encodes the peptide sequence at SEQ ID NO. 59080
aaagctggagctcacgcggtggcggcgctctagacagtggattcttgggctgcaggattcgtctcaccttagaaaagacgctcgacgcctctcctcctctcctcccccacccgtccatcgcccctccctccggtctgcgctcccacagcctcacccctgcgcccccgccgattcgcgtcgccctttgttggaaggaacgatggagcacaccttcatcatgatcaagcccgacggcgtccagcggggcctgatcggggacatcgtcggtcttttccagaagagggggtcgaccttaaggggatgagattcatgaccgggtaaaggtctttcccccccaacccttcattcggctggccgacgggggtgtcctccgtaagttggggggaaaacacgcgcccccccccaaaaagtacgaaaatcggggggcgcagcgcaacggaagttaggccgcccccggcgctcgccgacccctttcggggatgaccatttcccgtgcgacagtcccccgcggggggcgccgtcccgggggtttctgatgccgccacgagcgccgtccccgaagcgtttccccgcgtagctgttccgcgcaagtttccgcccccgcgcgggcagtcgcgcttgtgggcctgacgcccgtccctcccggtgcgttatttgccccgccccc

SEQ ID NO: 59080 - protein, 34 aa, Zea mays
  misc_feature: Ceres CLONE 1514248
  misc_feature: SWISSPROT Homolog: EC 2.7.4.6 Nucleoside-diphosphate kinase
MEHTFIMIKPDGVQRGLIGDIVGLFQKRGSTLRG

SEQ ID NO: 59081 - DNA, 670 bp, Zea mays
  misc_feature: Ceres CLONE 1514257
  misc_feature (310)..(310): n is a, c, t, g, unknown, or other
  misc_feature (389)..(389): n is a, c, t, g, unknown, or other
  misc_feature (390)..(390): n is a, c, t, g, unknown, or other
  misc_feature (394)..(394): n is a, c, t, g, unknown, or other
  misc_feature (396)..(396): n is a, c, t, g, unknown, or other
aaagctggagctccccgcggtggcggccgctctagaactagtggatcccccgggctgcaggaattcgtctcacccctagaaaaaaactaatccaattagtagtaagtattttcttttttatttaatagtctctgactatcattaaataaagggtagagcaattcttttttctagagattctagagaaagtgagacaaagtgaagcgaaagagttttctttgtataagaattaggtctatatcatatctaaatagaagggaaatcaaaaagaagggaagtggggattacattggatgaatccttaaggaanacatatcccaaaagaaataagggctaaagtaagcgctccttgcctttggtttgagcaaacagattcgtgtggccccgannaaananagaacttccggataattgacaatgccaacttgaattgaccaattcatttcccccttttcccaattaaaggggaggccctttatgtttcccgctttacaaaaatggaaattttttgggacatttcccaacaaaacgccagcccttattcccatttttgggaaatttgggggatttcggggcgtgttgtaccccccggtttaggggaaggcgcccccccaaaaaccctttcctttttctttcgaaacccggggattcgagggggcccccctggggg

SEQ ID NO: 59082 - DNA, 703 bp, Zea mays
  misc_feature: Ceres CLONE 1514259
  misc_feature: Encodes the peptide sequence at SEQ ID NO. 59083
ggagctccccgcggtggcggccgctctagaactagtggatcccccgggctgcaggaattcgtctcacccctagaaaaaaagagcaccaaggaccttcggcgcccgttcaggatccacatcttcccgagcgagttcttggttgacctcttcctcttcggaccacctccaaggctcttggtgtagcttgccactctcaccaatcaagttttcatgtctgatctcgacattcagatcccaactgccttcgatcccttcgctgaggccaatgctggggactctggtgcggcagcagggtcaaaggactacgtacacgtgcgcatccagcagcgtaatggtcgcaagagcctgactaccgtccagggattgaagaaggagttcagctacagcaagatcctcaaacatctcaagaaagagttctgctgcaatggtacagtggtccaggacccacaacttggacaggtcattcagctccagggtgatcagaggaagaacgtctcgaatttcctcgtccaggccggcattgtgaagaaggagcacatctagattcatggtttctgagcaacccccgggtccatagcaaaccaacccctgcatgcagggccagccttataatatataatatcctgagggggaacaacatctatcccggcctgggaccttacaaccaagccttgttacctccgccctgcgcgttccctcctaa

SEQ ID NO: 59083 - protein, 110 aa, Zea mays
  misc_feature: Ceres CLONE 1514259
  misc_feature (27)..(108): Pfam Name: SUI1 Pfam Description: Translation initiation factor SUI1
MSDLDIQIPTAFDPFAEANAGDSGAAAGSKDYVHVRIQQRNGRKSLTTVQGLKKEFSYSKILKHLKKEFCCNGTVVQDPQLGQVIQLQGDQRKNVSNFLVQAGIVKKEHI

SEQ ID NO: 59084 - DNA, 698 bp, Zea mays
  misc_feature: Ceres CLONE 1514260
  misc_feature: Encodes the peptide sequence at SEQ ID NO. 59085
aaagctggagctccccgcggtggcggccgctctagaactagtggatcccccgggctgcaggaattcgtctcacccctagaaaaaatgtgcatctcagcagcactagcagtgacaaactcgaagcttgccttctagcttgtttacaccccaaaactaaaactagagtcggcggcggcaacaagcggtacgtagaggatgaagagcaggagcagcactctgttggtgatcctagttctccaggcccttctgctctctgcggctgtggccaaaggacctgcagggccgaagaagcagtgctggtgcggcgagtgcaccagctggtcgggcgtgtggacctgcgacgacctcctcaccaagtgcgccgccacctgcaagaactgcgtccccgtctccacggacaagggcgccaccaagtacagatgccgcgacttcctccccgaaaactgcggctgcaagatccactagagactcatccaatcaaccatggccacagccgatggacccttcttccatatgcatgctctcctccgtccgtccgcctagcttgctacaagcaggcgctaataagctagcaagctgttgttgttgttttgcatgtttgattgggtgtcccttcccagtagagatggcaatggggacccgatccccgattcccctgcggggattccctctataggggacggggatggggaaatttc

SEQ ID NO: 59085 - protein, 89 aa, Zea mays; identical to SEQ ID NO: 3974
  misc_feature: Ceres CLONE 1514260

SEQ ID NO: 59086 - DNA, 685 bp, Zea mays
  misc_feature: Ceres CLONE 1514263
  misc_feature: Encodes the peptide sequence at SEQ ID NO. 59087
atagctggagctcaccgcggtggcggccgctctagactagtggatttcttgggctgcaggaattcgtctcacccctagggaggtcccatctcacggctagctagcacaagcatagtgcaggggcttgccacctaagtaaggcccgcctgagagccatggcatccaaggccgtcctcttcttggctctcaacctcctgttcttcacggtggccaacgcctgcggcaactgcccgaccccaacgcccccggtcgagccaccgccgccgcctcctgctgctaccccacccccttcgtccagcggcaagtgcccgctgaacgcgctcaagttcggcgtgtgcgccgatgtgctcggcctcgtcaaaggcgaggctggcaaggtgcctgccgagccatgctgtaccctcctcaaaggccttgcggacttcgaggccgccgtctgcctctgcacggccatcaaggccaacgtgctcggcgtcgtcctcaatgtccccatcaagctcagcgccctcgtcaactactgtggcaagtgcgtgcccaagggctacttgtgcgctaaagcacctcccggccgtcacaccctcgtaactgttcccgtaccaaataacctatccccccacccctgcaaggcaccgaaggcatgcctttgggtccgcctgaaatacttcccccggtctcaccttgcatt

SEQ ID NO: 59087 - protein, 176 aa, Zea mays
  misc_feature: Ceres CLONE 1514263
  misc_feature (51)..(132): Pfam Name: Tryp_alpha_amyl Pfam Description: Protease inhibitor/seed storage/LTP family
MASKAVLFLALNLLFFTVANACGNCPTPTPPVEPPPPPPAATPPPSSSGKCPLNALKFGVCADVLGLVKGEAGKVPAEPCCTLLKGLADFEAAVCLCTAIKANVLGVVLNVPIKLSALVNYCGKCVPKGYLCAKAPPGRHTLVTVPVPNNLSPHPCKAPKACLWVRLKYFPRSHLA

SEQ ID NO: 59088 - DNA, 736 bp, Zea mays
  misc_feature: Ceres CLONE 1514268
  misc_feature: Encodes the peptide sequence at SEQ ID NO. 59089
  misc_feature (318)..(318): n is a, c, t, g, unknown, or other
acccgcggtggcggccgctctttactagtggatcccccgggctgcaggaattcgtctcacccctagaaaaactctccgtgctttctcagaggtgggttggcttctcctcccccaccggttcgtgttcaggttctggttcgtgggcgagagggaagagatggcggcgtcggacgttgagtaccgttgcttcgttggcggcctcgcctgggccaccgacgaccactccctcaacaacgccttcagcacctacggcgaggtcctcgagtcgaagatcatcctggatcgggagacgcaaaggtcccgcggcttcggcttcgntgccttctccacggaggacgcgatgcgcagcgccatccagggcatgaacgggtaggagctcgacggtcgcatcatcaccgccaaccatgcccagtcccgcggcggccgtggaggcggcggtggcggatacggtggcgggcgccgtgatggaaggcggctaccgcggtggcggtggaggctaccgcaggtggtcgggaaggttccggcggcggtggggggaatacggtggtgcaaaccgtgggggcggctttcgggaccaaccactgggaacttggaaaaactgaacggtggggggtccccttaagggctaatttttccttggtgcgctttcggcttaccgtggttccccccaagtcttgagagggggttttaccttccccccgggggcccccccccgtggctcccgattgtttccgtt

SEQ ID NO: 59089 - protein, 71 aa, Zea mays
  misc_feature: Ceres CLONE 1514268
  misc_feature (10)..(72): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (54)..(54): Xaa is any aa, unknown, or other
MAASDVEYRCFVGGLAWATDDHSLNNAFSTYGEVLESKIILDRETQRSRGFGFXAFSTEDAMRSAIQGMNG

SEQ ID NO: 59090 - DNA, 684 bp, Zea mays
  misc_feature: Ceres CLONE 1514271
  misc_feature: Encodes the peptide sequence at SEQ ID NO. 59091
  misc_feature (562)..(562): n is a, c, t, g, unknown, or other
  misc_feature (564)..(564): n is a, c, t, g, unknown, or other
  misc_feature (571)..(571): n is a, c, t, g, unknown, or other
caaagctggagctccccgcggtggcggccgctctagaactagtggatcccccgggctgcaggaattcgtctcacccctagaaaaacctccgacggcgccgacaaaaccagaccatcaaacaagtgccagcgccctctcgcagtcgccgcaatggagagcaccttcatcatgatcaagcctgacggcgtccagaggggcctcattggtgagatcatcagccgttttgagaagaagggcttctacctcaaggccttgaagcttgtgaacgtggagaggtcgtttgctgagaagcactacgccgatctcgcctccaagcccttcttccagggcctcgtggactacatcatctctggccctgtggtggccatggtctgggagggcaagagcgtcgtcacaactggccgcaagatcattggcgccaccaaccccctggcttctgagcccggcaccatccgtggcgactttgctgtcgacattggcaggaatgtcattcatggaagtgacagcattgagagtgctaataaggagattgcccctgtgttccccgagggccctgctgatngnagagcanccagcacccctggatctacgagaagtaaaactggaaagttcccatcaaaccttgaagccagagaagcatgtcccctttgtgctttagcaaggttttcaaaaaataatgatctt

SEQ ID NO: 59091 - protein, 178 aa, Zea mays
  misc_feature: Ceres CLONE 1514271
  misc_feature (2)..(134): Pfam Name: NDK Pfam Description: Nucleoside diphosphate kinase
  misc_feature: SWISSPROT Homolog: EC 2.7.4.6 Nucleoside-diphosphate kinase
  misc_feature (138)..(138): Xaa is any aa, unknown, or other
  misc_feature (141)..(141): Xaa is any aa, unknown, or other
MESTFIMIKPDGVQRGLIGEIISRFEKKGFYLKALKLVNVERSFAEKHYADLASKPFFQGLVDYIISGPVVAMVWEGKSVVTTGRKIIGATNPLASEPGTIRGDFAVDIGRNVIHGSDSIESANKEIAPVFPEGPADXRAXSTPGSTRSKTGKFPSNLEAREACPLCALARFSKNNDL

SEQ ID NO: 59092 - DNA, 773 bp, Zea mays
  misc_feature: Ceres CLONE 1514273
  misc_feature: Encodes the peptide sequence at SEQ ID NO. 59093
  misc_feature (313)..(313): n is a, c, t, g, unknown, or other
  misc_feature (358)..(358): n is a, c, t, g, unknown, or other
  misc_feature (390)..(390): n is a, c, t, g, unknown, or other
  misc_feature (432)..(432): n is a, c, t, g, unknown, or other
  misc_feature (434)..(434): n is a, c, t, g, unknown, or other
  misc_feature (435)..(435): n is a, c, t, g, unknown, or other
  misc_feature (472)..(472): n is a, c, t, g, unknown, or other
  misc_feature (492)..(492): n is a, c, t, g, unknown, or other
  misc_feature (493)..(493): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (547)..(547): n is a, c, t, g, unknown, or other
  misc_feature (552)..(552): n is a, c, t, g, unknown, or other
  misc_feature (594)..(594): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (644)..(644): n is a, c, t, g, unknown, or other
  misc_feature (678)..(678): n is a, c, t, g, unknown, or other
  misc_feature (679)..(679): n is a, c, t, g, unknown, or other
  misc_feature (720)..(720): n is a, c, t, g, unknown, or other
  misc_feature (772)..(772): n is a, c, t, g, unknown, or other
cgagctggagctccccgcggtggcggccgctctagaatagtggatcccccgggctgcaggaattcgtctcacccctagaaaaacagacggcgcccacaaaaccagaccatcaaacaagtgccagcgccctctcgcagtcgccgcaatggagagcaccttcatcatgatcaagcctgacggcctccagaggggcctcattggtgagatcatcagccgttttgagaaaaagggtttctcaccccacgccttgaagcttgtgaacgtggagagcgcgtttgctgagaagcgctacatcgatctagcttataatccncttcttccaggcaccccacggccctacacctcttccagcccttgnggtggtgtttgtgtttttatggtaattatggntgggtggtgtggtggtgtatagcccctctcgatgtaaattcncnngccctcctcatctccaaggcctccccaaccccggatnttcccccccccgcctgtttnncatccacctccccctccccgttccgcggccccgctccttccnnngcgcccggtncccanagcaggacacccctaggcctcccccccacgatcgccgcgggncagtgtcgatagaacacggaaccacccaagnnnntctatttatcttttangccccgcacccgtaaacaaccccattgtattagnnccccctcaccgaaccgcaaatagccggccgtataattgacnatagcacctcctgcacatccacacccgacttttctaaccaagtacgagaagng

SEQ ID NO: 59093 - protein, 88 aa, Zea mays
  misc_feature: Ceres CLONE 1514273
  misc_feature (2)..(74): Pfam Name: NDK Pfam Description: Nucleoside diphosphate kinase
  misc_feature: SWISSPROT Homolog: EC 2.7.4.6 Nucleoside-diphosphate kinase
  misc_feature (71)..(71): Xaa is any aa, unknown, or other
  misc_feature (82)..(82): Xaa is any aa, unknown, or other
MESTFIMIKPDGLQRGLIGEIISRFEKKGFSPHALKLVNVESAFAEKRYIDLAYNPLLPGTPRPYTSSSPXGGVCVFMVIMXGWCGGV

SEQ ID NO: 59094 - DNA, 708 bp, Zea mays
  misc_feature: Ceres CLONE 1514275
  misc_feature: Encodes the peptide sequence at SEQ ID NO. 59095
aagctggagctccccgcggtggcggccgctctagaactagtggatcccccgggctgcaggaattcgtctcacccctagaaaaaatccaccatcacacagcaatccacacaagcacttcgacgtcacacgggcgctgcgcacagacacaccaagcgtcggcaccaatggcttactaccaggaggtggactactgctcggaggaggtgaggtcggtggccccggccggcttcggccgccacggcggcggcgtccagcagcacgtcgtcaaggagaagttcgaggaggtcgacacggtctcacgcgccggcgccaaccaccaccaccaccatggtcaccacggcggccacggcttcgtggtgcgcgagaccagggtcgaagaggacatcaacacctgcaccggccaaccccacgagcgcagggagagcttcctcgccagggctaactgagccgcccggcggccggcatccaccccccgtcgggcttgcctgcgtgccctaatgaatgccgtggttgactggttgtgcagggtcatcgtaatttggttaacgaacgtgcacccacctcacctcctgtacaaatacgacaataagctcctgacctgaaaaaaaaaaaaaaaaaaaaaaccagacccttcaaggacccaaattccccctaaaaggaggtctaattaccccccctccctggccggcgtttttaaaacgccgtggg

SEQ ID NO: 59095 - protein, 93 aa, Zea mays
  misc_feature: Ceres CLONE 1514275
MAYYQEVDYCSEEVRSVAPAGFGRHGGGVQQHVVKEKFEEVDTVSRAGANHHHHHGHHGGHGFVVRETRVEEDINTCTGQPHERRESFLARAN

SEQ ID NO: 59096 - DNA, 651 bp, Zea mays
  misc_feature: Ceres CLONE 1514277
  misc_feature: Encodes the peptide sequence at SEQ ID NO. 59097
aaagctggagctccccgcggtggcggccgctctagaactagtggatcccccgggctgcaggaattcgtctcacccctagaaaaaatctcagcagtgacgaactcgaagcttgcgttcttgtagtagaggtcggcagcaagcggtggtagagcgagaggtcgagaagatgaagagcagcactctgttggcgatcctagttctccaggcccttctggtctctgcggccgtggccaaaggacctgcagggccgacgacgaagaagcagtgctggtgcggcgagtgcaccagctggtcgggcgtgtggacctgcgacgacctcctcaccaagtgcgccgccacctgcaagaactgcgtccccgtgtccacggacaagggggccatcaagtacaggtgccgcgacttcctccccgaaaactgcggctgcaagatccactagagactcatccaattccaccatggccgcgcgccacagcggcacagccgatggatccttccatgttcctccgtccgtccgccttgctacaggcaggcagccacaccaataagctagctcctgggtggtggtttgaatgtttggatggggggccccttcccagtccaaaatggaataaataaaatcctcccgggcccaaaaaaaaaaaaaaaaaaaaa

SEQ ID NO: 59097 - protein, 89 aa, Zea mays; identical to SEQ ID NO: 58327
  misc_feature: Ceres CLONE 1514277

SEQ ID NO: 59098 - DNA, 684 bp, Zea mays
  misc_feature: Ceres CLONE 1514282
  misc_feature: Encodes the peptide sequence at SEQ ID NO. 59099
  misc_feature (537)..(537): n is a, c, t, g, unknown, or other
  misc_feature (540)..(540): n is a, c, t, g, unknown, or other
  misc_feature (643)..(643): n is a, c, t, g, unknown, or other
aaagctggagctccccgcggtggcggccgctctagaactagtggatcccccgggctgcaggaattcgtctcacccctagaaaaagtagagaactggttgagagagaggaagcagcagcaggacgccctacctaagcacaccgatcctgtgctgctcgtatcagatctgaagaagaaagctgaagcacttgacaggttctgcaaaccgatcatgactaaaccaaagccagctccgaagccacagactccgccaccacatactccacctccacagcctgaagcccaagcatctgaccctcaaacaccagaacaacaacaaagcgggactggtgcagctggtgagccgggtagtgagggaggtgtgcagcaggcctccggtgagcaaatggacatggacaggcccgatgattctgcggatgttgcggcataattgtggttgtggttgtcatctgtcttatgatcgatcaaaattttctgtttgtctggtaggtggatgagttaaaggcacagcatattctcccaagcgatttcgttttanggnttggaaaacatgagatgaggtaatgcgtcttgtccccagcgtgttttgtctggactgtgaatcagaatagaacgttgcatgatcgaattgcgccatagatctncatatcaaaaacgtggatgattcgacaaaaaaaaaaaaaaa

SEQ ID NO: 59099 - protein, 142 aa, Zea mays
  misc_feature: Ceres CLONE 1514282
KAGAPRGGGRSRTSGSPGLQEFVSPLEKVENWLRERKQQQDALPKHTDPVLLVSDLKKKAEALDRFCKPIMTKPKPAPKPQTPPPHTPPPQPEAQASDPQTPEQQQSGTGAAGEPGSEGGVQQASGEQMDMDRPDDSADVAA

SEQ ID NO: 59100 - DNA, 695 bp, Zea mays
  misc_feature: Ceres CLONE 1514304
  misc_feature: Encodes the peptide sequence at SEQ ID NO. 59101
aaagctggagctccccgcggtggcggccgctctagaactagtggatcccccgggctgcaggaattcgtctcacccctagaaaaacccactcctgcagtccttctccacctagctcccccgcgccaagaacacgccagctagcaagcgcgctcgatcgaataccgttaccgtgtcgccatggccgccaccgcgtctctatcagccgtcggggcgccgctgtcggtgcccgggctcaggaagccgctcggcgtgtcgtcgctccggcccctgcagccgagggcggcgaggatgacgacgacggccgtgcgggcgtcggcgtcgccctcgtccacgtccatcaaggagaaggctgcggccgggctgaccgcggcggcccctggcgggccgcgctgggtgcctggccgggaaggtccccggaaaggccgccgccaagtcccgggggggggttttcaggcccgtctcgcttcaaaaaaatttttcctcccttaaaaatttctgtgtcccgggggggggggccccgcccccccctttgggaaattttgtgggggggccccccttttttccccccccttttccccaaatattttaaccccccccctaaaaaaaggggggttcctttattccggaaaaaaccccccccctgtataaaaaaaaaatttcccctccccccccctgtgtttttttttttttttttc

SEQ ID NO: 59101 - protein, 103 aa, Zea mays
  misc_feature: Ceres CLONE 1514304
MAATASLSAVGAPLSVPGLRKPLGVSSLRPLQPRAARMTTTAVRASASPSSTSIKEKAAAGLTAAAPGGPRWVPGREGPRKGRRQVPGGGFQARLASKKFFLP

SEQ ID NO: 59102 - DNA, 719 bp, Zea mays
  misc_feature: Ceres CLONE 1514308
  misc_feature: Encodes the peptide sequence at SEQ ID NO. 59103
ggcggccgctctagaactagtggatcccccgggctgcaggaattcgtctcacccctagaaaaaccagcaacagccaacatatctcctcgcattttccttgcaaccgattgcctatccccctcccaacccaagaccgatggcgcccaaggccgagaagaagcccgcggcgaagaagccggcggaggaggagcccgcggcggagaagacgaccgccgggaagaagcccaaggcggagaagcgggtccccgcgggcaagtccgccggcaaggagggcggcgagggcaagcgtggcaagaagaagggcaagaagagcgtggagacgtacaagatctacatcttcaaggtgctgaagcaggtgcacccggacatcggcatctcgtccaaggccatgtccgtcatggactccttcatcaacgacatcttcgagaagctggccggcgaggccgccaagctcgcgcgctacaacaagaagcccaccatcacgtcccgcgagatccagacctccgtgcgcctcgtgctccccggcgagctcggcaaggacggcgtctctgaagggccccagggcggtcaccaagttcacctcctcctaggcttgcccgctcgccctttggaaggatctccttgggttgatggtccccctgttggagttatatgttggctggtttctcctggcagggggctgctccaaaaatgggtcttggaacccctgcaagggcctt

SEQ ID NO: 59103 - protein, 194 aa, Zea mays
  misc_feature: Ceres CLONE 1514308
  misc_feature (57)..(127): Pfam Name: Histone Pfam Description: Core histone H2A/H2B/H3/H4
MAPKAEKKPAAKKPAEEEPAAEKTTAGKKPKAEKRVPAGKSAGKEGGEGKRGKKKGKKSVETYKIYIFKVLKQVHPDIGISSKAMSVMDSFINDIFEKLAGEAAKLARYNKKPTITSREIQTSVRLVLPGELGKDGVSEGPQGGHQVHLLLGLPARPLEGSPWVDGPPVGVICWLVSPGRGLLQKWVLEPLQGP

SEQ ID NO: 59104 - DNA, 658 bp, Zea mays
  misc_feature: Ceres CLONE 1514310
  misc_feature: Encodes the peptide sequence at SEQ ID NO. 59105
aagctggagctccccgcggtggcggccgctctagaactagtggatcccccgggctgcaggaattcgtctcacccctagttattgcgcccgtcgcctccctttccccttccctccctccctctccccgcgggccgccagaggcaatttcgccctcgattcgaccccgattcgtccgcccgcgaccgggattccctccgccaagcgcggatctgaacgctgcgctccgtgtcgccgctcgaatccgccatgaagggggccaaatccaagggcgccgccaaggccgatgccaagctggcggtgaagagcaagggggcggagaagcccgccaagggcaggatagggaaggccggcaaggaccccaacaagcctaagagggcgcccagcgctttcttcgtgttcatggaagaactccgcaaggagttcaaggagaagaaccctaagaacaagtctgtagctgtcgggtggtggtgcaatgatggtgagcggaaggtgcggccgccggtgctgctgcatctgggggggcctgctgccaaggctcccaaggaggagaaggaggaagaagaaaaggaagaaagccgccacgacctggggattccccctggtccaactaaaaggggggggggccatcctggatcccaaaaagggggggcttgggccc

SEQ ID NO: 59105 - protein, 137 aa, Zea mays
  misc_feature: Ceres CLONE 1514310
MKGAKSKGAAKADAKLAVKSKGAEKPAKGRIGKAGKDPNKPKRAPSAFFVFMEELRKEFKEKNPKNKSVAVGWWCNDGERKVRPPVLLHLGGPAAKAPKEEKEEEEKEESRHDLGIPPGPTKRGGGHPGSQKGGAWA

SEQ ID NO: 59106 - DNA, 754 bp, Zea mays
  misc_feature: Ceres CLONE 1514312
  misc_feature: Encodes the peptide sequence at SEQ ID NO. 59107
  misc_feature (157)..(157): n is a, c, t, g, unknown, or other
  misc_feature (317)..(317): n is a, c, t, g, unknown, or other
  misc_feature (323)..(323): n is a, c, t, g, unknown, or other
  misc_feature (483)..(483): n is a, c, t, g, unknown, or other
tccccgcggtggcggccgctctagaactagtggatcccccgggctgcaggaattcgtctcacccctagaaaaagatttcgaaggagactgtttcataaacaggagccaggcaccggactttccaggaggataccacctcccgaacatggtgcgtcgnacgacccgccaccggggcagccccgataccccacctcgccgacgtcggtcgcgggctgctactcgcgtgcgtgctcgcgggcgctgcctcctcactcccagtagccgagtcgtcctgcccgcgatactactcactggggagagacatagtctgaatgcancagcgncactactggatggaaggattctcgcatgatactgtcacaggtgctcttgctcacgggacgaaggagggtgcaaatgcggctaccatccatttggtccagggtcgaggtaccccactccaccttgcattctttgtggacgaggttttcaattgtccttcangggggaagggcaacgctccttactccgggtccagctccgctgaaataccccaggacagcccgcaggaaggttcctgtcctttcagaaatacacatttttccatcccctggtaaatgattccccctcgggtccgggaattcctactgggcacgaagatttggcgagtttcttgtgatcataccgcgccccaccggtcaagatcttttaatcccatggatcggaatatggcctctaccgctgcaaagctgaaatccccctacttccgggaaga

SEQ ID NO: 59107 - protein, 94 aa, Zea mays
  misc_feature: Ceres CLONE 1514312
  misc_feature (2)..(2): Xaa is any aa, unknown, or other
  misc_feature (58)..(58): Xaa is any aa, unknown, or other
MXQRHYWMEGFSHDTVTGALAHGTKEGANAATIHLVQGRGTPLHLAFFVDEVFNCPSXGKGNAPYSGSSSAEIPQDSPQEGSCPFRNTHFSIPW

SEQ ID NO: 59108 - DNA, 634 bp, Zea mays
  misc_feature: Ceres CLONE 1514315
  misc_feature: Encodes the peptide sequence at SEQ ID NO. 59109
  misc_feature (634)..(634): n is a, c, t, g, unknown, or other
tggagctccccgcggtggcggccgctctagaactagtggatcccccgggctgcaggaattcgtctcacccctagaaaaactacgcggtacgcgcacacagccaaaccatcctcctctccgccgcccgccgcagcagcacccaccgggcaagatgaagacgatcctggcgtcggagacgatggacatcccggagggcgtcacggtcacggtggccgccaagctggtcacggtggagggcccccgcggcaagctcacccgcaacttcaagcacctcaacctcgacttccagctgcaggaggccggccgcaagctcaaggtggacgcctggttcggcacccgccgcaccatggccgccatccgcaccgccatctcccacgtccagaatctcatcaagggggtcaccaaaggctaccgctacaagatgaggttcgtctacgcccacttccccatcaacgcctccatcaccaacagcaacaccgcaatcgagatcaggaacttcctcggcgagaagaaggtcaggaaagtggacatgcttgatgggctggccatcctccggtccgagaaagtccaggatgagctcatcccttgacgaaacgacgtcgaacttggtatttcgatccgccgcccttataan

SEQ ID NO: 59109 - protein, 145 aa, Zea mays
  misc_feature: Ceres CLONE 1514315
  misc_feature (12)..(86): Pfam Name: Ribosomal_L6 Pfam Description: Ribosomal protein L6
MKTILASETMDIPEGVTVTVAAKLVTVEGPRGKLTRNFKHLNLDFQLQEAGRKLKVDAWFGTRRTMAAIRTAISHVQNLIKGVTKGYRYKMRFVYAHFPINASITNSNTAIEIRNFLGEKKVRKVDMLDGLAILRSEKVQDELIP

SEQ ID NO: 59110 - DNA, 717 bp, Zea mays
  misc_feature: Ceres CLONE 1514317
tccccgcggtggcggccgctctatactagtggatcccccgggctgcaggaattcgtctcacccctagaaaaaataccctaacctactcctccgccggtccgccgccgctcagcctcagcgtgtcttcctccgccacggcgaaccgggggctcatcgatcggattcaaatttcgatcagggtggacgtcaagggcaacgcggacgtggccgccggcgctccgaatacgaggacgttgcgtaaggacagttaccgcggcgtccaccaatatgcgcttctcaacatgtcgaaggacgagcatcacacgttatttagcgtaagcaccacctagaaagttcgtaaatggctccgagcacgacgcccttgacggtcatgaagacttctgctcaaggccataaacgaccctcctgcgggtgagaagcaagactcagtcgggacacatctctgtaacatgatcattgtgccctgcgatgattgactagcgttgttggggtctacatcgtgccggagattcaacagggtggagatcacgcctgagatgaatggccactagctttgctgacttccccatctcctataagccgggcaagcctggcacgcccggcatcggtgccacccactcctcgcggttaataccccagaatgagctgtaccgggctgtgtgtgttccacgatgcctggggaaagccctccgacccttcttatggttttaaaaggta

SEQ ID NO: 59111 - DNA, 684 bp, Zea mays
  misc_feature: Ceres CLONE 1514319
  misc_feature: Encodes the peptide sequence at SEQ ID NO. 59112
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
tagagctggagctccccgcggtggcggccgctctagaactagtggatcccccgggctgcaggaattcgtctcacccctagaaaaaaagcttaaagcaagcagatctaagctccaggcagcgtcgcgacagagtgagtgagtagcacgacaacaacaatggcttccctgaaggccgcgaagcccagcggagttgcggcgcagggcaaggagccggcgcccaagctcagcgagacggcgacgaagccgtcagccgcgaagagcggcggcgttaagaaggctgagcagaagccccgggaaaccaaaaggaaggtgaagagcagcaaaccggcggcggcggccaaaaagtgacgtacagtacgtgtggagtgtaatggagcttccatgcatgcatgagtggatccatgccatgttatgaatctagtccttcctttcttgtatcttccatgtgacgcggcgtgtgcgtcccttcatgtgtgatgatgccagatgaatactacaaataagacgttgtgactgtgccatcgtcgcctccttcatgcgtcnnnnnnnnnnnnnannnnnnnnnnnnnnnnnnnnnnnnnnnnnnnnnnnnnnnnnnnttnnnaaaaaaaaaaaaccggacgctcgaggacccaattcgccctatagtgagtcgaatacgcgcgctcactggccgtcgtttta

SEQ ID NO: 59112 - protein, 63 aa, Zea mays; identical to SEQ ID NO: 8705
  misc_feature: Ceres CLONE 1514319

SEQ ID NO: 59113 - DNA, 632 bp, Zea mays
  misc_feature: Ceres CLONE 1514324
  misc_feature: Encodes the peptide sequence at SEQ ID NO. 59114
gagctccccgcggtggcggccgctctagaactagtggatcccccgggctgcaggaattcgtctcacccctagaaaaatctcctttctcacacctcgacgcctctctctctttccccgagctctcgaaaccctaggtgcgtgccgaccggcggcggcggcgaggtgatggcgatggacccggacgcggtggcgaaagccttcgtggagcactactaccggacgttcgacaccaaccgcgcggcgctggtggggctgtatcaggagacctccatgctcaccttcgagggccagaagttccagggcccatccgccattgccggcaagctcggatctcttcccttccaggcctgcgagcaccagatcgtcaccgtcgactgccagccgtcggggccccagggaggcatgctcgtcttcgtctccggttccatccgcaccggccccgatgagcaccccatcaagttctctcaggcattccatttgctgccggcagctgggtccttcttcgtgcaaaaagacttgttccccctgaactatggctaaaagacagcccgaaaactccctgtgatgaaacaaaatttggtgaggggccttctttgttgaagaccatgaaattcccgaactggccccccgct

SEQ ID NO: 59114 - protein, 124 aa, Zea mays
  misc_feature: Ceres CLONE 1514324
  misc_feature (8)..(121): Pfam Name: NTF2 Pfam Description: Nuclear transport factor 2 (NTF2) domain
MAMDPDAVAKAFVEHYYRTFDTNRAALVGLYQETSMLTFEGQKFQGPSAIAGKLGSLPFQACEHQIVTVDCQPSGPQGGMLVFVSGSIRTGPDEHPIKFSQAFHLLPAAGSFFVQKDLFPLNYG

SEQ ID NO: 59115 - DNA, 645 bp, Zea mays
  misc_feature: Ceres CLONE 1514328
aaagctggagctccccgcggtggcggccgctctagaactagtggatcccccgggctgcaggaattcgtctcacccctagaaaaaatcctactgtcacacacacacagagagagacaagtggtttccaaagccaagtgtgtactagcagtctagcaaccagctagctcgggcggcagcaggcagccatcatgtcggaggagaacaccaccacttcttcaaccaccacaagaaggacgaggagcagcccgccggcgagtacgggtactccgagaccgaggtggtcaccgccaccggcgagggcgagtacgagaggtacaagaaggaggagaaggagcacaagcacaagcagcacctcggcgaggccggcgccatcgccgccggcgccttcgcactctacgagaagcacgaggcgaagaaggaccccgagcacgcgcacaggcacaagatcacggaggaggtcgctgccgcggcggccgtcggcgccggcggctacgtattccacgagcaccaccagaagaagaaggaccacaaggacgcccgaggaggctagcggcgaaaaagaaacccccccacctcttccgcctgaaccgtatacccggccgggcccgcgaaccaaacttgctaggctccgggcgcacaccaccc

SEQ ID NO: 59116 - DNA, 708 bp, Zea mays
  misc_feature: Ceres CLONE 1514329
agagctggagctccccgcggtggcggccgctctagaactagtggatcccccgggctgcaggaattcgtctcacccctagaaaaaagcagttgcgattgccagtcccccaaactatggtgctggccctgacgtctccaatggcgtctctctccttccactccgggaggatctcggaggcatctattggaggcgtcggtcctactcgcacggcggccccggcgggcgtatccgactcaccgttcctccggagcaacttcggctcgtcctcctacacgacgagctgctccggctctgcctccaccgcatcactcgcggcgaatggctccgcgtctctggcaagtacggccacctcctcgattgcagggtcatctacgggaatcgagttcagctactttatactgacaccacgtagatgcccgaggcatgcagatcatggctggagaggctgccctactgatgaccaagaggtccagggcctagcaagtctctttgccgtacccctggcctccctaagccaaatgctgaatactttcttgaagggaagaactggaggctcacgcccccccaaaaaaggaaggttttttgcccaggacaaacctccaaagtgggaagaaaccaccctctaattaaacccgcaattcaaggggttaccccctggcccccgaatttccactttaaaaaaaatttaaccccccccctgtgaaaacg

SEQ ID NO: 59117 - DNA, 720 bp, Zea mays
  misc_feature: Ceres CLONE 1514330
  misc_feature: Encodes the peptide sequence at SEQ ID NO. 59118
  misc_feature (71)..(71): n is a, c, t, g, unknown, or other
  misc_feature (72)..(72): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (90)..(90): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
tccaccgcggtggcggccgctctagaactagtggatcccccgggctgcaggaattcgtctcacccctagannannnnnnnnnnnnnnnanaannnnnnaaaaaaaaaaaaaaaaaaaaaaaaaaaatttacaataaatagtattgggtactgaagttgacaaaaaatgaccgcaggaagctgtactccaactttggtttattgtatccatatggccacaaaaaattggccgtttgtgaaaatgttgaccaggttcgtggtgcaatggagaattacccaccataccagtctatattttccaggatttcatatggagaaagtcagatgttggataaggcattttatgagggagaagtcaagaggctatgcttgtcctttgagcagcagttccactacgctgttttcttcgcttacatcaggctccgcgagcaggagatcaggaacctgaatgtgatctctgaaatgtgtcgctcaaaaccaaaagtcccgggtccatgacagtgtcgtcttcatattctgagaacccccgcacctatattgtatgtacaaaatgcctgctttgatgatgcccatccgctcaacattaaaatcgggacttataattatcccattccctccgttaaaccccgcttaaaaatgcaaaacctggagtgaaggatatttggtttgagaccaaaaaagggggaatatctgccacaaaataaaaacttgggattttgga

SEQ ID NO: 59118 - protein, 77 aa, Zea mays
  misc_feature: Ceres CLONE 1514330
  misc_feature: SWISSPROT Homolog: EC 3.6.3.14 H(+)-transporting two-sector ATPase
MENYPPYQSIFSRISYGESQMLDKAFYEGEVKRLCLSFEQQFHYAVFFAYIRLREQEIRNLNVISEMCRSKPKVPGP

SEQ ID NO: 59119 - DNA, 683 bp, Zea mays
  misc_feature: Ceres CLONE 1514335
  misc_feature: Encodes the peptide sequence at SEQ ID NO. 59120
  misc_feature (69)..(69): n is a, c, t, g, unknown, or other
ctccccgcggtggcggccgctctagaactagtggatcccccgggctgcaggaattcgtctcacccctangaaagcctcctgtcgctcgctctccctgtctcccgcacgccgacccgcagccgccgccgttcgccatgggtttcctcgacgcgctctaccgtgtggtgatgcgccgcaacgccgtctacgttaccttcgtcgtcgccggcgctttcgcgggcgagcgggcggtggactacggcgttcacaagatctgggagatgaacaacctcggggaaaaggtacgaagacatatcggttttgggggcagaggcccagctgaggaatgataaaattttggtcaccagtgttgcttcgggtttgacccgttttcagtgttggcaccggtaataaacgaatgttaaactttacgcctgcttcctattgaccctcctttctcatttcggtttacctcctgaaaaatgctttttgttgggggaatttccgtgggggcatggattttgaaacctggttaagggcttttgtttccggttaagctccttcaatccaaccatcccatggtgggatttggaaggggggattttgagaataggtttttggaaatcccccaaaaccaaggtccaaaacctttccttctccacaattttttttcccaaatcctctattcccaatctccaatattg

SEQ ID NO: 59120 - protein, 64 aa, Zea mays
  misc_feature: Ceres CLONE 1514335
  misc_feature (4)..(53): Pfam Name: UCR_UQCRX_QCR9 Pfam Description: Ubiquinol-cytochrome C reductase, UQCRX/QCR9 like
MGFLDALYRVVMRRNAVYVTFVVAGAFAGERAVDYGVHKIWEMNNLGEKVRRHIGFGGRGPAEE

SEQ ID NO: 59121 - DNA, 700 bp, Zea mays
  misc_feature: Ceres CLONE 1514342
  misc_feature (179)..(179): n is a, c, t, g, unknown, or other
  misc_feature (182)..(182): n is a, c, t, g, unknown, or other
  misc_feature (246)..(246): n is a, c, t, g, unknown, or other
  misc_feature (269)..(269): n is a, c, t, g, unknown, or other
  misc_feature (272)..(272): n is a, c, t, g, unknown, or other
  misc_feature (305)..(305): n is a, c, t, g, unknown, or other
  misc_feature (307)..(307): n is a, c, t, g, unknown, or other
  misc_feature (387)..(387): n is a, c, t, g, unknown, or other
  misc_feature (389)..(389): n is a, c, t, g, unknown, or other
  misc_feature (390)..(390): n is a, c, t, g, unknown, or other
  misc_feature (402)..(402): n is a, c, t, g, unknown, or other
  misc_feature (418)..(418): n is a, c, t, g, unknown, or other
  misc_feature (433)..(433): n is a, c, t, g, unknown, or other
  misc_feature (441)..(441): n is a, c, t, g, unknown, or other
  misc_feature (454)..(454): n is a, c, t, g, unknown, or other
  misc_feature (455)..(455): n is a, c, t, g, unknown, or other
  misc_feature (456)..(456): n is a, c, t, g, unknown, or other
  misc_feature (492)..(492): n is a, c, t, g, unknown, or other
  misc_feature (493)..(493): n is a, c, t, g, unknown, or other
  misc_feature (524)..(524): n is a, c, t, g, unknown, or other
  misc_feature (525)..(525): n is a, c, t, g, unknown, or other
  misc_feature (545)..(545): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (558)..(558): n is a, c, t, g, unknown, or other
  misc_feature (560)..(560): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (639)..(639): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
aaagctggagctccccgcggtggcggccgctctagaactagtggatctctcgggctgcaggaattcgtctcacccctagaaaaaccctagaaaaatctcagcagtgacgaactcgaagcttgcgttcttgtagtagaggtcggcagcaagcggtggtagagcgagaggtcgagaagatnaanagcagcactctgttggcgatcctagttctccaggcccttctggtctctgcggccgtggccaaangacctgcagggccgacgaccaanaancattgctgttgcgccgagtgcaccagctggtcngncgtgtgaacctgcgacgacctcctcacccattgcgcccccacctgtattaacccccccccccgggggggggggggggggncnntcatctatttcnatattccccccccttnctcccccaagaacgnggtccgcnaggccgccttggnnnctctttccaattgcaccgttgcagcgcccccaccgnngcgcccgcccaggggtccccccgcggcccgnncctccggccgctctgcttgntatnnnggtgggntngttagggaaccaacgactgacctccgcccgctcccttcccctnnngtacgctcctcctcgcccgattcgccctcctgcncgcccgcaacggcgcgcgaaatannnnattagtggaccgggggcaccaccccccccgcgcg

SEQ ID NO: 59122 - DNA, 686 bp, Zea mays
  misc_feature: Ceres CLONE 1514347
  misc_feature: Encodes the peptide sequence at SEQ ID NO. 59123
  misc_feature (387)..(387): n is a, c, t, g, unknown, or other
  misc_feature (393)..(393): n is a, c, t, g, unknown, or other
aaagctggagctccccgcggtggcggccgctcatacatagtggatcccccgggctgcaggatttcctctcacccctagaaaaaacgcgaatcctccaatctgcccttgccgccgccgccgacggatccaggtctgtagactgctcactcctctacgctccgctccgaatggcccgcacgaagcagacggcgcgcaagtcgaccggcggcaaggcgccgcggaagcagctggccaccaaggcggcgcgcaagtcggccccggccacgggcggcgtgaagaagccgcaccgcttccgccccggcaccgtcgcgctccgcgagatccgcaagtaccagaagagcactgagctgctcatccgcaagctccccttccagggggtgggccgcnagatcncgcaggacttcaagaccaacctgcggttccagtcgtcggcgggggcggcgctgcaggaggccgcggaaggctacctggggggggctcttctaggaaaccaaccttcggggccatccacgccaagaggggtcaccatcctgccctaggaactcccgtttccctcccgcatcaggggccaaaaggttttggcctcccccgggggtggttcggggttggggagagttgaagaaggggggggttgctttcatggcacggcttatccggggagatggggtttttcttacctcggatgg

SEQ ID NO: 59123 - protein, 123 aa, Zea mays
  misc_feature: Ceres CLONE 1514347
  misc_feature (74)..(74): Xaa is any aa, unknown, or other
  misc_feature (76)..(76): Xaa is any aa, unknown, or other
MARTKQTARKSTGGKAPRKQLATKAARKSAPATGGVKKPHRFRPGTVALREIRKYQKSTELLIRKLPFQGVGRXIXQDFKTNLRFQSSAGAALQEAAEGYLGGALLGNQPSGPSTPRGVTILP

SEQ ID NO: 59124 - DNA, 647 bp, Zea mays
  misc_feature: Ceres CLONE 1514352
  misc_feature: Encodes the peptide sequence at SEQ ID NO. 59125
ctggagctccccgcggtggcggccgctctagaactagtggatcccccgggctgcaggaattcgtctcacccctagaaaaaaaaaaaaggatcggttccaacaccagccgccgtcatgtcgaagcgaggtaggggaggttcggctgggaacaagttccgcatgtcactgggtctaccggtggcggccacggtgaactgcgcggacaacacgggcgccaagaacctctacatcatctccgtcaagggcatcaagggccgcctcaaccgcctcccgtccgcctgtgtcggcgacatggtcatggccaccgtaaagaacggaaagcccgacctcaggaagaaagtgatgcccgccgtcatcgtccgccagcgcaagccgtggcgtcgcaaggacggtgtctacatgtacttcgaatataatgctggagtgatcgtgaatcccaacggtgagatgaaaagctctgcaatcactgggactatcagccaagaagtgtgctgaccctttggcctaggatcgccagtgcagcaaatgccatcgttttgagagcttgttggaaatgtgtttagacctaaataagatcttcccaaattgtcggttgccaggtgttgtaaaggtgctattggaacttgaatgctcccttttatgtttga

SEQ ID NO: 59125 - protein, 126 aa, Zea mays
  misc_feature: Ceres CLONE 1514352
  misc_feature (19)..(126): Pfam Name: Ribosomal_L14 Pfam Description: Ribosomal protein L14p/L23e
MSKRGRGGSAGNKFRMSLGLPVAATVNCADNTGAKNLYIISVKGIKGRLNRLPSACVGDMVMATVKNGKPDLRKKVMPAVIVRQRKPWRRKDGVYMYFEYNAGVIVNPNGEMKSSAITGTISQEVC

SEQ ID NO: 59126 - DNA, 636 bp, Zea mays
  misc_feature: Ceres CLONE 1514354
  misc_feature: Encodes the peptide sequence at SEQ ID NO. 59127
ctggagctccccgcggtggcggccgctctagaactagtggatcccccgggctgcaggaattcgtctcacccctagaaaaagtctccgcatttccatcctgtcgtgggatcccagccaccgccgctagaagaagagctcggcgattcccaggtcccgcgagaatatgccgaagcagatccatgagattaaggacttcctcctcaccgcgaggaggaaggatgcccgctcagtgaagatcaagaggagtaaggatgttgtcaagttcaaggtgcgctgctccaagtacttgtacacgctctgcgtcttcgatgctgagaaggcaaacaagttgaagcaatctcttcccccaggtttgaccgtcgaggaggtctgattggatacatggcaacgccgagttgaactacccaagcttctttatcagtagcagagcatgctactctatgtacttttggaacctaagctattagacctgtcagtgttggatgtctggatcttgcattttttggagaaataccaatttacctccgttcaaagatgcaagtatattttcttgtttaacctgcccatttacttttttattttgtgcccggtttcccccaaaaaaaaaaataaaaaccgagacgcctcgaaggtaac

SEQ ID NO: 59127 - protein, 69 aa, Zea mays; identical to SEQ ID NO: 8575
  misc_feature: Ceres CLONE 1514354
  misc_feature (2)..(69): Pfam Name: Ribosomal_L38e Pfam Description: Ribosomal L38e protein family

SEQ ID NO: 59128 - DNA, 723 bp, Zea mays
  misc_feature: Ceres CLONE 1514358
  misc_feature: Encodes the peptide sequence at SEQ ID NO. 59129
tccccgcggtggcggccgctctagaactagtggatcccccgggctgcaggaattcgtctcacccctagaaaaactctcgcgccgccgcggaacacaacaccgcaccacactacccagcggaatccgcccacccgcacccgcacccggagcagaggagatatgtcgcaggggaagggaggagcggcgaggaaggaggaggtggtcaccaaggagtacaccatcaacctccacaagcgcctccacggctgcacattcaagaagaaggcacccaacgccatcaaggagatcaggaagtttgcgcagaaggccatgggcaccacggacattaggatcgatgtgaagctcaacaagcacatctggagcagcgggatcaggagcgtgccgcggagggttcgtgtgaggatcgcccgcaagaggaacgacgaggaggatgccaaggaggagctctactcccttgtcaccgtcgcagagatccccgccgagggcttgaaagggctggggaccaaggtcgttgacgaaaccgattaagctgtcgcgttatctacatctttagagagttcctagtttgtatttgcaacagcaagaccttgtgtattcacaaagttgtctatttccgcaacagaactgcatggctagatttcgtttcattgctgctgcatcctttttctcattatcgccccctgggaagtcgctgctcatggggacagtttggaatctccatgg

SEQ ID NO: 59129 - protein, 122 aa, Zea mays
  misc_feature: Ceres CLONE 1514358
  misc_feature (10)..(104): Pfam Name: Ribosomal_L31e Pfam Description: Ribosomal protein L31e
MSQGKGGAARKEEVVTKEYTINLHKRLHGCTFKKKAPNAIKEIRKFAQKAMGTTDIRIDVKLNKHIWSSGIRSVPRRVRVRIARKRNDEEDAKEELYSLVTVAEIPAEGLKGLGTKVVDETD

SEQ ID NO: 59130 - DNA, 625 bp, Zea mays
  misc_feature: Ceres CLONE 1514359
  misc_feature (407)..(407): n is a, c, t, g, unknown, or other
atagctggagctccccgcggtggcggccgctctagaactagtggatcccccgggctgcaggaattcgtctcacccctagaaaaaacaactcgcagatcgagtccaagcattcaccggaggatcccaaatcacactctccagtaaccgtccgcttctccagccgcatctctagccgagtctatctcctcctcctccgccgccgccgcaactatcctaatggctcgcttcgccgtggtcgccgccatcgtcgccctcctcgccgtcgtcgcggcggcgcaggccccgaccacagctcccaaggccgcgcccaggatggccccgctgccgcctccccctgcgcggtcccggccacagccccggcgccggccgccaagccgccggccgccaagccgccgaccgccgcggcnccgtcaccggtgggctctcctccggcccgcccacgagggccccgccgcctctgcgccgtccggaagagtcgacctcgtcgtctccaccaccccggcgtgggccccaccgtcgcgccctccgggagggcggcgcctcgggggcctccgcctctggttgtcgccgtcgccgggcgggtccacccccctctggtccagaccctccccggggggccgggtgg

SEQ ID NO: 59131 - DNA, 607 bp, Zea mays
  misc_feature: Ceres CLONE 1514363
  misc_feature: Encodes the peptide sequence at SEQ ID NO. 59132
  misc_feature (382)..(382): n is a, c, t, g, unknown, or other
ctccccgcggtggcggccgctctagaactagtggatcccccgggctgcaggaattcgtctcacccctagaaaaattcaccgtccacgttccatatggcttcctgcaggatggcactcctccttggcttgctgctgctagtagtagcttcgcccgcgatcgctgatgacgactccggtatctactaccagctggctcttatgtggccaggagcatactgcgagcagaccagcgctgggtgctgcaagccgaccaccggcgtctcgccggcgcgcgacttctacataacgggcttcaccgtccttaacgcgaccaccgacgctgcagtgacgggatgcagcaacaaagttccttacgaccctaacctgattaccggcatccaangcctgaatcattactggagcaacatcaggtgccccagcaacaacgggcagagcagctgggagaacgcctggaagaaggccggcgcctgctccggcctcagcgagaaagactacttcgagactgccctctccttccgtagccggatcaaccccctcgttccgctcaaagccaaagggatcgagccggaacttcgggctctacgggcctcaggcaatcaccaagggc

SEQ ID NO: 59132 - protein, 171 aa, Zea mays
  misc_feature: Ceres CLONE 1514363
  misc_feature (30)..(171): Pfam Name: Ribonuclease_T2 Pfam Description: Ribonuclease T2 family
  misc_feature: SWISSPROT Homolog: EC 3.1.27.1 Ribonuclease T(2)
  misc_feature (97)..(97): Xaa is any aa, unknown, or other
MASCRMALLLGLLLLVVASPAIADDDSGIYYQLALMWPGAYCEQTSAGCCKPTTGVSPARDFYITGFTVLNATTDAAVTGCSNKVPYDPNLITGIQXLNHYWSNIRCPSNNGQSSWENAWKKAGACSGLSEKDYFETALSFRSRINPLVPLKAKGIEPELRALRASGNHQG

SEQ ID NO: 59133 - DNA, 705 bp, Zea mays
  misc_feature: Ceres CLONE 1514365
  misc_feature: Encodes the peptide sequence at SEQ ID NO. 59134
  misc_feature (418)..(418): n is a, c, t, g, unknown, or other
  misc_feature (462)..(462): n is a, c, t, g, unknown, or other
  misc_feature (516)..(516): n is a, c, t, g, unknown, or other
  misc_feature (517)..(517): n is a, c, t, g, unknown, or other
  misc_feature (537)..(537): n is a, c, t, g, unknown, or other
caaagctggagctcaccgcggtggcggccgctctagaactagtggatcccccgggctgcaggaattcgtctcacccctagaaaaaacaacggcacagaggtgcgacgtacgacgacgaacgacgcaggcgccacacatggcatcccagctctccgccgccgtgccccggttccacggcctccggggctacgccgcgcccaggtccgcggtggcagcgctgccgtccgtgagggtgggcaggaagaggtcgtcgtcgcagggcatccgctgcgactacatcggctccgccaccaacctgatcatggtgacgacgacgacgctgatgctgttcgcggggcggttcgggctggcgccgtcggcgaaccgcaaggcgacggcggggctgaagctgggagcgcgcgactccgggctgcagacnggtgacccccgccgggttcatcttcgccgacacgctggcctgcngcgccgtcggccacatcctcggcgtcggcatcgtgctcggggctcagaacaccnngcgccctcgaccagatcatncgctagatccctacgtcgtcgttgttaagatcagactcaacagcttcaaatccccccctcggccggcaggtccctgcaaggggggacttttgtaaccggggggccgtgcggaccggaacttggcatccctctggggttccaaagaaataaaacctccggttgctccct

SEQ ID NO: 59134 - protein, 142 aa, Zea mays
  misc_feature: Ceres CLONE 1514365
  misc_feature (49)..(109): Pfam Name: PSI_PSAK Pfam Description: Photosystem I psaG / psaK
  misc_feature (109)..(109): Xaa is any aa, unknown, or other
  misc_feature (127)..(127): Xaa is any aa, unknown, or other
  misc_feature (134)..(134): Xaa is any aa, unknown, or other
MASQLSAAVPRFHGLRGYAAPRSAVAALPSVRVGRKRSSSQGIRCDYIGSATNLIMVTTTTLMLFAGRFGLAPSANRKATAGLKLGARDSGLQTGDPRRVHLRRHAGLXRRRPHPRRRHRARGSEHXAPSTRSXARSLRRRC

SEQ ID NO: 59135 - DNA, 573 bp, Zea mays
  misc_feature: Ceres CLONE 1514366
  misc_feature: Encodes the peptide sequence at SEQ ID NO. 59136
  misc_feature (256)..(256): n is a, c, t, g, unknown, or other
caaagctggagctccccgcggtggcggccgctctagaactagtggatcccccgggctgcaggaattcgtctcacccctagaaaaaaccacaccaccattccgagcacactagtcttccctgcgcttgctcgctccttcttgcccccatggcgctgctcgccttccagggcatggccatgtcgaccgccgccgcggccctcccatctcacaaccacggcgccgtctcatcctacgtctccacctcctcctacgcgcntcgcagcctccgccgcccttccccgcgcccgagctgcgttcgccgtcggcgccgtcttgtcggccacgtcactccagttctgacgtctactgcggagaagggacaagaacgaaaggggcaaaaggtcaccattcatatgcatgccaagccgcccacaaaaaaaaagaaacgggcctggccggtttttgctccccccactctccaggaaggatcatttccagaaggggaaaaccttttcatcccaaattgaccaaaaaacccccgaaaaaagggggcccaaaatccccccccggtttttaatttggccccgggcctta

SEQ ID NO: 59136 - protein, 119 aa, Zea mays
  misc_feature: Ceres CLONE 1514366
  misc_feature (37)..(37): Xaa is any aa, unknown, or other
MALLAFQGMAMSTAAAALPSHNHGAVSSYVSTSSYAXRSLRRPSPRPSCVRRRRRLVGHVTPVLTSTAEKGQERKGQKVTIHMHAKPPTKKKKRAWPVFAPPTLQEGSFPEGENLFIPN

SEQ ID NO: 59137 - DNA, 727 bp, Zea mays
  misc_feature: Ceres CLONE 1514368
  misc_feature: Encodes the peptide sequence at SEQ ID NO. 59138
  misc_feature (347)..(347): n is a, c, t, g, unknown, or other
  misc_feature (727)..(727): n is a, c, t, g, unknown, or other
ctccccgcggtggcggccgctctagaactagtggatcccccgggctgcaggaattcgtctcacccctagaaaaagacgtccccatttccaagctcctcctcgcgattccaatccacgcacgcctcctccgcttccgcctcgctcaggcttatagtcagtgatggaacacaaggaggcgggctgccagcagccggagggcccaatcctatgcatcaataactgcggcttcttcggcagtgctgcgacgatgaacatgtgctccaagtgccacaaggagatgataacgaagcaggagcaggcccagctggctgcctcctccatcgatagcattgtcaatggcggtgacngccggaaaggacctgcaattgctgcgtctgtaaatgcggcaattcctcaaccccaccctaagactattgttgggcagcccatgcttgtagctgaaaccagcgaggctgctgctgtaatccccaaggccaaggaaggcccaaaacggtgcgcggcctgcaagaagcgggttgggctgaacggattttactggcaaaagcgggaacgtgtaatgttcggtggaccgctactccgaaaaacttgactggccattccgataatcgaaatggacccaggggacgaaattggcaagggccatccctgtgggtgaggggggaaaaaactcaaacaaaatttgaaggggggcccttggggggaaccaaaaggggttgcaaccccccan

SEQ ID NO: 59138 - protein, 142 aa, Zea mays
  misc_feature: Ceres CLONE 1514368
  misc_feature (14)..(38): Pfam Name: zf-A20 Pfam Description: A20-like zinc finger
  misc_feature (63)..(63): Xaa is any aa, unknown, or other
MEHKEAGCQQPEGPILCINNCGFFGSAATMNMCSKCHKEMITKQEQAQLAASSIDSIVNGGDXRKGPAIAASVNAAIPQPHPKTIVGQPMLVAETSEAAAVIPKAKEGPKRCAACKKRVGLNGFYWQKRERVMFGGPLLRKT

SEQ ID NO: 59139 - DNA, 797 bp, Zea mays
  misc_feature: Ceres CLONE 1514374
  misc_feature: Encodes the peptide sequence at SEQ ID NO. 59140
  misc_feature (298)..(298): n is a, c, t, g, unknown, or other
  misc_feature (301)..(301): n is a, c, t, g, unknown, or other
  misc_feature (302)..(302): n is a, c, t, g, unknown, or other
  misc_feature (318)..(318): n is a, c, t, g, unknown, or other
gctctagaactagtggatcccccgggctgcaggaattcgtctcacccctagaaaaaacaccgcaatcttcaatctccccagcaatccctagcagaagccttccatcctcactcgctcgatggcccgcacgaagcagacggcgaggaagtccaccggcggcaaggcgccgaggaagcagctggcgactaaggcggcccgcaagtctgcccctgcgaccggcggagtgaagaaccccaccgcttccgccccggtaccttcgcgctccgggagatccgcaagtaccataagagtttggagntgnntgataaaaaaaatggnattccaggttccttcccccccccccccgggggggaggggtgggaccaaccttaccttcccccccccccgctggtccccgtcgtctgttatggatgctccctgaagtacttatcttggtcggcgctccctcacaatatgcccttgtctcctgcggccaccccgcgcctatacgggagttacccgttcctggccccattgtgatttcccgtgattggtgtagtggttcacccccccggcgactctgcgcctgcgagcggtctcgccctctttgcgtgcgcgccccgtctacccttaccatatctctcggttcggtctgatcccgggtgtcgcaccacccacatcaccctgtatagctccactccacctgattgcggatctcccatgccccactcgcccctttccccgtcatcctctccgttcgctccctcacgttcccctccctcacgtcgctcatattgatctcattataacggcgcccg

SEQ ID NO: 59140 - protein, 100 aa, Zea mays
  misc_feature: Ceres CLONE 1514374
  misc_feature (60)..(60): Xaa is any aa, unknown, or other
  misc_feature (61)..(61): Xaa is any aa, unknown, or other
  misc_feature (62)..(62): Xaa is any aa, unknown, or other
  misc_feature (67)..(67): Xaa is any aa, unknown, or other
MARTKQTARKSTGGKAPRKQLATKAARKSAPATGGVKNPTASAPVPSRSGRSASTIRVWXXXIKKMXFQVPSPPPPGGRGGTNLTFPPPRWSPSSVMDAP

SEQ ID NO: 59141 - DNA, 568 bp, Zea mays
  misc_feature: Ceres CLONE 1514377
  misc_feature (204)..(204): n is a, c, t, g, unknown, or other
  misc_feature (291)..(291): n is a, c, t, g, unknown, or other
tggcggccgctctagaactagtggatcccccgggctgcaggaattcgtctcacccctagaaaaaaactccaaaccctagcccagagcagccgcatcgaactctacctgcctttctctcgtccctggcggcggcggcaggatggcggcttctactgcgaggacggtgaaggatgtgaacccccacgagtttgtcaaggcctactnccgcccatctcaaacgctccggcaagatggagcttcctgagtgggttgacattgtgaagactgcgaggttcaaggagctcccctccnttattggaaccccgggacgggaaccccaattcggggggcgggcctttttttggtccccggggggaaaatatccttttttttgaaaaaaccaccccttttttgtgttttgtggggccccccccccacaaaaaaaaatttttggggggggcccccccaaaaaaaaaaggggggtgtttcccccccccccccccccccccttttttttttttttttaaaaaaaaaaaaaaaaaaggggggggggggttttttttttttttttttttttaaaaacaacacc

SEQ ID NO: 59142 - DNA, 649 bp, Zea mays
  misc_feature: Ceres CLONE 1514381
  misc_feature (407)..(407): n is a, c, t, g, unknown, or other
ctggagctccccgcggtggcggccgctctagaactagtggatcccccgggctgcaggaattcgtctcacccctagaaaaaatagcgacaggtcgacaatatgaccaggaggactctgctgaactatggtactcttcgtggcccttctggtctccgccgtcgcggacataggacttgcatggaccaccaccaacaagcatcgctggggcggggagcggaccctgtggtccggcgtgtggacctgcgacgacctcctcactcagtgcctcggcacctgaaacaactgaatccccctgtgcacgagataacggccccataggtgatggctgtcgaggatgcatgccgaagaagatgcgctgccagataccccagtgactaatcctgttacaccacggctgctcggcacanccgcaccgccgatggatacttccacgtgcctccgtacgaccgccattgcccaagtcgtgctccataacgataaccgagaggccttcatctactttctacgactcgataggagtgtctcctccgcaaatccaaatggaagaaaaaaaaatgcaaagggaccccttggatgattctagaggtcaggataaaaatctactgcacctctttattaaaatgtaacacggggagagggtgctctccga

SEQ ID NO: 59143 - DNA, 635 bp, Zea mays
  misc_feature: Ceres CLONE 1514383
  misc_feature: Encodes the peptide sequence at SEQ ID NO. 59144
  misc_feature (635)..(635): n is a, c, t, g, unknown, or other
tagctggagctccccgcggtggcggccgctctagaactagtggatcccccgggctgcaggaattcgtctcacccctagaaaaaaaatcctccgtcgacccctctacaccggcgatcggcggcgaacgatggggtgggcgacgcggttcctggcggcggtgtgcttctttgctgcgggcgtcctcttcgtcccagaggctatcggttccccatccggcgcaggagccgtcaccgccgccaagctggcccacgtcctctcctttgccacctcctggggcgccgccctctgggccaccttcatcggcggcatcataatgttcaagaacctgccgaggcacatgttcggcaacttgcagagcaagatgttcccggcctacttcacgcttatatctgcatgcgcagccatctccgtcgccgccttcgcgtaccttcacccgtggaagacggcgtccactgtgcagcgctaccagcttggattcctcctctcagcgctcggctgcaacctctcccaaccttctagtcttcactcccctgaccctcgagatgatgaagaagaggcccaagatccgagcgggacctgagtttcggcgaagaagccggatgggccaagaaccagcaggtgggctaatcccaccn

SEQ ID NO: 59144 - protein, 150 aa, Zea mays
  misc_feature: Ceres CLONE 1514383
MGWATRFLAAVCFFAAGVLFVPEAIGSPSGAGAVTAAKLAHVLSFATSWGAALWATFIGGIIMFKNLPRHMFGNLQSKMFPAYFTLISACAAISVAAFAYLHPWKTASTVQRYQLGFLLSALGCNLSQPSSLHSPDPRDDEEEAQDPSGT

SEQ ID NO: 59145 - DNA, 435 bp, Zea mays
  misc_feature: Ceres CLONE 1514386
  misc_feature (50)..(50): n is a, c, t, g, unknown, or other
aaagtggactccccgcggtggcggccgctctagaactagtggatcccccngggctgcaggattcgtctcacccctagaaaaactcatctctgctctgctctggaccgttaactctcagctcccctcgctcgttcccttcgcccaatcactgggaccaccaccgcctgctcagatcggcgggcgggcaccggccgcgatgactccaaccgtcaccacaacgttgggtgcgggggggctccccgtccgccccttgtccaaaggcgacccaaagaaccccccacccaaattgcccctttccaaaccccattccccggggaaacggatccctccccaagaaaaaacccggggaagcccttcccaaatttccccaaaaaaaaaccccccccctccaaaaatttttttttttggcccacaaaaaaaaaacccctcccccct

SEQ ID NO: 59146 - DNA, 656 bp, Zea mays
  misc_feature: Ceres CLONE 1514391
  misc_feature: Encodes the peptide sequence at SEQ ID NO. 59147
aaagctggagctccccgcggtggcggccgctctagaactagtggatcccccgggctgcaggaattcgtctcacccctagaaaaaattattatccacaacactcatcgatctacacacatacatagtttcttctactacacgacgacaaacatggggaagcctgcgaagatcggagagtggggtggatacgccggcgatcgtcgggatctgagggctactccggaccggctgatcgaggtgaaggtcacggcggacaacagcagctgcatccgctccatctccttcatctacatcggagccgatggcaaaccgtacgaggaggggccatggggtttcggccatgctggcacggagtacaagattgatctgtgcaagttcgacgagagcttgacggagatctccgggaccacgggcccagcctacaacattgacaatctggtcaagtctctcaaattcgtcacccacaaacgcgcttacggacccgtacggcagggacgagggcccccccgttccgtggtcaggtgatgaacaaacggccacgtccccgggcttcttttggccgctctggggaaattgcctggaaccccaccgagcttcttcctgtaacccccacctaaatacctaaaaacgattggatccggaatcatcctggttgt

SEQ ID NO: 59147 - protein, 124 aa, Zea mays
  misc_feature: Ceres CLONE 1514391
MGKPAKIGEWGGYAGDRRDLRATPDRLIEVKVTADNSSCIRSISFIYIGADGKPYEEGPWGFGHAGTEYKIDLCKFDESLTEISGTTGPAYNIDNLVKSLKFVTHKRAYGPVRQGRGPPRSVVR

SEQ ID NO: 59148 - DNA, 618 bp, Zea mays
  misc_feature: Ceres CLONE 1514401
  misc_feature: Encodes the peptide sequence at SEQ ID NO. 59149
  misc_feature (461)..(461): n is a, c, t, g, unknown, or other
aaagctggagctccccgcggtggcggccgctctagaactagtggatcccccgggctgcaggaattcgtctcacccctagaaaaatgtattgtgctacttgattaaatacaggaacatgacccctgaagcagctttggatcatgtacgatccattaggcctcgagtgcttttggcaccctcgcagtggcatgctgttaattcatttggagctctcaccggtggacaacttccagtacggagtacaaacctggcctgtttcctagaagccattgaagctggctgtacgaacacaacaggaaatgatgattaccacgtgatggagtttgactgcgaagatagtggcttaccactttatcaaattatgctacctaggccagccagccccactgggtctgggtgcaccgatgcagtcctcgtaacagaagcagatcttgagggctatgatacttatattggtaccnagaaagatgcggtgtcgttggaagtagccactcgcagtcccatcatgaggagattgtcctgcctctttggctccctcaaacttagaaacagcaactgtgagccagcctcaagccggtcactgaagttcccccctgctaagtaggtagtggcctcccc

SEQ ID NO: 59149 - protein, 162 aa, Zea mays
  misc_feature: Ceres CLONE 1514401
  misc_feature (116)..(116): Xaa is any aa, unknown, or other
MTPEAALDHVRSIRPRVLLAPSQWHAVNSFGALTGGQLPVRSTNLACFLEAIEAGCTNTTGNDDYHVMEFDCEDSGLPLYQIMLPRPASPTGSGCTDAVLVTEADLEGYDTYIGTXKDAVSLEVATRSPIMRRLSCLFGSLKLRNSNCEPASSRSLKFPPAK

SEQ ID NO: 59150 - DNA, 659 bp, Zea mays
  misc_feature: Ceres CLONE 1514407
  misc_feature: Encodes the peptide sequence at SEQ ID NO. 59151
  misc_feature (578)..(578): n is a, c, t, g, unknown, or other
  misc_feature (596)..(596): n is a, c, t, g, unknown, or other
  misc_feature (615)..(615): n is a, c, t, g, unknown, or other
ctggagctccccgcggtggcggccgctctagaactagtggatcccccgggctgcaggaattcgtctcacccctagaaaaactctctctctccactggctgacgccgcgaccgccccaacccaactgcccttttcggagatctcgccgcctccgccgtcgacttccgtcgcccccctatcccgcgtccgggcttacccgatggcacggctgcactggcttgaggccgtcctgccgctggggatcatcggcggcatgctctgcatcatgggcaacgcccagtatttcatccacaaggccgcgcacggcaggccgaagcacatcgggaacgatatgtgggacgtcgccatggagcgccgcgacaagaagctcgtggaacaatcctccggcaactagggtattgatcaacctcaaacttttctggatgttgacgaacctcctttcaaagcacagaagtactggctcttttgtttcctgtacaattggaaccaagactttgtttgttttgctttgaaatatcaacagttcggaagataatctgtatctgacatctgtttaattgaacaaagcccaatactttngtcaattgtgtatgcacnattaatttcccgcaccggnagcagatcccatgaacaccggaaaaaaaaaaaaaaaacgagacg

SEQ ID NO: 59151 - protein, 64 aa, Zea mays; identical to SEQ ID NO: 55001
  misc_feature: Ceres CLONE 1514407

SEQ ID NO: 59152 - DNA, 627 bp, Zea mays
  misc_feature: Ceres CLONE 1514419
  misc_feature (493)..(493): n is a, c, t, g, unknown, or other
  misc_feature (525)..(525): n is a, c, t, g, unknown, or other
  misc_feature (526)..(526): n is a, c, t, g, unknown, or other
  misc_feature (570)..(570): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (582)..(582): n is a, c, t, g, unknown, or other
  misc_feature (583)..(583): n is a, c, t, g, unknown, or other
atagctggagctccccgcggtggcggccgctctagaactagtggatcccccgggctgcaggaattcgtctcacccctagaaaaaactcgtcattctagcccgggaaacacgcccggtcgaccgggggtggaaaatatcctagcctggaccgcaagcgaacgcgaagggcacgcgacttctcgtcggcgtcgatctgctccggcgaccgcttctcatcgttgtagacttccaggggtcgagttatgtatgaagtagctccaatctttagaggaagaatgtcttctcaacgggttttatgtacttgttctatcaaagagtgagatgaatcattatctagatctatgatctcgtcatgtttagtacactggaaatgtattcttttgcaacttattagtgttaacataccatgagataattgtgcaggttgtttgataagcattaatattgagctgactgaattattttgatattattgtgactgtttaaaactcgnaaaaaatctcaaccctacaaaaaaaaaaaaannaaccaaacactccatgtacccaattcccccctattttttttccntaattannnttnnctcccggggaacccccctggttacaccctcttgcccttaataaa

SEQ ID NO: 59153 - DNA, 628 bp, Zea mays
  misc_feature: Ceres CLONE 1514421
  misc_feature: Encodes the peptide sequence at SEQ ID NO. 59154
aagctggagctccccgcggtggcggccgctctagaactagtggatcccccgggctgcaggaattcgtctcacccctagaaaaatagaagacaagatagagaagacggcggaggtggcgatcgaggtgatcgacaaggtggcggaggcgacggagaaggtcgccggcgaggtcgccgacgagttccccggcaacgagagcatcaaggaagcagcctccaggatcaagaaggtcatgcacgtggtcgaggaagacgccgacaaggctgaggccctgatcgagaaggtcgacgagataaagaaagaagtggattcgattgtcgatcctataatgggcaaggttgccaaggataaatcgcggagaatgaaccaaaaaggatgacagcagtcggtgaattgaaaggagcgcaaacattgctcggacggaaagagaagcaacatgacgcgtctcgtttcgtttttatctctcgtgcggtggcttcctccttacaaagtacgagatgaggcataagactattcatatgatcgtgcaaaacaatattttacactgtagattgtactgtttaccgagataatttcgaaataagagatgagataagatgtcatgaataagctgttggatgcatcctaa

SEQ ID NO: 59154 - protein, 48 aa, Zea mays
  misc_feature: Ceres CLONE 1514421
MHVVEEDADKAEALIEKVDEIKKEVDSIVDPIMGKVAKDKSRRMNQKG

SEQ ID NO: 59155 - DNA, 701 bp, Zea mays
  misc_feature: Ceres CLONE 1514425
  misc_feature: Encodes the peptide sequence at SEQ ID NO. 59156
  misc_feature (211)..(211): n is a, c, t, g, unknown, or other
  misc_feature (309)..(309): n is a, c, t, g, unknown, or other
  misc_feature (310)..(310): n is a, c, t, g, unknown, or other
  misc_feature (312)..(312): n is a, c, t, g, unknown, or other
  misc_feature (315)..(315): n is a, c, t, g, unknown, or other
  misc_feature (318)..(318): n is a, c, t, g, unknown, or other
  misc_feature (414)..(414): n is a, c, t, g, unknown, or other
  misc_feature (415)..(415): n is a, c, t, g, unknown, or other
  misc_feature (430)..(430): n is a, c, t, g, unknown, or other
  misc_feature (489)..(489): n is a, c, t, g, unknown, or other
  misc_feature (517)..(517): n is a, c, t, g, unknown, or other
  misc_feature (519)..(519): n is a, c, t, g, unknown, or other
  misc_feature (532)..(532): n is a, c, t, g, unknown, or other
  misc_feature (562)..(562): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (631)..(631): n is a, c, t, g, unknown, or other
  misc_feature (633)..(633): n is a, c, t, g, unknown, or other
  misc_feature (696)..(696): n is a, c, t, g, unknown, or other
  misc_feature (698)..(698): n is a, c, t, g, unknown, or other
ccatgctggagctcaccgcggtggcggccgctctagactagtggatcccccgggctgcaggaattcgtctcacccctagaaaaaaagctagccatagtagggggctcactcatccgcacagaccggcacccagctcaagtcacccccgaaacgcaagctaagcgcgcagccatggcggcggctccagggcggccgctggcggtggacttcnaggcgctgagctacatcagcagcctggtggaggcgttccaggcgttctactccgacaacgacgggctggtgacggcgcccgaactccgggacctgctnncntcnctngccctggacaagtcggaaggcgaggcgcgcgacatgctggttttccccccacccccaccggggggggggggggggcaccctaccaataatttcttnnaccctccatcaaccncccggaaaacacagaggtgtgcgcgccctcgagggggaggacttaaagagtaacgattncctcaacccttatctgaccgcgggaganancccacatgcaggngcagatgtactacaatacgcctagagctcntcgagcccctttggnnngcacctacgaccgcccttccgaacctccgctatacggccaaacgccccaacnanagagagactctactaaccagcaccctcaattccagagagtgccacagaggaaccgcactatcncntcg

SEQ ID NO: 59156 - protein, 103 aa, Zea mays
  misc_feature: Ceres CLONE 1514425
  misc_feature (14)..(14): Xaa is any aa, unknown, or other
  misc_feature (47)..(47): Xaa is any aa, unknown, or other
  misc_feature (81)..(81): Xaa is any aa, unknown, or other
  misc_feature (82)..(82): Xaa is any aa, unknown, or other
  misc_feature (87)..(87): Xaa is any aa, unknown, or other
MAAAPGRPLAVDFXALSYISSLVEAFQAFYSDNDGLVTAPELRDLLXSLALDKSEGEARDMLVFPPPPPGGGGGHPTNNFXXPPSTXRKTQRCARPRGGGLKE

SEQ ID NO: 59157 - DNA, 647 bp, Zea mays
  misc_feature: Ceres CLONE 1514430
  misc_feature: Encodes the peptide sequence at SEQ ID NO. 59158
ggagctccccgcggtggcggccgctctagaactagtggatcccccgggctgcaggaattcgtctcacccctagaaaaaagaccgcagcaattgcgattgcgagtcctccaaaccatggcgctcgccctggcctctccaatggcgtctctctccttccactccgggaggatctcggcggcgtctatcggaggcgtcggccgcactcgcagggcggccccggtgggcgtatccgcctcgccgttcctccggagctccttcgtctcgtcctcctccacgtcggccgcctccgcctccgcctcccccgcttcgctcgcggcggctgtctcggcgtctctggcatttacgtcctcctccgcgtttgccggttcatctttgggaatcgagttcagctacagtacaaccacaacacggagatcccgtggtatgcagattagggctggaaaggctgccctctgcatgaccaagaagtcaaggtctaggaaagcgcttggcccgtacacatgggttcccgcaaggcggatgccggactaccttctcgcaaaggaaggagacttgaaaccccacgcccccgccaaaagagcagggaaggtttcctttgcacccaagggccaaaccccaaaccaggtggggaaagaaaaagatacgcc

SEQ ID NO: 59158 - protein, 177 aa, Zea mays
  misc_feature: Ceres CLONE 1514430
MALALASPMASLSFHSGRISAASIGGVGRTRRAAPVGVSASPFLRSSFVSSSSTSAASASASPASLAAAVSASLAFTSSSAFAGSSLGIEFSYSTTTTRRSRGMQIRAGKAALCMTKKSRSRKALGPYTWVPARRMPDYLLAKEGDLKPHAPAKRAGKVSFAPKGQTPNQVGKEKDT

SEQ ID NO: 59159 - DNA, 630 bp, Zea mays
  misc_feature: Ceres CLONE 1514432
  misc_feature: Encodes the peptide sequence at SEQ ID NO. 59160
  misc_feature (408)..(408): n is a, c, t, g, unknown, or other
  misc_feature (440)..(440): n is a, c, t, g, unknown, or other
tagctggagctccccgcggtggcggccgctctagaactagtggatcccccgggctgcaggaattcgtctcacccctagaaaaaaccggcgagccacatcgagaacacgatcgagcacacacaagcacgaagactcgtttaggagaaaccacaaaccaccaatcggtgcaagcatcatggagtacggtcagcaggggcagcgcggccacggcgccactggccatgtcgaccagtacggcaacccagtcggcggcgtcgagcacggcaccggcggcatgaggcacggcacgggaaccgccggcggcatgggccagctgggtgagcacggcggcgctggcatgggtggcgggcagttccagcctgcgatggaggagcacaagaccggcggcatcctgcatcgctcccccanctccagctccagctcgtcggaggacgacggcntgggcggaaggaggaagaagggaatcaaggagaagatcaaggagaagctgccccgatgccacaaagacgaccagcacgccacggcgacgaccgggcgcgcctacgggcagcaaggacacaccggcagcgcctacgggcagcaaggacacaccggcggctccttacccaccgggcaccgagggcaccgggg

SEQ ID NO: 59160 - protein, 151 aa, Zea mays
  misc_feature: Ceres CLONE 1514432
  misc_feature (14)..(148): Pfam Name: Dehydrin Pfam Description: Dehydrin
  misc_feature (78)..(78): Xaa is any aa, unknown, or other
  misc_feature (89)..(89): Xaa is any aa, unknown, or other
MEYGQQGQRGHGATGHVDQYGNPVGGVEHGTGGMRHGTGTAGGMGQLGEHGGAGMGGGQFQPAMEEHKTGGILHRSPXSSSSSSEDDGXGGRRKKGIKEKIKEKLPRCHKDDQHATATTGRAYGQQGHTGSAYGQQGHTGGSLPTGHRGHR

SEQ ID NO: 59161 - DNA, 652 bp, Zea mays
  misc_feature: Ceres CLONE 1514439
  misc_feature: Encodes the peptide sequence at SEQ ID NO. 59162
  misc_feature (652)..(652): n is a, c, t, g, unknown, or other
ctccccgcggtggcggccgctctagaactagtggatcccccgggctgcaggaattcgtctcacccctagaaaaaaccacacccgcctgctcgtctcctgtaaaggcgccgccgactcttctacctacctctccccggcctcgcacccatggccacggttttgatgggtggtgcctctacctcgtggtcctcggggcgcgtcgcgtcacggctgaagccggtggcctcctgctcctccagaggtaccatcagctgctcggctctctcccggaggcccttggcacagcagctcccgccgctgccggcaacggcctccgtgccggcggtagcaccctggcccctcaggggctgtcggagcaaacggagaagggctccctgtttaacccccacctgtccccccccaagacggcgaccgcattccctgcgagaataggggcggttgacaagcctatattttgggtccgctaaaaaaattcttccatagagggggaaaccccatacccaatgtggaatggggggattccctcgggccccccccgaaggaggttaatgccgctggcgggacccgggggcgggggccttcatggatgggcgctgggcggccccaaaccccggggggggggctttggctggttaaaaataagcgacccacn

SEQ ID NO: 59162 - protein, 94 aa, Zea mays
  misc_feature: Ceres CLONE 1514439
MATVLMGGASTSWSSGRVASRLKPVASCSSRGTISCSALSRRPLAQQLPPLPATASVPAVAPWPLRGCRSKRRRAPCLTPTCPPPRRRPHSLRE

SEQ ID NO: 59163 - DNA, 758 bp, Zea mays
  misc_feature: Ceres CLONE 1514574
  misc_feature: Encodes the peptide sequence at SEQ ID NO. 59164
  misc_feature (80)..(80): n is a, c, t, g, unknown, or other
  misc_feature (110)..(110): n is a, c, t, g, unknown, or other
  misc_feature (113)..(113): n is a, c, t, g, unknown, or other
aaaagctggagctcaccgcggtggcggccgctctagactagtggatctctcgggctgcaggaattcgtctcacccctagngaggaaaagccagcagaagaagggatgcancanccgatgcacatgcagccgcaggcgccggcgataaccccagctgccggaatcaccacggagcagatccaaaagtatctggatgagaataagcagcttattttggctattttggaaaatcagaacctaggaaaattggcagaatgtgctcagtatcaatcacaacttcagatagaacctcttggatctcggtgcagtcgcatatgcccaaccgcgaactgctgcacgcctccctcagagggtgtcgcctggggtatcgccgggagggagcgcactctttgttcctttttacgaatttggcgccccccccccattcgaagagctccagggggaggcggggggctgggagtttgaccggcccgcggggtcagattccctcaattctcatgggcccgcggcgtttgctcggccttgcgctttcccccgccgtgttggctttatgtagctgcggtcagctgcacggcgatcactccgcccgcagaacccccacggtatcaccacccgtgtgctccccccgtctagagcccgtttgcgcgctattcgtagacgcagggggggacgccctccgcgcgctatatgtgtgtctttaccgcgccacgcctataatccccgttctcgcgcatgtgtcactagcttagcccagataca

SEQ ID NO: 59164 - protein, 119 aa, Zea mays
  misc_feature: Ceres CLONE 1514574
  misc_feature (17)..(62): Pfam Name: SSXT Pfam Description: SSXT protein (N-terminal region)
  misc_feature (2)..(2): Xaa is any aa, unknown, or other
  misc_feature (3)..(3): Xaa is any aa, unknown, or other
MXXPMHMQPQAPAITPAAGITTEQIQKYLDENKQLILAILENQNLGKLAECAQYQSQLQIEPLGSRCSRICPTANCCTPPSEGVAWGIAGRERTLCSFLRIWRPPPIRRAPGGGGGLGV

SEQ ID NO: 59165 - DNA, 679 bp, Zea mays
  misc_feature: Ceres CLONE 1514582
  misc_feature: Encodes the peptide sequence at SEQ ID NO. 59166
  misc_feature (485)..(485): n is a, c, t, g, unknown, or other
  misc_feature (560)..(560): n is a, c, t, g, unknown, or other
  misc_feature (563)..(563): n is a, c, t, g, unknown, or other
  misc_feature (567)..(567): n is a, c, t, g, unknown, or other
ctggagctccccgcggtggcggccgctctagaactagtggatcccccgggctgcaggaattcgtctcacccctagaaaaagagtttcctcctccactccctcccccccgcctccactaccccactcccaggagccgcccaggtacgtcgccggcggcgatgacgacgcgcttcaagaagaaccgcaagaagcgcggccacgtgtccgccgggcacggccgcatcggcaagcaccggaagcatcccggaggtcgcggtaacgccggtggcatgcaccaccaccgcatcctcttcgacaagtaccatcccggctacttcggtaaggtcggcatgcgctacttccacaagctccgcaacaagttctactgccccgcggtcaacatcgagcgcctctggtcgatggtgcccgccgaaaaggcggcggaagccggcggcgaacaggccccgcagatcgacgtcacgcagttcggcttcttcaggtgctcngggaagggggtgctgccgcccaagcccatcgtcgtcaagggcagctcatctcccaggtcgccgagagaagatcanggncgcnggcgggcgcgtcgtgctcaccgcctagttttcagtccttattcgcctctgggttttgagatctatatctgaactagcagtcttttctgtctcaccctattggggtaaggaaa

SEQ ID NO: 59166 - protein, 159 aa, Zea mays
  misc_feature: Ceres CLONE 1514582
  misc_feature (134)..(134): Xaa is any aa, unknown, or other
  misc_feature (137)..(137): Xaa is any aa, unknown, or other
MTTRFKKNRKKRGHVSAGHGRIGKHRKHPGGRGNAGGMHHHRILFDKYHPGYFGKVGMRYFHKLRNKFYCPAVNIERLWSMVPAEKAAEAGGEQAPQIDVTQFGFFRCSGKGVLPPKPIVVKGSSSPRSPREDXGRXRARRAHRLVFSPYSPLGFEIYI

SEQ ID NO: 59167 - DNA, 697 bp, Zea mays
  misc_feature: Ceres CLONE 1514583
  misc_feature: Encodes the peptide sequence at SEQ ID NO. 59168
  misc_feature (223)..(223): n is a, c, t, g, unknown, or other
  misc_feature (224)..(224): n is a, c, t, g, unknown, or other
  misc_feature (231)..(231): n is a, c, t, g, unknown, or other
  misc_feature (239)..(239): n is a, c, t, g, unknown, or other
  misc_feature (259)..(259): n is a, c, t, g, unknown, or other
aaagctggagctccccgcggtggcggccgctctagaactagtggatcccccgggctgcaggaattcgtctcacccctagaaaaagacctgcagccaaccatctaccagcgactcagcgagcgagagcagcacacactgcacgcagctagctaggagcagcagcagcggcggcgatggcggcctccatgatctcctcgtcagctctggcggtggcgcctcaggnnctgccgnccctcggncgccgcgcctccttcttcgncgtcgtctgctcccagaagaagatctagaccgaccagccctaccggattgggggtggccttgacgtcgacgtccacaccaacgggagaaagggcaaaggcaaaggcctgtaccaattcgtccacaagtacagggcgcacatctacagatacaccccatctacaacgagggaggactgggctcccaccggggaaatctataatttgtgggacacctgggcgtcttaaattgggccctcccccctcgctgggaaactctgggggggggggccctcttcgggtttaaaaccagagccctcttcggggtaaaggaatcccaagggtggggcttttttgggatattccaaagtgaaaaaaaggggggctttgctataaactacacccccccgggagggccccccctctcccctgggagaaaaaaaacacgggggtctcctctc

SEQ ID NO: 59168 - protein, 37 aa, Zea mays
  misc_feature: Ceres CLONE 1514583
  misc_feature (17)..(17): Xaa is any aa, unknown, or other
  misc_feature (20)..(20): Xaa is any aa, unknown, or other
  misc_feature (29)..(29): Xaa is any aa, unknown, or other
MAASMISSSALAVAPQXLPXLGRRASFFXVVCSQKKI

SEQ ID NO: 59169 - DNA, 769 bp, Zea mays
  misc_feature: Ceres CLONE 1514586
  misc_feature: Encodes the peptide sequence at SEQ ID NO. 59170
  misc_feature (47)..(47): n is a, c, t, g, unknown, or other
  misc_feature (54)..(54): n is a, c, t, g, unknown, or other
acagtgctgagctcaccgcggtggcggccgctctagactagtggatntcttggnctgcaggaattcgtctcacccctagaaaactctacaatgatctgctgatgcaagccggcaaacttgggaatgtgcaatcagagctgcttctccgcaaggactcccggactttcactttcgaaaagggatgggccttcccacgccgagtttacttcaatggtgataattgtgtcatgccatctcctgaaaattatccagggctgccgaatgcaagcccctctacacaattattggcccggcggtgcggggccccccggtttgccttggccggcctcgggggcttacgcaggaacggcggcgcatctagaaggtttaggggggctgccgggggggcccccaccatcccccaaaataaccccccccccccccggcgatttgggtcgattcaacgcccgcggggcccgacccaagagagagatggagcgcggagtcgccgggagcagggggcggcgccgttctgcccgccgaccagccgctagtcgcccaaaccgccgaccctcttcccccctccgcgcatcacgcgtctccgccccgggcggcccggagggccctccccgcgctgggtcggtacccgcgcgggctcggttttccccccgcggggcgggcgaatacatgtagcccccccccggcttacgtgtcccccgcccccccgtgacgcgggactggcggggtggggcgggtgcgcgcgggggtgttttgctctaccgccccgcgg

SEQ ID NO: 59170 - protein, 143 aa, Zea mays
  misc_feature: Ceres CLONE 1514586
MQAGKLGNVQSELLLRKDSRTFTFEKGWAFPRRVYFNGDNCVMPSPENYPGLPNASPSTQLLARRCGAPRFALAGLGGLRRNGGASRRFRGAAGGAPTIPQNNPPPPRRFGSIQRPRGPTQERDGARSRREQGAAPFCPPTSR

SEQ ID NO: 59171 - DNA, 645 bp, Zea mays
  misc_feature: Ceres CLONE 1514587
  misc_feature: Encodes the peptide sequence at SEQ ID NO. 59172
ggagctccccgcggtggcggccgctctagaactagtggatcccccgggctgcaggaattcgtctcacccctagaaaaaaaaaaaccctagcagttcggtagtccctctcctctcgaggtattagcagtcgaccggttcctcggagcacgatgaagtttgttgctgcctacctgcttgctgtcctcgctgggaacgccagcccctccgctgacgatttgactgccattctggagtcagtttgggctgtgaagttgacaatgaaagatggactcctgctgtcccactgagcggtaggacatcccgagctcatgccgcgggcaggagaagttgcttcatccatgtggtgccgcgggtccctgtgcggaactgccctggtgctgggggacctgtcctgggcttagcaaaaaaaaaaaaaggggaaaaaaaggaaaaaccattatatttgggcttcgccccttcaatagggtggcagtcctccatttttgtttttggcgtggaacccaaggaaaaccgaagccgggtttaaattttacccttgtttttattttagaaaaactggaaaaaactggtccctttgtttttattttttggaaacgcgccccccgaaaattcccttcccgcggtggtggattttctcctgagaaa

SEQ ID NO: 59172 - protein, 45 aa, Zea mays
  misc_feature: Ceres CLONE 1514587
MKFVAAYLLAVLAGNASPSADDLTAILESVWAVKLTMKDGLLLSH

SEQ ID NO: 59173 - DNA, 625 bp, Zea mays
  misc_feature: Ceres CLONE 1514593
  misc_feature: Encodes the peptide sequence at SEQ ID NO. 59174
  misc_feature (536)..(536): n is a, c, t, g, unknown, or other
aaagctggagctcaccgcggtgggcgtcgctctagactagtgaatttcttgggctgcaggaattcgtctcacccctagaaaaaaaaccctagcttgccgcgccgcctggatcgagcagccgagcgactaagcgaagactcccttttccccgagcacaagagaaccatggcggcggcggcagtatacggcggcttcaaggggaagcttggcgtcgaggatgcccccgagctgcagctcaaccgcatccgcatcacacctctcatccaagaacgtcaagaaacttgggagaaaaggtttgtggcggaatttgggtaaaggggaggccccaggaaccaggctttttgaagggggttaaagggggaccccctgggcacgcggggatatcccccccatcccaatgacaggggcggtgttcttctccgctggcgggtttttgtgtccgcagtgtagtcctatggggggagacggaggaaacccccccccccttctccctgcggtggggggggtgaaaaataagggagccccccccccccacnaaaaaagggggcggggggtggggggttgggtggttactcccctccccccttgggggggggggggggacaactgacacccacccccgcgg

SEQ ID NO: 59174 - protein, 49 aa, Zea mays
  misc_feature: Ceres CLONE 1514593
MAAAAVYGGFKGKLGVEDAPELQLNRIRITPLIQERQETWEKRFVAEFG

SEQ ID NO: 59175 - DNA, 747 bp, Zea mays
  misc_feature: Ceres CLONE 1514599
  misc_feature: Encodes the peptide sequence at SEQ ID NO. 59176
  misc_feature (322)..(322): n is a, c, t, g, unknown, or other
  misc_feature (359)..(359): n is a, c, t, g, unknown, or other
ctccccgcggtggcggccgctctagaactagtggatcccccgggctgcaggaattcgtctcacccctagaaaaaaaagaggaaaggcttgcggtggatacctaggcacccagagacgaggaagggcgtagcaagcgacgaaatgcttcggggagttgaaaataagcatagatccggagattcccaaataggtcaaccttttgaactgcctgctgaatccatgagcaggcaagagacaacctggcgaactgaaacatcttagtagccagaggaaaagaaagcaaaagcgattcccgtagtagcggcgagcgaaatgggagcancctaaaccgtgaaaacggggttgtgggagagcaatancagcgttgtgctgctaggccaagcggttgagtgccgcaccctatatggctaaagtccagtagccgaaagcatcactagcttacgctctgacccgagtagcatggggcacgtggaatcccgtgtgaatccgcaaggaccacccttgcaggctaaatactccctggttgaccgataaccgaataataccctggagggaaaagttgaaaaaaaaaaaaaaaaccgagacgctccgaggtacccaatccgccctatagggagtcctaattacgcgcggtccctgggccgtcttttttacaacgtccgggactgggaaaacccctggcgttaccccaatttaatccgcctgggagaacattccccctttccccaggtgggggtatatacgaaa

SEQ ID NO: 59176 - protein, 39 aa, Zea mays
  misc_feature: Ceres CLONE 1514599
MLRGVENKHRSGDSQIGQPFELPAESMSRQETTWRTETS

SEQ ID NO: 59177 - DNA, 699 bp, Zea mays
  misc_feature: Ceres CLONE 1514600
  misc_feature: Encodes the peptide sequence at SEQ ID NO. 59178
  misc_feature (324)..(324): n is a, c, t, g, unknown, or other
  misc_feature (396)..(396): n is a, c, t, g, unknown, or other
  misc_feature (398)..(398): n is a, c, t, g, unknown, or other
  misc_feature (425)..(425): n is a, c, t, g, unknown, or other
  misc_feature (430)..(430): n is a, c, t, g, unknown, or other
  misc_feature (431)..(431): n is a, c, t, g, unknown, or other
  misc_feature (447)..(447): n is a, c, t, g, unknown, or other
  misc_feature (453)..(453): n is a, c, t, g, unknown, or other
  misc_feature (480)..(480): n is a, c, t, g, unknown, or other
  misc_feature (537)..(537): n is a, c, t, g, unknown, or other
ccccgcggtggcggccgctctagaactagtggatcccccgggctgcaggaattcgtctcacccctagaaaagtgctttcttagaggtgggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcngcttcgtcaccttctcccacgaggaggcgatgcggaacgccatcgagggcatgaacgggcaggagctggacngnccgcacatcacccgtcacgaggcccantcccnngcgcgccgtggaagcngccgcngtgggtaccgtggtggccgtgaaggcngcggctacggcgttggccggccccttgatggcggtggcggctacgggggtggcggcngctacggtggcggggcggctacggtggtgggggcggcggctacgcggtgggaaccggtggggggggtaccggttttcccaaagggaactgggagaaattgagccgggggggccccgccggcccaaattttcctggtccctaccggggattgtaccctaagca

SEQ ID NO: 59178 - protein, 155 aa, Zea mays
  misc_feature: Ceres CLONE 1514600
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (52)..(52): Xaa is any aa, unknown, or other
  misc_feature (76)..(76): Xaa is any aa, unknown, or other
  misc_feature (85)..(85): Xaa is any aa, unknown, or other
  misc_feature (87)..(87): Xaa is any aa, unknown, or other
  misc_feature (93)..(93): Xaa is any aa, unknown, or other
  misc_feature (95)..(95): Xaa is any aa, unknown, or other
  misc_feature (104)..(104): Xaa is any aa, unknown, or other
  misc_feature (123)..(123): Xaa is any aa, unknown, or other
MAASDVEYRCFVGGLAWATDDHSLHNAFSTYGEVLESKIILDRETQRSRGFXFVTFSHEEAMRNAIEGMNGQELDXPHITRHEAXSXARRGSXRXGYRGGREGXGYGVGRPLDGGGGYGGGGXYGGGAATVVGAAATRWEPVGGVPVFPKGTGRN

SEQ ID NO: 59179 - DNA, 616 bp, Zea mays
  misc_feature: Ceres CLONE 1514601
  misc_feature: Pfam Name: DUF1138 Pfam Description: Protein of unknown function (DUF1138)
ccccgcggtggcggccgctctagaactagtggatcccccgggctgcaggaattcgtctcacccctagaaaaaaccgggtcatcgccattcgccacaaagccatgttgaaccccccacgtctcctcgcctcgttccccatttgctgcgtctccttgcccgcgctcgccgctcgccgtttgcccctcgtctccgcaccgcgcgctgttgtccatccttgtgcagcacaatgacggctggctacattgtggctcactggtcggatcctttgcattgcataactgtgtgacacatttatctctgacaagaaggcatttgtaggtaacaccccccagactgtttctgaccaggagtggttgcaagtcccagaccccaatttcatggcctgggcttccactggtgggccaccggttgtcatgaaccccttttgcccgccaaaatttcctccgcaatccccctgaataggttttgccttgaaaaacctggtttcccaaattgtgggccccccttaaaaccaaaatcccctttttcagggcgcttaaacattttggaaaaaaccaaaaaaaaaccgggggttttttttgggggtttttcacagggccgggggagaaaaaatggc

SEQ ID NO: 59180 - DNA, 724 bp, Zea mays
  misc_feature: Ceres CLONE 1514603
  misc_feature: Encodes the peptide sequence at SEQ ID NO. 59181
  misc_feature (55)..(55): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
cagagctggagctcaccgcggtggcggccgctctagaactagtggatttctgggnctgcaggaattcgtctcacccctagggagggacagactaactgagcacccgctgcaaggagtccgcgcccatggcgagcaccaacatggcgtcggccacctcgcggttcatgctggccgcgggcgtgcccaccggcagcagcggcggccgcgtcaacttcgcctcggcgcccaaccggcttggcaggaggctcgtggcccgggccgacaacgaggccgccgcagctgaggcggcggaaggggagggtgccctgtccaccaagcccaaggccgagaagccgccgccgatcgggcccaagagggtttcccccccccccagggggggggggggggtcctactgttaccacnnnatccccccccccctccccggtcaataaggatcccgaccccggttacgcggtggttgtgcgtgttcccagggggaactgcgccggtggggcccccaaacagcgatggcgttggacgagggcctctaacggggaagtgggtgggacccggcccgtttcacgggttccccgcgtggcgacgcgggaagatgatgtttaagcggtgtcgggagaagggaggctctagagactgccgcgcgcgggtgggacacaccgccgcccctagcgcgctctttgtgtggtagcggcgggaggccgcgtttggttgtggtccggccgaatg

SEQ ID NO: 59181 - protein, 186 aa, Zea mays
  misc_feature: Ceres CLONE 1514603
  misc_feature (93)..(93): Xaa is any aa, unknown, or other
  misc_feature (94)..(94): Xaa is any aa, unknown, or other
MASTNMASATSRFMLAAGVPTGSSGGRVNFASAPNRLGRRLVARADNEAAAAEAAEGEGALSTKPKAEKPPPIGPKRVSPPPRGGGGVLLLPXXPPPPPRSIRIPTPVTRWLCVFPGGTAPVGPPNSDGVGRGPLTGKWVGPGPFHGFPAWRRGKMMFKRCREKGGSRDCRARVGHTAAPSALFVW

SEQ ID NO: 59182 - DNA, 703 bp, Zea mays
  misc_feature: Ceres CLONE 1514608
  misc_feature: Encodes the peptide sequence at SEQ ID NO. 59183
  misc_feature (363)..(363): n is a, c, t, g, unknown, or other
  misc_feature (381)..(381): n is a, c, t, g, unknown, or other
  misc_feature (382)..(382): n is a, c, t, g, unknown, or other
  misc_feature (390)..(390): n is a, c, t, g, unknown, or other
  misc_feature (398)..(398): n is a, c, t, g, unknown, or other
  misc_feature (400)..(400): n is a, c, t, g, unknown, or other
  misc_feature (438)..(438): n is a, c, t, g, unknown, or other
  misc_feature (578)..(578): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (592)..(592): n is a, c, t, g, unknown, or other
  misc_feature (597)..(597): n is a, c, t, g, unknown, or other
  misc_feature (598)..(598): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (615)..(615): n is a, c, t, g, unknown, or other
tggagctccccgcggtggcggccgctctagaactagtggatcccccgggctgcaggaattcgtctcacccctagaaaaaaccaccacacaagaagaggcccccagccagccagtccacagctctccactcgagaaacctccagtccagctccacccttcgtccactccagacttccagaggcaccacacacaccatggctcccagcaagcttgcggtggtcgtcgccttggtagcgtctctcctcctggtcaccaccagcaacaccaagcttggcctgttcgtgctcggccaggctgctccgggcacctacccaccacgggatcctccgccgcaccagatcgtcgaccccgccaaagactgcnggggcgcgtgcgacgtgnncgtgcgcncgcactcncngaagaacatctgcacccgggcgtgcctcaagtgctgcngcgtctgccgctgcgtgccggcgggcacggccgggcaacaacagacgtggcggcaagtgctacaccgactggaccacgcccggggaacaagaccaagtgcccgtgaaatccttttcctttaacaaaacacctgactgggntnnnnnnnnnnggnggggnnccccccnnntnnnccangggggggcacggggggcccccaattttttttttataaacccccccccccccccggggggaaaaaatatggtggaaccccctttttttt

SEQ ID NO: 59183 - protein, 121 aa, Zea mays
  misc_feature: Ceres CLONE 1514608
  misc_feature (4)..(113): Pfam Name: GASA Pfam Description: Gibberellin regulated protein
  misc_feature (57)..(57): Xaa is any aa, unknown, or other
  misc_feature (63)..(63): Xaa is any aa, unknown, or other
  misc_feature (66)..(66): Xaa is any aa, unknown, or other
  misc_feature (69)..(69): Xaa is any aa, unknown, or other
  misc_feature (82)..(82): Xaa is any aa, unknown, or other
MAPSKLAVVVALVASLLLVTTSNTKLGLFVLGQAAPGTYPPRDPPPHQIVDPAKDCXGACDVXVRXHSXKNICTRACLKCCXVCRCVPAGTAGQQQTWRQVLHRLDHARGTRPSAREILFL

SEQ ID NO: 59184 - DNA, 724 bp, Zea mays
  misc_feature: Ceres CLONE 1514610
  misc_feature: Encodes the peptide sequence at SEQ ID NO. 59185
tggagctccccgcggtggcggccgctctagaactagtggatcccccgggctgcaggaattcgtctcacccctagaaaaactcctctatcttcgcgtctggcacgagctgccaagcaaataacagtagagcggccagcgacgaccggcctgggccaccctttctgccgagcgtagccgagcaggtcgtcctcttcgtcgcaccaccccgtcagctatcatggccacaaggaggcactggtggtggtggtgcctgctgctgctggaggcttggtgctgcgccgcggccgcccactccccgccagcggcagacccgctgcatagcaagtgccagggggacttcgggaagctgacggactgcatggactacgcgacggggcacgcggcgtcaccctcgtccacctgctgcagccacgcctgctactcggagaacgcgcgccccgagtgcctctgctacatcttctagtgagtgctcacggcgcgcaaccaggtgcagtcgctcgtcctgcgcttcgaccgactcatggcgctccccgccgcctgcgacctctccaactccaacgtctcgctctgcatcaccctgctgaacctgaagtcgggctctgcgtactacgccctcttctgcaacgccatctagatcacgccgtcagtcggcgctaccctgtgagcgacagcgcctcgggtagcatcgtcatgctcttggctggggtcagcagcggcctactgt

SEQ ID NO: 59185 - protein, 81 aa, Zea mays
  misc_feature: Ceres CLONE 1514610
MATRRHWWWWCLLLLEAWCCAAAAHSPPAADPLHSKCQGDFGKLTDCMDYATGHAASPSSTCCSHACYSENARPECLCYIF

SEQ ID NO: 59186 - DNA, 725 bp, Zea mays
  misc_feature: Ceres CLONE 1514612
  misc_feature: Encodes the peptide sequence at SEQ ID NO. 59187
  misc_feature (387)..(387): n is a, c, t, g, unknown, or other
  misc_feature (388)..(388): n is a, c, t, g, unknown, or other
ctccccgcggtggcggccgctctagaactagtggatcccccgggctgcaggaattcgtctcacccctagaaaaaccccgccgccgccaccacttgctcgccttcgccccttctgtctcccttcgtccgtagcagaccaggaacgcccaaggcgctagcgtctccaagatggtgctgcaaaacgacattgacttactcaatccaccggcagagcttgagaagctaaagcacaagaagaagcggctagtccagtcccccaactccttcttcatggatgtcaagtgccagggctgtttcagcataaccactgtgttcagccactcccagactgtggttgtgtgccccagctgccaaactggtctgtgcaaacctaccgggtgggagggcnnagctcacgaggggtgctcctttcgtcgcaagggcgaataggtcctgctccccttaccgtgagagagataaatttgggtgttttgcaactttctcaggaaatgaactggaactcggggaggattttggttaattaattaaggcgtggtaaaccggccctgaaaaaggctggggggttaaccctggcctttgttttgaccgaagggccctccaaaaagggggctgtttgggtttttgccgaagggaagggcaagcgcaaataaaccaacggggggcgtttaaaaaaaaaaaaaaaaaaaaaaacctcgggaggccccttttctcccctaagggggggcg

SEQ ID NO: 59187 - protein, 86 aa, Zea mays
  misc_feature: Ceres CLONE 1514612
  misc_feature (30)..(84): Pfam Name: Ribosomal_S27e Pfam Description: Ribosomal protein S27
  misc_feature (74)..(74): Xaa is any aa, unknown, or other
MVLQNDIDLLNPPAELEKLKHKKKRLVQSPNSFFMDVKCQGCFSITTVFSHSQTVVVCPSCQTGLCKPTGWEGXAHEGCSFRRKGE

SEQ ID NO: 59188 - DNA, 732 bp, Zea mays
  misc_feature: Ceres CLONE 1514614
  misc_feature: Encodes the peptide sequence at SEQ ID NO. 59189
ggagctccccgcggtggcggccgctctagaactagtggatcccccgggctgcaggaattcgtctcacccctagaaaaaaagcaagcaagcaagcacttggcctctcaaccaacggggcgcgcacacgcacactgccaacgaggcaccaagaaggcaggaagggatggagtactgctaccagtacaacagcgtcagcaacgcggagaaggagaagaggccgccgctgaggaggggcggcgtcaagctccagatcgtgaagaccctcagcaacctcgtcgtggcgcccagcaacggcagcgactccaagcaagcggaccgcaacagcttcacaagggagcgaagctacaactgaaacgaactgtatcttcagtatttggatacagatgtcgaccttgtgtctgaagaactccgctttgggactcgagaggttttcttagcttgttggacttccttgtttgcttggtccactagtgatgaaatggaactgtatgaatagttcgttcccgtctgtgtttttgttttggaaaagaagcttctatggctcatacatagacaagggactaacggtaagacgaagtctttctagtctaaattagcccttacctaagttagtggattaactaagtttggaggacctatggggtggcgcaatattgtgcctacggcatccaagtaaaaaagttttatgctcgaaaaaaaaaaaaaaaaacggagacgttccaggtacccctt

SEQ ID NO: 59189 - protein, 62 aa, Zea mays
  misc_feature: Ceres CLONE 1514614
MEYCYQYNSVSNAEKEKRPPLRRGGVKLQIVKTLSNLVVAPSNGSDSKQADRNSFTRERSYN

SEQ ID NO: 59190 - DNA, 722 bp, Zea mays
  misc_feature: Ceres CLONE 1514617
  misc_feature (512)..(512): n is a, c, t, g, unknown, or other
  misc_feature (514)..(514): n is a, c, t, g, unknown, or other
  misc_feature (577)..(577): n is a, c, t, g, unknown, or other
tccccgcggtggcggccgctctagaactagtggatcccccgggctgcaggaattcgtctcacccctagaaaaaaagctacctagctagagctagtatctctatctacccgccattgcattgcaccacctctgtcctcgatatctcttgctcgaccacacacacacacacacaaacacacgatcgactggggtcgtctgctagtagcttggactaataacccttctgtatctgtatggatacggcaatgagccagcacagctccgacacctcgtccacgtcctcctactcgtccgacccctcctccacgtcgtccaccaccagcggcaagaagcgcccgcgcccgcacgccgccgccgccgccgccgccccggcgtaccgcggcgtccgcatgcgcgcgtggggcaagtgggtgtcggagatcatggagccccgcaagaagtcgcgcatctggctgggcaccttcccgcgcccggagatggcggcgcgcgcgcacgacgccccgcgctcacgntncaaggggcgcgcgcgccgtgcttcaacttccggccctcgagcgccactcccgcgcccggcctnccttgggcgccgcgcgacgtccaggccgccgtccgcgcgcggcggccgtcatgcacgacccataggctcaacaacctgatggagccggacggcaccccttgggaggaggtggccctggccggctagctggtgttcaacgaactgt

SEQ ID NO: 59191 - DNA, 731 bp, Zea mays
  misc_feature: Ceres CLONE 1514619
  misc_feature: Translation starting site: 159
  misc_feature (379)..(379): n is a, c, t, g, unknown, or other
  misc_feature (666)..(666): n is a, c, t, g, unknown, or other
aaagctggagctccccgcggtggcggccgctctagaactagtggatcccccgggctgcaggaattcgtctcacccctagaaaaaagccaagcaaataagacgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaagccgcgcccgagttcgtcgaggccgcggcggagtccggcgaggccgcccacggctgcagctgcggtggcaactgcaagtgcgacccctgncactgctgatcacatcgatcgacgaccatggatatgattattatctatctagcttgtggtggtggttgaacaataataagcgaggcccgagctggctgccatacataggtattgtgtggtgtgtgtgaaagaaagagaacagaattcttcagtttggcatctctctctgcatgtttggcggccgtctttgtgctcatgtacctacgtgggtctaccggcctggtggttgaaccgaatgcatccggtgaaaccatatattaatgggtccccgaagaaatgaatttggnccttttatttactaaaaaaaaaaaaaaaacgagaccgctcaaggacccaattcccctattaggag

SEQ ID NO: 59192 - DNA, 718 bp, Zea mays
  misc_feature: Ceres CLONE 1514622
  misc_feature: Encodes the peptide sequence at SEQ ID NO. 59193
  misc_feature (55)..(55): n is a, c, t, g, unknown, or other
  misc_feature (56)..(56): n is a, c, t, g, unknown, or other
  misc_feature (77)..(77): n is a, c, t, g, unknown, or other
  misc_feature (85)..(85): n is a, c, t, g, unknown, or other
  misc_feature (211)..(211): n is a, c, t, g, unknown, or other
  misc_feature (262)..(262): n is a, c, t, g, unknown, or other
  misc_feature (305)..(305): n is a, c, t, g, unknown, or other
  misc_feature (385)..(385): n is a, c, t, g, unknown, or other
  misc_feature (463)..(463): n is a, c, t, g, unknown, or other
  misc_feature (465)..(465): n is a, c, t, g, unknown, or other
  misc_feature (467)..(467): n is a, c, t, g, unknown, or other
  misc_feature (651)..(651): n is a, c, t, g, unknown, or other
  misc_feature (684)..(684): n is a, c, t, g, unknown, or other
  misc_feature (718)..(718): n is a, c, t, g, unknown, or other
cgacgctggagctcaccgcggtggcggccgctctagaactagtggatttcctggnnctgcaggattcgtctcatctntagggagntccaacccacacacaggctgaccccaccaacagcaagcgaaaatctcccgatcccctctagtctccgcggcgaagatgtcggggcgcggcaagggcgggaagggcctgggcaagggcggagcgaancgccaccggaaggtgctccgcgacaacatccaggggatcacgaagccggcnatccggcggctggcgcgcaggggcggcgtgaagcgcatctccnggctcatctacgaggagacccgcggcgtcctcaagatcttcctggagaacgtgatccgcgaccccgtcacgggggccgancacccgcgccacaaaaccttcccacccggggacgtcgtctacgcactcaggcgcccgggccgcgcccttctacggctncngntgggtaggctagggcccggcgcgccctctagggcatcgctgccgggtccaaagggttttgcacgtccggaggaggtggccgggtgggcaagagtgcgggggtaccgggccctacaaacgcggggcggggactggcgggtccgaaggaaaggcccacgtgtgggctcgtgcggtggtgtgccgcntcgctcagcaatgcctgcacagcgcaacgagcnatagacggggcggcctggggggatcgcccgtacn

SEQ ID NO: 59193 - protein, 174 aa, Zea mays
  misc_feature: Ceres CLONE 1514622
  misc_feature (25)..(94): Pfam Name: Histone Pfam Description: Core histone H2A/H2B/H3/H4
  misc_feature (17)..(17): Xaa is any aa, unknown, or other
  misc_feature (49)..(49): Xaa is any aa, unknown, or other
  misc_feature (75)..(75): Xaa is any aa, unknown, or other
  misc_feature (102)..(102): Xaa is any aa, unknown, or other
  misc_feature (103)..(103): Xaa is any aa, unknown, or other
  misc_feature (164)..(164): Xaa is any aa, unknown, or other
MSGRGKGGKGLGKGGAXRHRKVLRDNIQGITKPAIRRLARRGGVKRISXLIYEETRGVLKIFLENVIRDPVTGAXHPRHKTFPPGDVVYALRRPGRALLRLXXGRLGPGAPSRASLPGPKGFARPEEVAGWARVRGYRALQTRGGDWRVRRKGPRVGSCGGVPXRSAMPAQRNE

SEQ ID NO: 59194 - DNA, 734 bp, Zea mays
  misc_feature: Ceres CLONE 1514624
  misc_feature: Translation starting site: 195
  misc_feature (377)..(377): n is a, c, t, g, unknown, or other
  misc_feature (418)..(418): n is a, c, t, g, unknown, or other
ggagctccccgcggtggcggccgctctagaactagtggatcccccgggctgcaggaattcgtctcacccctagaaaaaattcccagctactgccagtgtgcatcctgagccatccattgggctccgtttccacccaatccaatggcgctcaggctctccctcgccccgccagcagctgcacccgcggcctccacatgccgctgcagcagcgcaagcttcatccggccgggcgtcgcagttgggagccgccggggcagggcgcgtggctgcgtggtggcgatggccgacctgctgggcgacttgagcgcgcgcgaccccttcccggaggagatcgagagccagtttggggagaaggtgctggcaacgtgaacacgctnccacagaaatctcatcccaccctctccgcgctcttcctcgngaaagctccgctgcagcccgacgcggagccgctctccctcgacgacgcgcgcaggctcctctttcaagtcgtcgggtggaaggtcgtcctctccgaacgcgacggaaacaagcaccgccccccgcggctgcaatgcttcttgaaaagtgcgccaaaaaacctggggccaaggaattcatcccccagaaataaccgcccgttcccagggccggaaaacgccccggggaaccctgggtttcaaggccccaaaccggggaagggcaaaatctcccacccccccccccccgggggaaagcctccccgtaaaaaaaaaatc

SEQ ID NO: 59195 - DNA, 671 bp, Zea mays
  misc_feature: Ceres CLONE 1514633
  misc_feature: Encodes the peptide sequence at SEQ ID NO. 59196
  misc_feature (389)..(389): n is a, c, t, g, unknown, or other
acagctggagctccccgcggtggcggccgctctagaactagtggatcccccgggctgcaggaattcgtctcacccctagaaaaaatcgggaccttcctcggacacaacatcgtcgacaatcacgacctacttctataccttgttttgttttcatctagagtcagtcggtccattgtttgttcccagtctggtgattaaaagtctgcaaattctgtttgtggaattggcagcgatacaaatttggcttctttaagtaaatccggttggcggtacacagcggtattaaaacatctcaataatcgctctaattgtttgcattccacctgcattgatctttgaagggcccaagctaatgcagcatggatttagtgatgccattgcaaaagtangtttgacaaagtttgtcactgacctattcttggtaggactgatctaccatctgtataaccagattgctacaaacaccttggagcgagtggctcctctgacacatgctgtcggcaatgtgttgaaacgtgtttttgtcatcgggttctcaatcattgtgttttggaaccaaattagcacaccaaactggaaatgggcccgtccattgcccaaacctggtgtttccaatgtaactcctacattaaagcctaaaaattgaagaggaaaaaaaaaaaccacaaacc

SEQ ID NO: 59196 - protein, 97 aa, Zea mays
  misc_feature: Ceres CLONE 1514633
  misc_feature (13)..(13): Xaa is any aa, unknown, or other
MQHGFSDAIAKVXLTKFVTDLFLVGLIYHLYNQIATNTLERVAPLTHAVGNVLKRVFVIGFSIIVFWNQISTPNWKWARPLPKPGVSNVTPTLKPKN

SEQ ID NO: 59197 - DNA, 712 bp, Zea mays
  misc_feature: Ceres CLONE 1514638
  misc_feature (53)..(53): n is a, c, t, g, unknown, or other
  misc_feature (58)..(58): n is a, c, t, g, unknown, or other
  misc_feature (75)..(75): n is a, c, t, g, unknown, or other
  misc_feature (225)..(225): n is a, c, t, g, unknown, or other
  misc_feature (263)..(263): n is a, c, t, g, unknown, or other
  misc_feature (264)..(264): n is a, c, t, g, unknown, or other
  misc_feature (271)..(271): n is a, c, t, g, unknown, or other
  misc_feature (272)..(272): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
aagctggagctcaccgcggtggcggccgctctagaactagtggatttcttggnctgcnaggattcgtctcatctntaggggaggccggccaccgcgaatccagagccccacgccccgtccgaaccccagagcagagcaaagcctcctcgacctccctgtccccagccttccccgatggcccgcacgaagcagacggcgcgcaagtcgactaggcggaaggcgccncgggagcagctggggtataaggcggcccgccattcggnnttgtaanngggggctttattaattcggccgggggcgccccggcccccgccgccttgctctaaatcttaaggtctgtgtggttttttcgctctttgttcctcaccccccccgagggggggggctttttttccccctccccctccgcccannnnnntcgggcgccccgcgggggggtggactcccgcgggcggggggcgggggggggcgcccgcggggggctcccgtggggtccgctccgttcgggcgctctgcgcgagggtgtttcgggttgcgagggggggggatgtccgggggccgcgatgctttggccgagggggcgccgctggtgggggcgccgcgccccccccgccgcgccttgggtgcgggccgtggcgctcatccattgcgcgcggcgggctgcggtgcggtttcaatgggccctgcgtccaagccggccagccccccccgg

SEQ ID NO: 59198 - DNA, 736 bp, Zea mays
  misc_feature: Ceres CLONE 1514640
  misc_feature: Encodes the peptide sequence at SEQ ID NO. 59199
  misc_feature (325)..(325): n is a, c, t, g, unknown, or other
  misc_feature (333)..(333): n is a, c, t, g, unknown, or other
  misc_feature (652)..(652): n is a, c, t, g, unknown, or other
  misc_feature (653)..(653): n is a, c, t, g, unknown, or other
  misc_feature (682)..(682): n is a, c, t, g, unknown, or other
  misc_feature (683)..(683): n is a, c, t, g, unknown, or other
ctccccgcggtggcggccgctctagaactagtggatcccccgggctgcaggaattcgtctcacccctagaaaaatccgcatttccatcctgtcgtgggatcccagccaccgccgctagaagaagagctcggcgattcccaggtcccgcgagaatatgccgaagcagatccatgagattaaggacttcctcctcaccgcgaggaggaaggatgcccgctcagtgaagatcaagaggagtaaggatgttgtcaagttcaaggtgcgctgctcccagtacttgtacacgctctgcgtcttcgatgctgagaaggcaaacaagttgaangcatctcntcccccaggtttgaccgtcgagggagtctgattggatacatgggcacgccgattgaactaccccagcttctttatcagtagcagagcatgctactctatggactttttggaactaaactattaaacctgtcagggttggatggcctgaatcttgcatttttggagaaataccttttacctcctttcagggatgcagtaattttcttgtttacctggcccttactttatattttgggctggtttcaacctttccccaaaaaaaaaataacaaaattttggggcttttaatggtaaggcgcttggggggggtggctttaannaaaaaaaaaaaaaaagggggaaaaaaaanngggggggggggcccgggggccccatttccccctatagggggggggttttcccc

SEQ ID NO: 59199 - protein, 69 aa, Zea mays
  misc_feature: Ceres CLONE 1514640
  misc_feature (2)..(69): Pfam Name: Ribosomal_L38e Pfam Description: Ribosomal L38e protein family
  misc_feature (57)..(57): Xaa is any aa, unknown, or other
  misc_feature (60)..(60): Xaa is any aa, unknown, or other
MPKQIHEIKDFLLTARRKDARSVKIKRSKDVVKFKVRCSQYLYTLCVFDAEKANKLXASXPPGLTVEGV

SEQ ID NO: 59200 - DNA, 717 bp, Zea mays
  misc_feature: Ceres CLONE 1514645
  misc_feature: Encodes the peptide sequence at SEQ ID NO. 59201
  misc_feature (385)..(385): n is a, c, t, g, unknown, or other
cagagctggagctcaccgcggtggcggccgctctagactagtggatttcttgggctgcaggaattcgtctcacccctagaaaaaagccaagcaaataagacgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggcccctgagaagaaggccgcgcccgagttcctcgaggccgcggcggagtccggcgaggccgcccacggctgcagctgctgtggccaccgcaagggcggcggggggggctncttaatccctcaacccacccccaccggatatgagtattatcctatctggctggggggggggggcggaacaataataagcccaggccggacctggctcgccctaccgcggggatgggcgcggcggggggcgagagacgcgaaaaacaagagtttctccacttggcgcaccaccccgcggcgggttgggccgcccgcctcctgggcaccggggccgcccggggcgtctaccagcgcggggggcgtgcatccgaggcgctcccgccgtgccccgaccgtgcaaagagccacgagcggaatgcggtggaccctgaggcgttgccggtgacaggaag

SEQ ID NO: 59201 - protein, 183 aa, Zea mays
  misc_feature: Ceres CLONE 1514645
  misc_feature (1)..(66): Pfam Name: Metallothio_2 Pfam Description: Metallothionein
  misc_feature (76)..(76): Xaa is any aa, unknown, or other
MSCNCGSSCGCGSSCKCGKKYPDLEETSTAAQATVVLGVAPEKKAAPEFLEAAAESGEAAHGCSCCGHRKGGGGGXLIPQPTPTGYEYYPIWLGGGGGTIISPGRTWLALPRGWARRGARDAKNKSFSTWRTTPRRVGPPASWAPGPPGASTSAGGVHPRRSRRAPTVQRATSGMRWTLRRCR

SEQ ID NO: 59202 - DNA, 732 bp, Zea mays
  misc_feature: Ceres CLONE 1514646
  misc_feature: Encodes the peptide sequence at SEQ ID NO. 59203
ggagctccccgcggtggcggccgctctagaactagtggatcccccgggctgcaggaattcgtctcacccctagaaaaatctccgttgagtcgaggcggctccaactccggttcgtggactcgcggaccaacatggccgccccttcgccctcgccggtggaggctaccctaccgcctgacgccgcggctgccgccgaggaagaccagtgcgatgctgacggatatgtcattcctaatttgcccactcaacataatgatgtggctgagcctaatgtccgcaaatacaaagatccctgagcctctacagcgcaacgatgagagaatatacttcgggacatcatggagcttccctatctcatgcaagcatctcgagctgaactccgttgcccgcaagcatctggtccagaaccacctgaatgaagcgataaggaattcccccgccatgctccggagaacagggggaaaacctagggaccttatgggtgctaaaaggggtaccacctgccaaaaaaattccccccgggttggttccaccccccttgcccttatttttaattccccgaaaacaccctttaattaaccggcaaagaagcccggggggttttaccgaaggttgatttcccggtgccccctggggggggtttttttcccccaataaaacaactttggggtcacccagaacccttgtgttcccggggggggaaaaaatctttttttttgtggggtggggggg

SEQ ID NO: 59203 - protein, 54 aa, Zea mays
  misc_feature: Ceres CLONE 1514646
MAAPSPSPVEATLPPDAAAAAEEDQCDADGYVIPNLPTQHNDVAEPNVRKYKDP

SEQ ID NO: 59204 - DNA, 689 bp, Zea mays
  misc_feature: Ceres CLONE 1514651
  misc_feature: Encodes the peptide sequence at SEQ ID NO. 59205
agagctggagctccccgcggtggcggccgctctagaactagtggatcccccgggctgcaggaattcgtctcacccctagaaaaaaaaacttccagccgtctcctccgcacgcgaaaaccctagcagctccgtagtccctctcctctggaggtattcgcagtcgaccgtgtcctcggagcacgatgaaggttgttgctgcctacctgcttgctgtcctcgctgggaatgccagcccctccgctgaggatttgactggcattctggagtcagttggctgtgaagttgacaatgaaaggatggaactgctgctgtcccaactgagcggtaaggacatcaccgagctcattgccgcgggcagagagaagtttgcttcagtcccatgtggcggcggcggtgtggctgttgccgcaggtgcacctgctgctggcggagctgctcctgcagctgaggcaaagaaagaagagaaggtggaagagaaggaagaaagcgatgatgatatgggcttcagcctcttcgactaggttgcacagtcatcacagtattgtttcgggcagggaaatcaaaggggaaaccagagtcatgtttagatttaaaccttattttaatgttgggaaatacctgcaaagactggctaattgcctctgtatttggggaattcaacctgaaatttgctatgaaggttggggatt

SEQ ID NO: 59205 - protein, 112 aa, Zea mays; identical to SEQ ID NO: 58739
  misc_feature: Ceres CLONE 1514651
  misc_feature (17)..(111): Pfam Name: Ribosomal_60s Pfam Description: 60s Acidic ribosomal protein

SEQ ID NO: 59206 - DNA, 663 bp, Zea mays
  misc_feature: Ceres CLONE 1514654
  misc_feature: Encodes the peptide sequence at SEQ ID NO. 59207
  misc_feature (138)..(138): n is a, c, t, g, unknown, or other
  misc_feature (436)..(436): n is a, c, t, g, unknown, or other
  misc_feature (437)..(437): n is a, c, t, g, unknown, or other
  misc_feature (457)..(457): n is a, c, t, g, unknown, or other
  misc_feature (482)..(482): n is a, c, t, g, unknown, or other
  misc_feature (546)..(546): n is a, c, t, g, unknown, or other
tccccgcggtggcggccgctctagaactagtggatcccccgggctgcaggaattcgtctcacccctagaaaaaatcgcatccatccaccacgcaccccaccaacccatacccataccagaggctctctgattttactntctcagcggtagaatcggctgagcgagcgagcgagcgaggcacacggagctagctaaacagagcacacggatagaaaagcaagatgtcggacggcacggcgacctgcatcgacatcatcctcgccattatcctgccgccgctcggggtcttcttcaagttcggctgcggggttgagttctggatctgccttatcctcaccttcttcggctacctccccggcatcatctacgccgtctgggccatcaccaagtagccggccgggtgcgtagcatggcatgcgcgcgcagggtgatctcnntggcgggggacgcgtgtgcncgtgtcttgagatgtgatccctccntcccctgttaggtgctgctgctcctgcgggggtagtactgggggatcccaggcctttaaattcntggaataattggcccggctgaaaaaatcaggaccccggcctggggggttcctgccccaccccccgtggacttgggaaaaccgttccccccccggggggtgggggggccctttttcct

SEQ ID NO: 59207 - protein, 56 aa, Zea mays; identical to SEQ ID NO: 52841
  misc_feature: Ceres CLONE 1514654
  misc_feature (6)..(56): Pfam Name: UPF0057 Pfam Description: Uncharacterized protein family UPF0057

SEQ ID NO: 59208 - DNA, 665 bp, Zea mays
  misc_feature: Ceres CLONE 1514655
  misc_feature: Encodes the peptide sequence at SEQ ID NO. 59209
aaagctggagctccccgcggtggcggccgctctagaactagtggatcccccgggctgcaggaattcgtctcacccctagaaaaaactccccgcaccattccgagttttctccccaccctcctccgtggctgccagtcccgcgggagcgcagcgcgcgctgctctacggtcgccgcgcgccgttcgcgggagcgctcctgtttttcagcatcggcgccgtcagcgctgcggtcgcgttcaggacagggtgcgccatctcacaccgacgtccccccttcctcggggcaagaggtctcagttccactagaatggagtcagcttcgaccacagtgccatccattgtcgtgtatgtgacagttccacatagggaagcatgtacgaagctgtcacagagcatcatctgcgagaagcttgctgcttgtgtcaatatagtacctggcattgaatccatgtactggtgggaggcaaaggtaccatctgatgctgaaagattactcatcatcgagaccagggaatcccttctggaagccttgcctgcccctgtcccagccaatcatgaatttgatgtccctgaattattgctcggcccataactgggcggaacccctagtatttggaaggatcaaaaccaacaccgggaaaagtgatctttttttttttcggacc

SEQ ID NO: 59209 - protein, 94 aa, Zea mays
  misc_feature: Ceres CLONE 1514655
  misc_feature (10)..(93): Pfam Name: CutA1 Pfam Description: CutA1 divalent ion tolerance protein
MESASTTVPSIVVYVTVPHREACTKLSQSIICEKLAACVNIVPGIESMYWWEAKVPSDAERLLIIETRESLLEALPAPVPANHEFDVPELLLGP

SEQ ID NO: 59210 - DNA, 679 bp, Zea mays
  misc_feature: Ceres CLONE 1514658
  misc_feature: Encodes the peptide sequence at SEQ ID NO. 59211
aaagctggagctccccgcggtggcggccgctctagaactagtggatcccccgggctgcaggaattcgtctcacccctagaaaaatccctcgctgcgccataaggctgcgactgcgagagccagccgcacccgcaccagtccataggccggcctcctctcttaccttcccacaccccttctcgaccgtacgtagcctagttgtgcttggtagccagccagaaggtcgtcggccgatgatgggaggaagaacagtggccccgccgctcgtcctcgcgctggtgaccatcatcgccatcgcggcggccgagggggacgaggtgaagtgtggcgggtgctctccgtgcggcggcgccgactgcccggtgctgtacccgtcgccgcccccgccgccgtactactactacagccctcccccacccgcgacctaccccggggagtcctcgtcatactaccagccgcccgcgccgggcgcgtacatccagatcgggagcgcgccgccgggcaaggcccgctgtacccgcaggacccagggttcatcccggcccggggcggcggggccgcgccgcggcgcttggggtcgttcctgccctcgcaccggggtttggcttgccccatggcccttattgggatctcaaagggcttgaactggaccagcgccaggcgaactgctttattcctc

SEQ ID NO: 59211 - protein, 136 aa, Zea mays
  misc_feature: Ceres CLONE 1514658
MMGGRTVAPPLVLALVTIIAIAAAEGDEVKCGGCSPCGGADCPVLYPSPPPPPYYYYSPPPPATYPGESSSYYQPPAPGAYIQIGSAPPGKARCTRRTQGSSRPGAAGPRRGAWGRSCPRTGVWLAPWPLLGSQRA

SEQ ID NO: 59212 - DNA, 665 bp, Zea mays
  misc_feature: Ceres CLONE 1514660
  misc_feature: Encodes the peptide sequence at SEQ ID NO. 59213
ctggagctccccgcggtggcggccgctctagaactagtggatcccccgggctgcaggaattcgtctcacccctagaaaaactttctcgagcctgacccttacgccttcgctcgcgccgccgccgccgccgccgctacgccccgcacctcgcttcatttcgtgtcgccaagatgacgaagcgcactaagaaggcaggaattgttggcaaatatggaaccaggtatggtgctagcttgcgtaagcaaatcaagaagatggaggtatctcagcattccaagtacttttgcgagttctgtgggaagtttgctgtgaagaggaaagcagttggaatttgggggtgcaaggactgtgggaaggtgaaggctggtggtgcttacaccatgaacactgctagtgcggtcaccgtcaggagcacgatccgccgcctgagggagcagactgaagcatgatatagctctttatattattggggtttcctgtagttgctcttgtcaggcatgttgtgggggccttatctagtggaaatgtggaatcactgtactggctgttttgcgagacatgctccttatattggttatgctctaggatctcaaagtgtgttaagattgcccttgttaccgtctgatctgacagtgatattcatctatgcaatctgacgtcaaatt

SEQ ID NO: 59213 - protein, 92 aa, Zea mays; identical to SEQ ID NO: 7812
  misc_feature: Ceres CLONE 1514660
  misc_feature (2)..(91): Pfam Name: Ribosomal_L37ae Pfam Description: Ribosomal L37ae protein family

SEQ ID NO: 59214 - DNA, 687 bp, Zea mays
  misc_feature: Ceres CLONE 1514662
  misc_feature: Encodes the peptide sequence at SEQ ID NO. 59215
  misc_feature (431)..(431): n is a, c, t, g, unknown, or other
  misc_feature (634)..(634): n is a, c, t, g, unknown, or other
ggagctccccgcggtggcggccgctctagaactagtggatcccccgggctgcaggaattcgtctcacccctagaaaaaagatcctgccttggaaagaaggtttcaaccagttaaggttccagagcctactatggatgaaacaatacagatcttaagaggacttcgtgagagatatgaacttcatcacaaactgagatacacagatgatgctttaattgctgctgcacagctgtcttatcagtatatcagcgatcgttttctgcctgacaaagccattgacttgattgatgaagctggatctcgtgttaggctgaggcatgcgcagctccctgatgaagccaaagagctggacaaagagctgcggcagataagcaagcaaaaaaatgaggctgtacttggccaaaattttgagaaggtatactgttgttttncacagcggtgaacaagccgatccgctcccccctctctagcaacgtccatatgggttaaaaccaagcataatggtggttcccttttgaaaaaaaacggtttgttaccggaatttacccttttgccccccccctcctggtttttggtccaaaaagcctggagccaaagggctaaccgaagaagaaaaccccttaccctttgtttngggccgcgaaaaaacaaagagaaaggcccggaggccccttcgggggtaccccg

SEQ ID NO: 59215 - protein, 103 aa, Zea mays
  misc_feature: Ceres CLONE 1514662
  misc_feature (101)..(101): Xaa is any aa, unknown, or other
MDETIQILRGLRERYELHHKLRYTDDALIAAAQLSYQYISDRFLPDKAIDLIDEAGSRVRLRHAQLPDEAKELDKELRQISKQKNEAVLGQNFEKVYCCFXQR

SEQ ID NO: 59216 - DNA, 678 bp, Zea mays
  misc_feature: Ceres CLONE 1514663
  misc_feature: Encodes the peptide sequence at SEQ ID NO. 59217
ctccccgcggtggcggccgctctagaactagtggatcccccgggctgcaggaattcgtctcacccctagaaaaaatctcacgccgcatcctccctcgagcccaagcaaacaagggcggacgcggagccggcggcggagcggaaatggcggacaagaagcgaggcgccggcactcgcctgggtgaggtggtgacactccagtaccctgtcgacctccacgaacgcctccacggatgcgcctttaagaataaggctccaactgccttgagcgagatctggaagttcgcttagagggccatgggaactactgatgtccggattgacgtgtatctcaacaagcacatctggagcagtggtatccgcagtgtgcctaggcgagtccgtgttagaattgcccgccaccgtcacgatgacgatcacgcccatcatgaactctactctctggtcacagttgctgagatcccaccggagggtctcggatgtttggaatctaaagtcgttgacgatgaggattaggccctgtataccatgacatacatttgagagtgttgcttgagctcattgttatctactgccaatgactcatgcaatagaaccttctacacttgtctcctttccagtatgcatatatccccatggtatttcatggtcctaaaaaaagagagacccgataccctcg

SEQ ID NO: 59217 - protein, 72 aa, Zea mays
  misc_feature: Ceres CLONE 1514663
  misc_feature (1)..(54): Pfam Name: Ribosomal_L31e Pfam Description: Ribosomal protein L31e
MGTTDVRIDVYLNKHIWSSGIRSVPRRVRVRIARHRHDDDHAHHELYSLVTVAEIPPEGLGCLESKVVDDED

SEQ ID NO: 59218 - DNA, 712 bp, Zea mays
  misc_feature: Ceres CLONE 1514664
  misc_feature: Encodes the peptide sequence at SEQ ID NO. 59219
  misc_feature (408)..(408): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
tggagctccccgcggtggcggccgctctagaactagtggatcccccgggctgcaggaattcgtctcacccctagaaaaaaaactcgcagatcgagtccaagcattcaccggaggatcccaaatcacactctccagtaaccgtccgcttctccagccgcatctctagccgagtctatctcctcctcctccgccgccgccgcaactatcctaatggctcgcttcgccgtggtcgccgccatcatcgccctcctcgccgacatcacggcggcgcatgccccgatcacagctcccaaggacgcgcccaggatggccccgctgccgcctccccctgcacgggcatcggccacagcctctggcgccagccgccaagccgactgtcggcaacctggcatactgccgtggcccccncccccgctgggctgatgtaatgtaccgaccaattaacccccccccccccccgggggggatctgaaaagggctccgaactaggtcaaattccacacccccggtcggggcccccccccggcccctccttccgggggggcaccccacccatggaggccccctgccaagcgnnnnncccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 59219 - protein, 70 aa, Zea mays
  misc_feature: Ceres CLONE 1514664
MARFAVVAAIIALLADITAAHAPITAPKDAPRMAPLPPPPARASATASGASRQADCRQPGILPWPPPPLG

SEQ ID NO: 59220 - DNA, 563 bp, Zea mays
  misc_feature: Ceres CLONE 1514665
  misc_feature (220)..(220): n is a, c, t, g, unknown, or other
  misc_feature (373)..(373): n is a, c, t, g, unknown, or other
  misc_feature (396)..(396): n is a, c, t, g, unknown, or other
  misc_feature (397)..(397): n is a, c, t, g, unknown, or other
  misc_feature (516)..(516): n is a, c, t, g, unknown, or other
  misc_feature (517)..(517): n is a, c, t, g, unknown, or other
  misc_feature (524)..(524): n is a, c, t, g, unknown, or other
  misc_feature (526)..(526): n is a, c, t, g, unknown, or other
tggcggccgctctagaactagtggatcccccgggctgcaggaattcgtctcacccctagaaaaactccacccgtcgccgcttcctcccgttagactaggttaggctagggtgtcgaccagctcgcggaaatggtggccttcaggttgcatcaggacccggtggtggggcgcgcgcttcccaaccccggtgattagcaccccaagaactatccgattaagnttttcggcccccccccctattccccgcccccacaaaaagatccttttttccccccccgcccaggaccacaacacgctgaaaaaaaatcttttttttctgcgccctctggcccccccacggacaacccaccctttttttttccccccccccccncgggggggaacgaaaaggggagnnactccctcttcccccttttttttataccccccccccttctcccccttcatcccccccgcccatagcggagtctcaaaccctcccaccccccccttactgcgcatcccaaccactacatnnatgactntngcccccttaagtaaatgttccttcccccccctgcacc

SEQ ID NO: 59221 - DNA, 695 bp, Zea mays
  misc_feature: Ceres CLONE 1514666
  misc_feature: Encodes the peptide sequence at SEQ ID NO. 59222
  misc_feature (542)..(542): n is a, c, t, g, unknown, or other
  misc_feature (588)..(588): n is a, c, t, g, unknown, or other
  misc_feature (633)..(633): n is a, c, t, g, unknown, or other
  misc_feature (687)..(687): n is a, c, t, g, unknown, or other
ggagctccccgcggtggcggccgctctagaactagtggatcccccgggctgcaggaattcgtctcacccctagaaaaaaaaaaaagttcgtgatgatgccctcttggatttctataacaagtggcagcatgaatacttggttgtaagcaagtggtttgctcttcaagctacttcagagattcctggaaatgttgcaaatgttcagaagctgctgtctcaccctgctttcgacctgaggaatcccaacaaggtgtactcactaatcgggggattctgtggctcacctgtgaacttccacgcgaaagatggttctgggtacaagttcttgggtgagatcgttttgcagcttgacaagataaaccctcaggtggcctcccgcatggtttcagcattttctcggtggaggcggtacgacaagaccagacaagctcttgctaaggcccagctggagatgatcgtgtcggccaatgggctctccgaaaacgtgttcgagattgcttcaaaaagcttggcggattagcttgggcagttccgaggaattngcgagtggagtgcttaactgaatctctcttttgttggtaaaatgancagtagagataataaacaggcgggccgaatttgcatgaactgatnaaatataagtgtgatgatgcccccgctttgtgggggcttttggagcatgcatgncgcgctcc

SEQ ID NO: 59222 - protein, 46 aa, Zea mays
  misc_feature: Ceres CLONE 1514666
  misc_feature: SWISSPROT Homolog: EC 3.4.11.2 Membrane alanyl aminopeptidase
MVSAFSRWRRYDKTRQALAKAQLEMIVSANGLSENVFEIASKSLAD

SEQ ID NO: 59223 - DNA, 735 bp, Zea mays
  misc_feature: Ceres CLONE 1514667
  misc_feature: Encodes the peptide sequence at SEQ ID NO. 59224
aactgtggagctccccgcggtggcggccgctctagaactagtggatcccccgggctgcaggaattcgtctcacccctagaaaaactctcgtcggtggattccatgtccaaccgcgtcgccggaggccggaaccatgaagcctgtcagtgtcgccgaacacaacaaccaccagcatcgcctgcactcccccacgccggcgtcggcgaccaagatctcgatccccatctcttcgagcgaggcggcgctgttcgggaagggtaggtacaaggtgtgggccctctcggccatcgcgctcctagagctctggtccatgttcgccgcctccgtcacgctgcgcttgtcctccgtcaatctcgctaccacctccccccaccggagcggggggggtcatcaacaaacttaatcccccccccatggaccaaaaaaaaaagctaacggccccggaaggggggatgtgaacacacccccaaaaaaaccctggacgggtaccaacgggttctggccaaaaaaactttggaggtggcctttgagggagctgggctgggtgaagaaacgcctaacatgtgaagccgacctaatccggaaaattggcccgcgtgacaatcccaatagccccggaggtttgagcccccgcccccaccaatggattgacggagttgaatcaaaccgcctctatgttgcgcaacttctcctgggctcaaacggccacaccgcaccgcaaaagaaggagtgccg

SEQ ID NO: 59224 - protein, 89 aa, Zea mays
  misc_feature: Ceres CLONE 1514667
MKPVSVAEHNNHQHRLHSPTPASATKISIPISSSEAALFGKGRYKVWALSAIALLELWSMFAASVTLRLSSVNLATTSPHRSGGGHQQT

SEQ ID NO: 59225 - DNA, 477 bp, Zea mays
  misc_feature: Ceres CLONE 1514676
  misc_feature (177)..(177): n is a, c, t, g, unknown, or other
  misc_feature (192)..(192): n is a, c, t, g, unknown, or other
  misc_feature (193)..(193): n is a, c, t, g, unknown, or other
  misc_feature (202)..(202): n is a, c, t, g, unknown, or other
  misc_feature (204)..(204): n is a, c, t, g, unknown, or other
  misc_feature (207)..(207): n is a, c, t, g, unknown, or other
acccgcggtggcggccgctctagaactagtggatcccccgggctgcaggaattcgtctcacccctagaaaaagttccgttccttccgtccatccatccgccatggcgaccgctacgctactgagctcctccttcgccatgcccgccgccgcccgtagggcctcctccccttcctccngcctcattgaagctnntcgccacgntncgncaggctttcgccggggctttctccccttcttcggccggggggttttggaaacttcccaaaccgggcggttgccccttcccttctccccaaaaaagaggaaaaaaagttcccccgccccccatttttttccccccggggggggggtggccccttttccggaaaaaaaaaaaaaaccggggaaaaaaaggtttttttttttccccccccaaaaaaaaaaaaaaaaccctttttttggaaacccctcccaaaaaaagaaaaaggtgggggggg

SEQ ID NO: 59226 - DNA, 655 bp, Zea mays
  misc_feature: Ceres CLONE 1514678
  misc_feature: Encodes the peptide sequence at SEQ ID NO. 59227
aaagctggagctccccgcggtggcggccgctctagaactagtggatcccccgggctgcaggaattcgtctcacccctagaaaaaccactcgccctcccacacagaaaaccctagccgccgccaccgaagcggcctcccaggtaagcaggagcgtccaccccgccgccgtcatgaagcgcaatccccgcgtcacgagctcccgccggaagtgccgcaaggcgcactttacggccccgtcctccgtccgccgcgttctcatgtccgccgggctgtcgacggagctccgccacaagtacaacgtgcgctccatcccgatccgcaaggacgacgaggtgcaggtcgtgcgcggcacctacaagggccgcgaggggaaggtggtgcaggtctaccgccgccgctgggtcatccacgtcgagcggatcacccgcgagaaggtgaacggctccaccgtgaacgtgggcatccacccctccaaggtgatcgtcactaagctgaagctcgacaggaccgtcaggcgctccctggactgcaggccggggcctgcgcgccgacaagctaagggcaagttactgccgacgacgtcgctgccgccggcgctggtggcgccgccaccgcggctctctccagagatcgactaggctcttcacgtcatctg

SEQ ID NO: 59227 - protein, 155 aa, Zea mays
  misc_feature: Ceres CLONE 1514678
  misc_feature (51)..(82): Pfam Name: KOW Pfam Description: KOW motif
MKRNPRVTSSRRKCRKAHFTAPSSVRRVLMSAGLSTELRHKYNVRSIPIRKDDEVQVVRGTYKGREGKVVQVYRRRWVIHVERITREKVNGSTVNVGIHPSKVIVTKLKLDRTVRRSLDCRPGPARRQAKGKLLPTTSLPPALVAPPPRLSPEID

SEQ ID NO: 59228 - DNA, 684 bp, Zea mays
  misc_feature: Ceres CLONE 1514681
  misc_feature: Encodes the peptide sequence at SEQ ID NO. 59229
tccccgcggtggcggccgctctagaactagtggatcccccgggctgcaggaattcgtctcacccctagaaaaaatcgccagacacactatagaccacagccagtcagccacatcactagctagctgtgcagaggcaatggcgtccaaggttgagctggtggtggaggtcaagtccccggctgacaagctgtgggcggcgctgcgcgactccacggagctgttccccaagatcttccccgagcagtacaagagcatcgagaccgtcgagggcgacggcaagtcggccggcaccgtccgcctcctcaagtacaccgaggcggtgccgatgctgacgttcgccaaggagaagcttgacacggcggacgacgagaacaaggtggtgtcgtacagcgtggtggacggcgagctggcggacttctacaagaacttcaagatcacgctgaaggtgactccggccaaggcggacggcgagggcggcgccgtcgtcagctgggccatggagttcgacaaggccaacgacccagtggccgacccggacgtcatcaaggagaccgcccccaagacgtttcccgacctcaacaactacctcctcaagaactagatgggatcgacaactggcaaatggtccagaaaaagtacaggttccggtccctttcaccggacgcgtcccaattttactaggtg

SEQ ID NO: 59229 - protein, 154 aa, Zea mays
  misc_feature: Ceres CLONE 1514681
  misc_feature (1)..(154): Pfam Name: Bet_v_I Pfam Description: Pathogenesis-related protein Bet v I family
MASKVELVVEVKSPADKLWAALRDSTELFPKIFPEQYKSIETVEGDGKSAGTVRLLKYTEAVPMLTFAKEKLDTADDENKVVSYSVVDGELADFYKNFKITLKVTPAKADGEGGAVVSWAMEFDKANDPVADPDVIKETAPKTFPDLNNYLLKN

SEQ ID NO: 59230 - DNA, 653 bp, Zea mays
  misc_feature: Ceres CLONE 1514682
  misc_feature: Encodes the peptide sequence at SEQ ID NO. 59231
  misc_feature (352)..(352): n is a, c, t, g, unknown, or other
  misc_feature (401)..(401): n is a, c, t, g, unknown, or other
  misc_feature (534)..(534): n is a, c, t, g, unknown, or other
agctccccgcggtggcggccgctctagaactagtggatcccccgggctgcaggaattcgtctcacccctagaaaaagtgctttcttagaggtgggttggcttctcctccccctccggttcgggttcgggttcgtgaggttctccggggttcgggttcgtgggtgagcggatcaagatggcctcctcgaatgttgagtaccgctgcttcgtcggcggtctcgcctgggccacggacgaccactccctctacaacgtcttcagcacctactgcgaggtcctcgagtccaagatcatcctctatcggaagacgcagagctcccgcggcttcggcttcgtcaccttctacacggangaggccatgcggaacgccatctaggtcatcaactgcaaggagcatgacngccgctacatcaccgtctacgaggaccattcctgcgccgcccttgaaggcggctactgtggggtacgctcgtggcctttggaggctggcgcctaccgccgtggggggaccccctgaaggcggtccctcctacngcagaaggcccgggctccgttgggggtagggattaccgggggggggcgcctccggcaaaatccgtttggaaacagtgggggggggctaacggaaactccaaacggaaatggaagccacg

SEQ ID NO: 59231 - protein, 66 aa, Zea mays
  misc_feature: Ceres CLONE 1514682
  misc_feature (10)..(67): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (59)..(59): Xaa is any aa, unknown, or other
MASSNVEYRCFVGGLAWATDDHSLYNVFSTYCEVLESKIILYRKTQSSRGFGFVTFYTXEAMRNAI

SEQ ID NO: 59232 - DNA, 720 bp, Zea mays
  misc_feature: Ceres CLONE 1514683
  misc_feature: Encodes the peptide sequence at SEQ ID NO. 59233
  misc_feature (396)..(396): n is a, c, t, g, unknown, or other
ctccccgcggtggcggccgctctagaactagtggatcccccgggctgcaggaattcgtctcacccctagaaaaaagccgaagcgactgtcgcgaggcaaggccatcgtccgccatgacgctctccctctccacctctttcctccccatccccgccgccgcgaggaccaccgcccgcaccctacgctccgtcgtcccctcccaggggatgcgctgctcgatgcgcaagaaggggttgcacccggagatctacgaggacgcgaaggtgtactgcaacggcgagctggtgctggtgacggggggcaccaagccggagtacacggtggacgtgtggtctggaaaccacccctactatgtcggcgacacctcggcgctcgtggtcatggacagccagatcnagaaagtcccgcaagaggtggggccacatcaaaggagtactggccccgaggaacagtgggaaggaagatgcacccagacggcgaaccgggattccgaccccgagggggacaactgaaatgaagggttccccctccttcctccccccgggggcggggcccccgggcccaatttaactttcgccctcttgaaaggaaatcagaaacttctgcgtgtccccttggctcccccggggttccgggtaatgttccgaaagggaaaatttccaattttccccccctttcccaaataaggggctttggttatatatgggccccccccaaaaa

SEQ ID NO: 59233 - protein, 132 aa, Zea mays
  misc_feature: Ceres CLONE 1514683
  misc_feature (36)..(104): Pfam Name: Ribosomal_L31 Pfam Description: Ribosomal protein L31
  misc_feature (95)..(95): Xaa is any aa, unknown, or other
MTLSLSTSFLPIPAAARTTARTLRSVVPSQGMRCSMRKKGLHPEIYEDAKVYCNGELVLVTGGTKPEYTVDVWSGNHPYYVGDTSALVVMDSQIXKVPQEVGPHQRSTGPEEQWEGRCTQTANRDSDPEGDN

SEQ ID NO: 59234 - DNA, 667 bp, Zea mays
  misc_feature: Ceres CLONE 1514685
  misc_feature: Pfam Name: FHA Pfam Description: FHA domain
  misc_feature (395)..(395): n is a, c, t, g, unknown, or other
  misc_feature (441)..(441): n is a, c, t, g, unknown, or other
  misc_feature (442)..(442): n is a, c, t, g, unknown, or other
  misc_feature (457)..(457): n is a, c, t, g, unknown, or other
  misc_feature (468)..(468): n is a, c, t, g, unknown, or other
aagctggagctccccgcggtggcggccgctctagaactagtggatcccccgggctgcaggaattcgtctcacccctagaaaaaaaacagctagccagcccccattcttctccggctccggtgcattccgtgtcctgtcctgtcctgtcctgatggaagcagcaatggctgccacgtcctccctactccttgcctccggctccaggaggtggccagcaaccttgcctccttccccctggccccagcagcagcgtctggttttctgcctcgctgcaagaacgaggccgctggacagcaagaggggtagctggaggcgctcttccagtgccaccggcggccggtcgaccgccgtctcgtcgtcgtcgtcatcggaaagatgggttctcgaccctgcangagacggtgactggcgccacatcggctacaaagtcgcgcgccctgnngcgatcgagatagtnctcgaggacancgcggtgaccgtggggcggggtcgccgacaagcggacatcgtgctcccccgtcgcacagtttcaggcgctcacccccggctggaaaaaaaagggcgcacctgctggtgacggaccctgaacagaccaacgggacctacattaacgaacgccggctcaacccgggtttcccccggtcggtcaaccccgggagcctaattt

SEQ ID NO: 59235 - DNA, 674 bp, Zea mays
  misc_feature: Ceres CLONE 1514686
  misc_feature: Encodes the peptide sequence at SEQ ID NO. 59236
tggagctccccgcggtggcggccgctctagaactagtggatcccccgggctgcaggaattcgtctcacccctagaaaaaattcctcggagaggagaagccgccgtcgcagcaatcacagcagcccggagaacggccaggtccgacaagatgcagatctttgtgaagacgctgacagggaagaccatcaccctcgaggtcgagagcagcgacaccatcgacaatgtcaaggccaagatccaggacaaggaagggatcccgccggaccagcagcggctgatctttgccgggaagcagctggaggatggccgcacccttgcggactataacatccaaaaggagtctacgctccacctcgtgctcaggctccgcggtggcatcattgagccctcgctgcaggcgctccctcgcaagtacaaccaggacaagatgatctgccgcaaatgctatgcacggctgcaccctagggctgtcaactgccgcaggaagaagtgtggtcacagcaaccagctgagggccaagaaaagatcaagaactgaggtgttgctgctagccagtttcatggaaaaggttgtttgggtgttgaaccgggtttgtttaccaactggattttttgtttggttgttgaccccgttttgtttcccaacaatattggccttatgttatggttttcccc

SEQ ID NO: 59236 - protein, 175 aa, Zea mays
  misc_feature: Ceres CLONE 1514686
  misc_feature (6)..(74): Pfam Name: ubiquitin Pfam Description: Ubiquitin family
  misc_feature (77)..(128): Pfam Name: Ribosomal_L40e Pfam Description: Ribosomal L40e family
MQIFVKTLTGKTITLEVESSDTIDNVKAKIQDKEGIPPDQQRLIFAGKQLEDGRTLADYNIQKESTLHLVLRLRGGIIEPSLQALPRKYNQDKMICRKCYARLHPRAVNCRRKKCGHSNQLRAKKRSRTEVLLLASFMEKVVWVLNRVCLPTGFFVWLLTPFCFPTILALCYGFP

SEQ ID NO: 59237 - DNA, 657 bp, Zea mays
  misc_feature: Ceres CLONE 1514687
tccccgcggtggcggccgctctagaactagtggatcccccgggctgcaggaattcgtctcacccctagaaaataaaaccgggtagttgaacagtgcatgcctgatgctgcagaggctgcacgagctgtacctgctggacccagccacgtactcgaccctgacggggatagtgcagaacgaagtgaaggagggcacagcgaggaaggtcgacagctgcgcaagggcgatcctgtggcttgctagaggctggaggaggactctgcgcagcagcagcagcagcacagcctggcgcagctcgtggaagccgcgtacgaaggccacccctgaagcagtgccaccggcttggatcctcctccgggggcgtggccaaatagcggggaaacctcttccccccaagaggacgggggtccccccgcatggctggttggggaatggggccccgaactgcttttgtattccggggaacaacaccccgcgggggtttcgcgccggttgcttttcacgcccttccctttggggaacatccaccctccacagaaggggccaaagttccaaaacgggaacagggcctcaaaagcccgaggggtgccccccccccatagggggagacccctcaacgcggagcgccccaagccccatggggacagggggtgcccc

SEQ ID NO: 59238 - DNA, 663 bp, Zea mays
  misc_feature: Ceres CLONE 1514688
  misc_feature: Encodes the peptide sequence at SEQ ID NO. 59239
  misc_feature (458)..(458): n is a, c, t, g, unknown, or other
tccccgcggtggcggccgctctagaactagtggatcccccgggctgcaggaattcgtctcacccctagaaaaaaaatggaggaccaacctgtccggtaaatcagcaagtgcttgtatctactatcttcaacatgtaattaccaatactactgaagtattcctcgccgccgctgtcatggccaccctcaaccctttcgaactcctcggcgcctacgacaaccacaacccgtcgctgttgattgtgccggccgcgactgctgctcagaagacctaggcgaagaagtccgccgtggcgcctgctgggaatgctgcccagcctgcatcgaccaccaaattcacgaccaagatctctcctccctcgcagaccgttctggatgcacgcgggcagtggctcatcaactcgtggaggcattggccatggtgaacactgccgtctcagacgtggacagccatatggncaaaactctgcctacagtggtgacagatgcaactgactccaagcaggttatgtctgcataggctatggggatagtactgtaactgccgtatctgaatgataaaggagatacacacttcgtccccgtaccgatgcgaatcaaaacttggtagttacccgaactgtcgattttggccataactttgaaacgtctacacggaaaaacg

SEQ ID NO: 59239 - protein, 32 aa, Zea mays
  misc_feature: Ceres CLONE 1514688
MATLNPFELLGAYDNHNPSLLIVPAATAAQKT

SEQ ID NO: 59240 - DNA, 613 bp, Zea mays
  misc_feature: Ceres CLONE 1514689
  misc_feature: Translation starting site: 414
  misc_feature (186)..(186): n is a, c, t, g, unknown, or other
  misc_feature (324)..(324): n is a, c, t, g, unknown, or other
  misc_feature (408)..(408): n is a, c, t, g, unknown, or other
  misc_feature (439)..(439): n is a, c, t, g, unknown, or other
  misc_feature (447)..(447): n is a, c, t, g, unknown, or other
  misc_feature (448)..(448): n is a, c, t, g, unknown, or other
  misc_feature (469)..(469): n is a, c, t, g, unknown, or other
ctccccgcggtggcggccgctctagaactagtggatcccccgggctgcaggaattcgtctcacccctagaaaagtgcccgcggtgctagtgacggttgctctagatccgttcatcctggtggttttgtgaggtcgaaagcggcgagcgaattagaagatgctggacaagctgtgggacgacgtggntggccgggcctcgcccggagacgggcctcgagaagctccgcaaggccaccaccgcccgccctgctcgtcatcaacaaagacgcggacggcggcagctacaagcgggcgcagtcgacgttgtcgaccccgacgacgccngtgacgccgtcgtcgtcgacgacgccgcgcggcgccggcaacgtgtggcgcagcgtcttccacctggggagcaccctggcaccnagggcatggggcgcaacctctttcgacgggncgcagccnnattcccccaccgtctaagaantggttcttcggggaccaaaccggggaccaacccccccttaattcgggcaaaaatgattggacccgtaaaaaaggcctggtttcccgggccctgggggttattaaaaacccccccctgggcttttatacccgggcccccccatat

SEQ ID NO: 59241 - DNA, 678 bp, Zea mays
  misc_feature: Ceres CLONE 1514690
  misc_feature: Encodes the peptide sequence at SEQ ID NO. 59242
  misc_feature (597)..(597): n is a, c, t, g, unknown, or other
aagctggagctccccgcggtggcggccgctctagaactagtggatcccccgggctgcaggaattcgtctcacccctagaaaaactcccggctcagacttctgctgcagcgcctccgccgccgccgccgcatctaacgcagttccctccgccgcagcccgaggcaagatggttctccagaacgacattgatctgctcaacccgccggcagaactcgagaagctcaagcacaagaaaaagagactcgtccagtcgcccaactccttcttcatggatgttaagtgccaggggtgcttcagcataaccactgttttcagccactcccagactgttgttgtgtgccctggctgccaaactgtcctctgccaacccacaggaggaaaggcaaggctcactgagggctgctctttccgcaggaagggagactagagcggatgtggtcttcaagttttgctctatgccagatactagcgtcatgaactgcctttagctaagattttccataagttgttctcgagcagctatgtgttgcatggtggctacttccaaactatatctgggttgggttggaatgtgatgaactaatggctctttgattnataatatgatggtgacgatattttgtggaaaaaaaaaaaaaaaaaaggaaaaaaaaaaaaaaccggggccctcgaggtccc

SEQ ID NO: 59242 - protein, 86 aa, Zea mays; identical to SEQ ID NO: 44315
  misc_feature: Ceres CLONE 1514690
  misc_feature (30)..(84): Pfam Name: Ribosomal_S27e Pfam Description: Ribosomal protein S27

SEQ ID NO: 59243 - DNA, 716 bp, Zea mays
  misc_feature: Ceres CLONE 1514692
  misc_feature: Encodes the peptide sequence at SEQ ID NO. 59244
  misc_feature (345)..(345): n is a, c, t, g, unknown, or other
ggagctccccgcggtggcggccgctctagaactagtggatcccccgggctgcaggaattcgtctcacccctagaaaaagaaccaaatcactcccaccgtctccacagcaaccagcacacatttccctttggcggatcgaaggacggaaggaggagatgggtggcggcatggaggtgcacaaaaaccggtggatcgaagagtggaacgccggccgcgagaacctcgagttcaatttccgctggacccgccgcagcctcgccgtcgtcggcctcttcggcctcgctgtccccatcctcgtctacaagggcatcgtccgcgaattccatatgcaggacgaggatgcanggccggccatacaggatgttccctgtaagcggcgtccaggggccgcaggagatgtcggacccccccaccccgggcctgccaggaagggggagtttcccttcaggtttggggccggatttggttttagccggaatctggaaggagcaactttgggaagggttgactaatgcgtgcctggtccccccgggaaaaaaggggccactgaccccccccttttccaattactgaaaacttgaacctgttttcggattttccggattgggaggcgccgactcggaaaacaaaataatccagacccccctcgggggcccccccgtttccccccctaagggggaggcccgaaataaaccgccccgcgattaatgggtgcc

SEQ ID NO: 59244 - protein, 118 aa, Zea mays
  misc_feature: Ceres CLONE 1514692
  misc_feature (64)..(64): Xaa is any aa, unknown, or other
MGGGMEVHKNRWIEEWNAGRENLEFNFRWTRRSLAVVGLFGLAVPILVYKGIVREFHMQDEDAXPAIQDVPCKRRPGAAGDVGPPHPGPARKGEFPFRFGAGFGFSRNLEGATLGRVD

SEQ ID NO: 59245 - DNA, 684 bp, Zea mays
  misc_feature: Ceres CLONE 1514697
  misc_feature: Translation starting site: 153
  misc_feature: SWISSPROT Homolog: EC 1.11.1.15 Peroxiredoxin
agctccccgcggtggcggccgctctagaactagtggatcccccgggctgcaggaattcgtctcacccctagaaaaaattcactcgccttgcgcttcctcgccgccccagttccccaccccctgctcacccacccgtcccctcctgctcgcccatggctcccatcgctgtcggcgacgccctccccgacggccagctcgggtggttcgacgagaacgaccagctgcagcaggtctccgtccacgcgctcgccgccggcaagaaggtcatcctcttcggcgtccccggcgccttcaccccgacctgcagcaaccagcatgtgccaggcttcatcacacaggctgagcagctcaaagccaagggtgtagacgagatcctgcttatcagcgttaacgacccccttccacatgagggcgtgggcgaagacctaccccgagaacaagcacgtgaagttcctcgccgacggatctggagcgtacaccaaggggctcgaactcgagctcgatctcaccgaacaaagtctgggcgtgcgctcaaaaaagttacttctctggccgacgacctcccggccaccgtccccaaaattcaagaaaggggggaaattcccgaatttctggcccttaaaaaaaatcctgaaagccctttttaaaccgccaaaaaccattggcttaattttaaaccccccg

SEQ ID NO: 59246 - DNA, 735 bp, Zea mays
  misc_feature: Ceres CLONE 1514698
  misc_feature (410)..(410): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
agctccccgcggtggcggccgctctagaatagtggatcccccgggctgcaggaattcgtctcacccctagaaaaaataaccaagaacaaaccattgttggacgcgttcccctcctgcacgcaacctcatctcgtcctccagatcctggatggccgtcctccttgataccttgcctcgcgagtgctctcggtgagctactttgctttgatttatcaggaaatccgtttgcttcctgttatgcaggctcagatctgattgctggactcggcatcttactggcttgaatagagctaggactgggcgaaaacaacaacccctccccggatcctgtatcgaactgcagcaaatttttttatcccccctcgtatggggggggggggggccctattctaattattatttttttcttncccttttattccannnagaaacacactgcgcctggcggactcgggtttaccccgccatccagagaaaaacccttgccgcggcaacattttttgggttcccgttttccccgaacgattttctaccctccagttcaacaaactttttttttgtggaatggctatgtatggttttcctatcctcttaaatctccccccctgcgtcgcgccggttatccgttttatcgctaagcgtgggcccccttcaccggctcccactccgcccccaacttgatactcgtctctcatgccctgtcctcctgcaccaccggaacgatcgacctcctgg

SEQ ID NO: 59247 - DNA, 679 bp, Zea mays
  misc_feature: Ceres CLONE 1514699
  misc_feature: Encodes the peptide sequence at SEQ ID NO. 59248
tacccgcggtggcggccgctctagaactagtggatcccccgggctgcaggaattcgtctcacccctagaaaaaacaatcacaacctccacgaccaacgaggcaacgaccaaacgtccaaacccttccccctccctagctccgtgctccagcgggagtccgcggcggcggtgaagatgattatcccagtgcgctgcttcacctgcggcaaggttattgggaacaagtgggatctatacctcgacctcctccaggccgactactcagaaggggatgctctggatgctttggaattgttccgctactgctgcaggcgaatgctcatgacacatgttgacctcattgagaagttgctcaactacaacaccctagagaagaccgagacaggttaagcgagcacatcatgctccaaaaacactactgtttggcagtatcatagagcttaagtagtatgttgtctcttctctatcaataaaaatgggttggggagggtaaacatgcttttcaaggactttttcaggccgacgggctttgttgccacctatggaacgaggttggaattttttaaggggaaatatttgccaaaagaaaacttatggtttttgtggtgaattgggccggaaaaaaaaaaaaaaaaaacagaaacccttagaggaccccaatttccccctaaaggggggt

SEQ ID NO: 59248 - protein, 71 aa, Zea mays
  misc_feature: Ceres CLONE 1514699
  misc_feature (1)..(60): Pfam Name: RNA_pol_N Pfam Description: RNA polymerases N / 8 kDa subunit
  misc_feature: SWISSPROT Homolog: EC 2.7.7.6 DNA-directed RNA polymerase
MIIPVRCFTCGKVIGNKWDLYLDLLQADYSEGDALDALELFRYCCRRMLMTHVDLIEKLLNYNTLEKTETG

SEQ ID NO: 59249 - DNA, 692 bp, Zea mays
  misc_feature: Ceres CLONE 1514700
  misc_feature: Encodes the peptide sequence at SEQ ID NO. 59250
  misc_feature (372)..(372): n is a, c, t, g, unknown, or other
  misc_feature (374)..(374): n is a, c, t, g, unknown, or other
  misc_feature (376)..(376): n is a, c, t, g, unknown, or other
  misc_feature (377)..(377): n is a, c, t, g, unknown, or other
  misc_feature (378)..(378): n is a, c, t, g, unknown, or other
  misc_feature (526)..(526): n is a, c, t, g, unknown, or other
  misc_feature (527)..(527): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (548)..(548): n is a, c, t, g, unknown, or other
gctccccgcggtggcggccgctctagaactagtggatcccccgggctgcaggaattcgtctcacccctagaagaatccccaaatcggcctacgcccacggttccacctcctcgtccacgaggtgaggaaaccctagcgaccgaccatggcgttgctcccgcgcaccgcgcggctggccctcctttccccccgcgggcgtctccgctgccgctgctgcgggcgcctcccgacgtccccagcgcctacgggggcgccccccaccggcgatgtcaaagacggccgagttcgtggtctctaagggggacgacctgatgaactgggcgcgtaaggggcccgatctggcccatgaccctccggctccccggggcgccncnannnaaaattaaataaaagcgggccccccccccgcttttgagctcccaaccgggggcggggcgcacccttttcgcgtccggtcgcccgcggccccggtccggaaagggaagaatcggttcccggggccccccccttccgtaagggggcgggnncccnnncccccccgccggggntcctgcccccacagggccttgagaccctcgggtgggggttttcttccgggggcccgcgcgggcttaaaggcgcgggggaaaaacccccctacttcccgcccctcgatcgtcgacccgggaggtgaactgcaactgccccttcgg

SEQ ID NO: 59250 - protein, 39 aa, Zea mays
  misc_feature: Ceres CLONE 1514700
  misc_feature (36)..(36): Xaa is any aa, unknown, or other
  misc_feature (37)..(37): Xaa is any aa, unknown, or other
  misc_feature (38)..(38): Xaa is any aa, unknown, or other
MSKTAEFVVSKGDDLMNWARKGPDLAHDPPAPRGAXXXN

SEQ ID NO: 59251 - DNA, 704 bp, Zea mays
  misc_feature: Ceres CLONE 1514779
  misc_feature: Encodes the peptide sequence at SEQ ID NO. 59252
aagctggagctccccgcggtggcggccgctctagaactagtggatcccccgggctgcaggaattcgtctcacccctagaaaaaaggcatccaagctcaaagcaagcagatctaagctccaggcagcgtcgcgacagagtgagctagtgagtagcacgacaacaacaatggcttccctgaaggccgcgaagcccagcggagttgcggcgcagggcaaggagccggcgcccaagctcagcgagacggcgacgaagccgtcagccgcgaagagcggcggcgttaagaaggctgagcagaagccccgggaaaccaaaaggaaggtgaagagcagcatacaggcggcggcggccaaaaagtgacgtacagtacgtgtggagtgtaatgggagcttccatgcatgagtgaatccatgcccatgttatgaatctagtcctttccctttcttgtatcttccatgtgacgcggcgtgtgcttcccctcatgtgtgatgatgcccgatgaatactacaaattaagacgtttgttgtgaccaaaaagtttcaaattaaaatacacattttaaataccccaatcacttacgttcccgggaaaaaaaaaacatggaggccggggggcctcggggggcccccaattcccccctataggggagttctttatttccggcgcccttcaagggggcctttttttttaaaaacggcccggggc

SEQ ID NO: 59252 - protein, 63 aa, Zea mays
  misc_feature: Ceres CLONE 1514779
MASLKAAKPSGVAAQGKEPAPKLSETATKPSAAKSGGVKKAEQKPRETKRKVKSSIQAAAAKK

SEQ ID NO: 59253 - DNA, 707 bp, Zea mays
  misc_feature: Ceres CLONE 1514817
  misc_feature: Encodes the peptide sequence at SEQ ID NO. 59254
aaactggagctcaccgcggtggcggccgctctagaactagtggatcccccgggctgcaggaattcgtctcacccctagaaaaaagcctgctccgctctgcagcacgaacatgatgaagccatcgtgtgtactgcttctttccagccttcttgtagccactcttgcagctacttcttcgtcctctcctccgtattccgtcggcaagcacccagggtggctgctggttctaggtcgcaaaggcagagaactcggccagtcgtcagggtaccattattaccagcatcagagcaagcagcccgagctgcagggagtggctatggaggtaaagaaacccgaggaggaggcgacggcgaggcgaacggccgatcagagcggggacgccgagacagggctgatctacagcgcggactacagcagcgtggccatgcatgctgcctctccgccgacggcgaagcccaagcacaggcaccccaccagaacattaggaagctgtcccttatgtaagcccagtcgtatgcccgtcccgtttcgtgtggtttcttaatctccgctggattggaacaaacaaaaaacaccccctggcttgtctcttgaaaaaaataggcccctccttgaaggggctggcttctttcccttcaaaaaaaaaaaaaaaaaaaacggaaaacccttcgaaggtaccccaaatttccgccctaaaaggggaggcc

SEQ ID NO: 59254 - protein, 144 aa, Zea mays
  misc_feature: Ceres CLONE 1514817
MMKPSCVLLLSSLLVATLAATSSSSPPYSVGKHPGWLLVLGRKGRELGQSSGYHYYQHQSKQPELQGVAMEVKKPEEEATARRTADQSGDAETGLIYSADYSSVAMHAASPPTAKPKHRHPTRTLGSCPLCKPSRMPVPFRVVS

SEQ ID NO: 59255 - DNA, 548 bp, Zea mays
  misc_feature: Ceres CLONE 1514834
  misc_feature: Translation starting site: 158
  misc_feature: SWISSPROT Homolog: EC 1.1.1.42 Isocitrate dehydrogenase (NADP(+))
gctctagaactagtggatcccccgggctgcaggaattcgtctcacccctagaaaaagcctgccgtctctcttccaccttccaccacaagcgccgccgcagccggtgcctgctccttcccgatccccgaggcaaagctgcgactccgcaaccgccgccatggcgttcgagaagatcaaggtctccaacccaatcgtcgagatggacggtgatgagatgaccagggtattcttggcagtctatcaaggacaagcttatcctcccatttctggacctggacatcaagtactatgatttggggatactgcacggtgaagcaactgatgacaaggtccccagtgaaggctgcagaggctactctcaagtacaacgtggctattaatggtgcgaacattacttccgatgaaactccgggttaaggagttcaatcctaaacacctgtggggagaagccccaattgcccccatttaggaaactttttaaaatgggcccttgggtttcaaaaaagcccctttttttttgccaaaaaaccttttcccaaaaaactttt

SEQ ID NO: 59256 - DNA, 485 bp, Zea mays
  misc_feature: Ceres CLONE 1514836
  misc_feature: Encodes the peptide sequence at SEQ ID NO. 59257
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (35)..(35): n is a, c, t, g, unknown, or other
  misc_feature (45)..(45): n is a, c, t, g, unknown, or other
nnnnnnnnnnnnnnnnccccccccccccccccccnggggggtttnttttaaactggactccccgcgggcggccgctctaaactagtggacccccgggctgcaggattcgtctcacccctagaaaaaatgcgcaaacatcgaatcgtctcactcgtgtctgccctgctcatactgcttgccctcgccgtatcgtccacccgcaacgcacaggaggattccatggccaacaacaccgggacgttgggtgggcggcatcccaggacgtggccggggaagccgagaaccgaccctttcacccttccagggagcctccgcccggctttccgcccgtccgaatggagccaaccaacccagggaagggggcccccaaattggccttcctttcccttgggggggggttttccaaagaaaaaaaaacgccttttttggtgccgcaaaaaagggggcgccccaaagaaaaaaccccccaaaaaagggggtggggt

SEQ ID NO: 59257 - protein, 50 aa, Zea mays
  misc_feature: Ceres CLONE 1514836
MEPTNPGKGAPKLAFLSLGGGFSKEKKTPFLVPQKRGRPKEKTPQKRGWG

SEQ ID NO: 59258 - DNA, 748 bp, Zea mays
  misc_feature: Ceres CLONE 1514847
  misc_feature: Encodes the peptide sequence at SEQ ID NO. 59259
  misc_feature (8)..(8): n is a, c, t, g, unknown, or other
  misc_feature (9)..(9): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (35)..(35): n is a, c, t, g, unknown, or other
  misc_feature (37)..(37): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (748)..(748): n is a, c, t, g, unknown, or other
tttttttnntnnnnnnnnnnnnncttctccctttncnccttttnnntttttttcaaagctggactccccgcggtggcggccgctctagaactagtggatcccccgggctgcaggaattcgtctcacccctagaaaaaaagtcccaccacagcaaagcaactgcttgcagcctccgcacaacaaaaaaccccacgggtagtctcggatctccacgccaccaaaacatccgaagcttcttcgatctcttgcgcggcgttctggaatctgaaccttcaatcttggagagcggcgcgtccccgaagaattagatcagccatggccaagcaaaagatcgtgatcaaggtgccgatggcgagcgacaagtcccggtccaaggcaatggcgctggtggcggccgcgggcggggtcaactccgtggccatcgccggcgacggcaaggaccaggtggtcgtcgttggggagggcgtcaactccatcaagctcaccaccatcctgcgcaagaagaatgggcgacgcgcagctcgtcaaggtcgccgaggacaagaagaaggaagagaaaaagcccgaccccgtcgcccaaagctgcgggcggcgtaactacaaccaggtactactacccactacccaccgcccgcccgggggtcgttcttacgacccccttaccccacggttcggggccaccaccttgcaacccataaatggtagaaatttggtagaacttccccctgttgggcacattattgcaaan

SEQ ID NO: 59259 - protein, 93 aa, Zea mays
  misc_feature: Ceres CLONE 1514847
MAKQKIVIKVPMASDKSRSKAMALVAAAGGVNSVAIAGDGKDQVVVVGEGVNSIKLTTILRKKNGRRAARQGRRGQEEGREKARPRRPKLRAA

SEQ ID NO: 59260 - DNA, 867 bp, Zea mays
  misc_feature: Ceres CLONE 1514854
  misc_feature (1)..(1): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (36)..(36): n is a, c, t, g, unknown, or other
  misc_feature (40)..(40): n is a, c, t, g, unknown, or other
  misc_feature (41)..(41): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (362)..(362): n is a, c, t, g, unknown, or other
  misc_feature (459)..(459): n is a, c, t, g, unknown, or other
  misc_feature (567)..(567): n is a, c, t, g, unknown, or other
nttttnnnnnnnnnnnnnnnnttttttttttggccntaannccccatnnnnacgaccgggagcccaccccggtggcggccgctctagaatagtggatcccccgggctgcaggaattcgtctcacccctagaaaaactccctcactcactaagccaaagctgacagcagcatacaagcaccagcagagctcttgccgatggcggtggccaagcccccgcttcagaggggcgcggtcctcctcctcctcctcctggtcggcgcggccgcgtcgtggctccagaccgtcgaccccccttcagggttctgctcgagcaagtgcagcgtccggtgcggcccgtttgcaacacccaggggcgcatggnagcctgcatctgagttcttgctgcccctctgctgcaagggagggaaaagtagttttttttttcccccccccccccggggggggaaagaaggggggancttaaccatcactcccaccctctccccaacttatcggtgccccccggagaaaaagcacccctcccccccaccccaccatagcaggccccgcccctaccccttacatcncccgaagtcactcaaggatccgcacggcccgccccacacagcggccacaagagcacccccccgcgcgagcccgccagttacacgcgcacgcaaagagaagaaatgaaacgaggggatgaagcagaacgggaacgggagccattgagctatgacgtgcaacgggaccccaccccggcccccccagcccccccgcccccgcgcgacacaaagtcacccaaaacagcccgcagaagatggaggtagcaagccagggacgctcttgtcgctctccaacaccacatagacgccccctgcccccca

SEQ ID NO: 59261 - DNA, 806 bp, Zea mays
  misc_feature: Ceres CLONE 1514877
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (25)..(25): n is a, c, t, g, unknown, or other
  misc_feature (28)..(28): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (48)..(48): n is a, c, t, g, unknown, or other
  misc_feature (51)..(51): n is a, c, t, g, unknown, or other
ttttttttttnnnnnnnnnnntttnttnttttnnnttttttttcacangcnacaaactcggactccccgcggtggcggccgctctagaactagtggatcccccgggctgcaggaattcgtctcacccctagaaaaagtccggggaaggagcaggagggaggcggagatgatcgaggtggtgctcaacgaccgcctggggaagaaggtgcgggtcaagtgcaacgaggacgacaccatcggcgacctctagaagctggtggcggcgcatacggggacgcgccccgagaagatcctcatccagaagtggtacaacatctactaggaccacatcacccctcaaggactacgaggtccacgacggcatgggcctcgagctctacctacaacttgagcccgccgccccctctctccctctcgtcaggttggtctgaattctgaagtccatggggttgccaatttccccttcggcgggcgatctccttaagctccatccccatctataaaaagccaaacctccggttggggctttttataagaaccctggccgtgcccaaacctatgctaggggacgcactcggcccagccttttccagataccgcttcgttgggatttgccccaacccctgcgaaaccttgggctgcaccggccctcacccggcccccggcgaaatacatcttaaggggcttttaaacccttggggctgaggcctcaactcaacataaaataataacccaaaaactgatcgcaaggaaaccccaattttccccccctaaggatgaagtacgcgtgatttcccctccccgcc

SEQ ID NO: 59262 - DNA, 669 bp, Zea mays
  misc_feature: Ceres CLONE 1514907
  misc_feature (217)..(217): n is a, c, t, g, unknown, or other
  misc_feature (218)..(218): n is a, c, t, g, unknown, or other
  misc_feature (249)..(249): n is a, c, t, g, unknown, or other
  misc_feature (250)..(250): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (537)..(537): n is a, c, t, g, unknown, or other
ctggagctccccgcggtggcggccgctctagaactagtggatcccccgggctgcaggaattcgtctcacccctagaaaaaagggctgcataagtcccgtgggctcattgcgtgttcgatcgatcggatccccatacgatctactagctagctaagctacacgactcgaccgaggaggaggagcgctcaggccgtatagaaacttggagcatgttccnngttaaaccccacccaagtggtttggggcctnncccggctacagggcggtgggtgatctattcatcgtcacgaaactggtcattggtaaagctcttaaccccccgataaccggggggggttttttttttccggggggagagggaaaaaaacccccccgaggggggtgaaaaaaaaaaacccctttgggggaattttcccgggggtaaaaaaaaaacgcccgcctttctcttgggtggggggcccccccacccactttaaaaaaaaaatttgggggggggcnnnnggtagggagctgggagggggggccccccccccttantgttttttgtgttgaaaaaaaaggggtttaaaaaaaaagagagggggcggggtctgctctccccccggggtgagaaattaaaatatatgaggcccccgccttttgggtagaaggaaaagatatatttttttc

SEQ ID NO: 59263 - DNA, 768 bp, Zea mays
  misc_feature: Ceres CLONE 1514928
  misc_feature: Encodes the peptide sequence at SEQ ID NO. 59264
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (46)..(46): n is a, c, t, g, unknown, or other
  misc_feature (49)..(49): n is a, c, t, g, unknown, or other
ttttttttttnnnnnnnnnnnnnnnnnnnnnnnnnnnaaccaaaanaanacaaactggagctccccgcggtggcggccgctctagactagtggatcccccgggctgcaggaattcgtctcacccctagaaaaaaaaacccagccgtcatcgtttcgcgtccgcctcagcccgccgcaaggggagttcatgagacaccttcgagaagctgaaatggctcctaaagctgctcctgccaagaagggtgatgccaagacccaggccttgaaggttgccaaggctgtgaagtctggggcagccaataagaccaagaagatccgcacatctgtgacatttcaccgccccacgaccctgaagaaggctagggaccccaagtacccacgaatcagcactaccggaaggaacaagcttgatcagtaccaaattctcgagtaggcgcttaccacagaatcagcgatgaacaccaccgaagataacaactctctggtccttcattgttgaacccccagggcagacaagacgaagaccccaggctgccgttctagaagatgtttggatttccaggtcaaagaaagtcaaccaccttggatcaggcctgcaggggaaaactcaccggcctccagtggaaggtggactctccaaatcatagaaggatctaaggaggggggccaccgaaaaacaggcgcaccggtggcgagaggaggggggggagtaggggagagccgggcgcggcggccccataggtccagtccgccgggggaggacgacaa

SEQ ID NO: 59264 - protein, 73 aa, Zea mays
  misc_feature: Ceres CLONE 1514928
  misc_feature (11)..(63): Pfam Name: Ribosomal_L23eN Pfam Description: Ribosomal protein L23, N-terminal domain
MAPKAAPAKKGDAKTQALKVAKAVKSGAANKTKKIRTSVTFHRPTTLKKARDPKYPRISTTGRNKLDQYQILE

SEQ ID NO: 59265 - DNA, 806 bp, Zea mays
  misc_feature: Ceres CLONE 1514939
  misc_feature: Encodes the peptide sequence at SEQ ID NO. 59266
  misc_feature (1)..(1): n is a, c, t, g, unknown, or other
  misc_feature (2)..(2): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
nnttttnnnnnnnnnnnnnnnnnnncccttttccccccgagagcagcgccagagtggagctccccgcggtggcggccgctctagaactagtggatcccccgggctgcaggaattcgtctcacccctagaaaaaacgcttccactacaacagcatcatcgatcgccgagcgtgcgtgctctagctctagcaatagcagcgaggagacggtcgaggatggatcagaacaacagcaaccaggcagcagcagcaggagccgccgccaccacccgcgggctacccgatggcaggcgcggagcagcagggaggcatcggaaggaagcaaggacgcctggggaagacgacctcagggcggggagaagggcttcatcgaaggatgcatcgcggcgctctgctgccgctggatcttccatatgtgctgctactaggtaggcgtcgcgcgtttccatccgccgcccaggattttaagccttccccacaggaaacgggaggagattctggcattcccaccaccaaaaactgcccgctggtgggctcgcccgatccttccgcgggcaacacggttgtggtgggggaaggggagtctcggggagaggttttggactgtgggggggaagagaggcggcgtggtggtggaccggttgtgccgtcgggggggggcgggggtattggggggtgttgttgggctctggggcctggacttcgtcctcctccgccacccttgacggggccccccccggtttttgaatttttataccttctgatagatggggagctagggggtcgactacataccccgagggggcag

SEQ ID NO: 59266 - protein, 175 aa, Zea mays
  misc_feature: Ceres CLONE 1514939
MAGAEQQGGIGRKQGRLGKTTSGRGEGLHRRMHRGALLPLDLPYVLLLGRRRAFPSAAQDFKPSPQETGGDSGIPTTKNCPLVGSPDPSAGNTVVVGEGESRGEVLDCGGEERRRGGGPVVPSGGGGGIGGCCWALGPGLRPPPPPLTGPPPVFEFLYLLIDGELGGRLHTPRGQ

SEQ ID NO: 59267 - DNA, 855 bp, Zea mays
  misc_feature: Ceres CLONE 1514958
  misc_feature: Translation starting site: 213
  misc_feature: SWISSPROT Homolog: EC 3.4.25.1 Proteasome endopeptidase complex
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (51)..(51): n is a, c, t, g, unknown, or other
nnnnnnnnnnnnnnnnnnnggggggggnnnnacccnnnnnntttttnnntntcaaactggagctccccgcggtggcggccgctctagactagtggatcccccgggctgcaggaattcgtctcacccctagaaaaacttcccctccgatcgtcgtcgacgacgcatccaccccaacccttctccgcgaaatagccgtcgccgcagctccggctatgtcaatcttcgagtacaacgggtccgccgtggtggcgatggtggggaagaactgcttcgcgattgccagcgaccggcggctcggcgtgcagcttcggaccatcgcaacagacttccagcgggtgttccaagatccacgacgagctctacatcggcctctcagggctcgccaccgacgcccagacgctgtaccagcgggtttggtcttccccgccccggggggggggggggggcgcgaaaggacagggaacttcgaacccccgagcagttgttgccagggccttgagcttgtggcgcttccttcctaggaaggaaggaaggatccggggtcccgtgattttgcctggcccagaccgagcggccactgggctcgggtactcccggccggtttgagaccctgcggttacccgtgtgtcgggcgtggtgggcgcacgggaacttgggtgtctttgggtgggctataagcggttttttgtggacaccaggggggtcgctcctccccttctcatattgtagaagaggaattccatggaattgtggttggttttaaatgtatatttgtgtgttatttctctgtttctctcctagcccggcggtggctgctggcttcttcgttcgttcttttctctctctgggggtctt

SEQ ID NO: 59268 - DNA, 590 bp, Zea mays
  misc_feature: Ceres CLONE 1514967
  misc_feature (203)..(203): n is a, c, t, g, unknown, or other
  misc_feature (410)..(410): n is a, c, t, g, unknown, or other
tccccgcggtggcggccgctctagaactagtggatcccccgggctgcaggaattcgtctcacccctagaaaaaaatccagctacatccgtctgggtgaactccagggccaggagcagttcgccgccttcgttcgcatcacctacgcggttcaatccaactggcaggaaggaacgtgatggccaagacgagctcgttcaagctnggagcacccccttgagaagaggcagtctgaggctaatcggatcagagagaagtaccctgacagaattccagtgattgttgagaaggctgagaggagtgacattcctgacatcgacaagaaaaagtacctggtccctgctgatcttacggttggacaattcgtgtatgttgttaggaagagaatcaagctcagtgctgagaaagctantcttcatcctttgtgaagaacaccccttccaacaaacagcttgctcctgatgtgcttcaatcctatgaaagagaacaagggaccaaggaatggggtcctttctacatgaccttaaagcgggggaaaaacccctttcggggctgggttttagaatgggcaaaaacacccccggggtttaac

SEQ ID NO: 59269 - DNA, 619 bp, Zea mays
  misc_feature: Ceres CLONE 1514972
  misc_feature: Encodes the peptide sequence at SEQ ID NO. 59270
aagctggagctccccgcggtggcggccgctctagaactagtggatcccccgggctgcaggaattcgtctcacccctagaaaaaaccacaacccagcgccggcagtcgccgtcatcgatcgatcgccggaaaactaacccctaacgatgtctggagccggcgaggaggacaagaagcccgcggagggcggcgcccacatcaaccttaaggtcaagggacaggatggcaatgaggtgttctttcgcataaagaggtccacccagctgaagaagctgatgaacgcttattgtgaccgccagtctgtggacatgaatgccattgcgttcctgtttgatggccgcaggcttcgcggcgagcagacccctgatgagctggagatggaggacggcgacaagatcgacgccatgcttcaccagaccggaggcagcgttcctagcaccaccctaaagcttcgtttttgctcctccgtccctgcggtagtacctaaaccaaaaaggggaaaaaaagtctttttaaaggacattggaggcccgggcccctggggccttgggaaggaaacccctacccttttttaaaaaaagggttgggaaatttttttggcaccccccccctttatcacc

SEQ ID NO: 59270 - protein, 142 aa, Zea mays
  misc_feature: Ceres CLONE 1514972
  misc_feature (21)..(91): Pfam Name: ubiquitin Pfam Description: Ubiquitin family
MSGAGEEDKKPAEGGAHINLKVKGQDGNEVFFRIKRSTQLKKLMNAYCDRQSVDMNAIAFLFDGRRLRGEQTPDELEMEDGDKIDAMLHQTGGSVPSTTLKLRFCSSVPAVVPKPKRGKKVFLKDIGGPGPWGLGKETPTLF

SEQ ID NO: 59271 - DNA, 728 bp, Zea mays
  misc_feature: Ceres CLONE 1515307
  misc_feature (50)..(50): n is a, c, t, g, unknown, or other
  misc_feature (51)..(51): n is a, c, t, g, unknown, or other
  misc_feature (60)..(60): n is a, c, t, g, unknown, or other
  misc_feature (61)..(61): n is a, c, t, g, unknown, or other
tttctaccgttttgttttgctttttattttttgtttgtgctatctctttnnttttttttnnttcatactggagctccccgcggtggcggccgctctagaactagtggatcccccgggctgcaggaattcgtctcacccctagaaaaaaagagaagttgccggacttgaactgcaagagcatcgactctgctatgaggatcatcgctggcaccgccgctaacatgggcatcgatgttgatcctccaatccttgttaagaaggaaaaggtcctcttgtagtttgtttttgctggcaccaccagtgcccattttgagattatatgtgaaaggaccaagatgatcaaaagagtgaattgagtttctctaaaatatcttggataaattaatgcctattaatgagtccatttcaccctttggttatcctccctttttgccccaaaatagaaaagtttaagtatataaatataaaaccccccccccccaaactaaaatcctgaggcttggaaaaaaattatcttaaaacgggccccctcagaggcccccttttcccccccattagtgggtccgttatttcccccgcgccccatggtgcgccgcgtttttataaagctcctcggaccggggaaaaaaccccgggcggctcccccaaccttttttaccgccttggtaagaaaatttcccccccttttccgccccgggtggggggaatattagcgaaaaaaaaggccc

SEQ ID NO: 59272 - DNA, 804 bp, Zea mays
  misc_feature: Ceres CLONE 1515315
  misc_feature: Translation starting site: 139
  misc_feature (1)..(1): n is a, c, t, g, unknown, or other
  misc_feature (12)..(12): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
naaccccccttnattttcctttcgccccggtgtnnnnttttttcnnnnnnccaaagctggactccaccgcggtggcggccgctctagaactagtggatcccccgggctgcaggaattcgtctcacccctagaaaaaagatgccactcgaacccagagctagctggttctccccgaaatgcgttgaggcgcagcagttgactggacatctaggggtaaagcactgtttcggtgcgggctgtgcgagcggtaccaaatcgaggccaactctgtatactacatatgacccacccacaacaggggtcacggtcggccattgagaccatgcgtccactgctaacccttcccccctttccaaaagaaaaaaacccggagccgctcgagggaccccatttggccctatagtgaccccgtatttaggtgccccccatcgcccctcgtctttataacctcttgcccccccccaaaattttgcgggtgttccccctttcgtcatgttccgccgaacataccccccagaccgacttaatccggccggtacttaatgacctgacgtccccccgttccctggccccctttccccccctgattacccccctcactgtccccgggtttctcacccgatctctgccacacccgtctacaatactcttgaggccctacatcccgctgcctgaatgtattcccccgcggggcgacgctcccccactcctttctgcgcagttccccgcctctataatccctccccaataatctccgcatctgtccctgcgtcctgttatcccctggcccccctctgccccccc

SEQ ID NO: 59273 - DNA, 641 bp, Zea mays
  misc_feature: Ceres CLONE 1515318
  misc_feature (355)..(355): n is a, c, t, g, unknown, or other
aaagctggagctccccgcggtggcggccgctctagaactagtggatcccccgggctgcaggaattcgtctcacccctagaaaaacatcgtctactccgtcggctgctgcgccttcaggaacaaccgcagagacaacgcctaccgcggcgggtggaagggcgggtacgcttgatccaccatcgcgtcgtttaggagcggagccatgcacgcgcgctcggtgctctgctctgctccctgcccgccgctgtcgtcgtacgtacatgtttagtaggctcgttgtagctctgtacaggtgatggagatcgttgttgcggattcttatcgtcttcctggttacatacttacattattgttngaaaataggagactgcattggtctttcactttaaaatcggtccctgcatagataaaaaccgagacgctcgaggtacccaattcgccttatagtgagtcgtattacgcgcgctcattggccgccgttttacaacgtcgtgactgggaaaaccctgcggtaacccactttaatcgcctggcacacatcccccttcgccacctggtttaataaccaagaggcccccccgatcgcccttcccaaagttgctccacctgaatgggaaatgaaaattgaaacgtaatttttt

SEQ ID NO: 59274 - DNA, 645 bp, Zea mays
  misc_feature: Ceres CLONE 1515319
  misc_feature: Encodes the peptide sequence at SEQ ID NO. 59275
aagctggagctccccgcggtggcggccgctctagaactagtggatcccccgggctgcaggaattcgtctcacccctagaaaaaatcccctccccacatcgggaaccgccgccgacgccgcaggaggagacgcatcgaggttagcacgcgaagaagcgaccatgagggccaagtggaagaagaagcgcatgaggaggctcaagaggaagcgcagaaagatgaggcagagatccaagtaggcagatcgagatggattgtggacctgatgacatgcgtgggtacatacatttcttcggatgcgttggtgtgcctgtggagagatgtcaacctgccatggtgtcacggtccgccatcagttgaacgtcttgcctgcacttcagtaagccatttttcatggttctagttccacccccacccagccgtttgccactaagaataatcaaacatttcgtttctgtgaccctattatgattggagcttttttttgctggataatatctcaccttccctattttgagccaaaaaaaaaaaaaaaatacgaaacgccccgaaggtacccacattcccccccaaaagtggaaggcgattttaccccgcccccctcttgggcccctcctcttttaacaacgctccggaacctggagaa

SEQ ID NO: 59275 - protein, 45 aa, Zea mays
  misc_feature: Ceres CLONE 1515319
MTCVGTYISSDALVCLWRDVNLPWCHGPPSVERLACTSVSHFSWF

SEQ ID NO: 59276 - DNA, 657 bp, Zea mays
  misc_feature: Ceres CLONE 1515320
  misc_feature: Encodes the peptide sequence at SEQ ID NO. 59277
  misc_feature (546)..(546): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (553)..(553): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (588)..(588): n is a, c, t, g, unknown, or other
aaagctggagctccccgcggtggcggccgctctagaactagtggatcccccgggctgcaggaattcgtctcacccctagaaaaaatagcgcccgctcgcccatcagcccacgcggccacgccgaagtatggcgctctccgtctcctccctcgccgccgccctctcccacctctccctcccatcgacctccacccccaagcctcacccggccccgctcctgcgcctgcgctccacctaccgccgcgctgttagcctcgcgctccgcgcctccgcagccgaagccgccgaatcgttcgaggcggacctgcccgccgaggaggtgatggctgtcgaggaggaggcggaggaggatgcgctgtcgggaatcgcgctgcgaaagtatgtgaagcagcggctgccgggcgggttcgcggcgcagcggatcaccgccacgggccgtcgcaagacggccatcgcccgcgtcgtgctccaggagggcaccggcaaggtcttcatcaacttccgctcccagattggcttgacaagcatgttaattccatgaaaaanannnnanannnnnnnnaannnnnnnnnnnnnnnnnnnnnganaaaaaaaaaaaaaaacgagacgctcgaggtacccaattcgccctatagtgagtcgtattacgcgcgctc

SEQ ID NO: 59277 - protein, 72 aa, Zea mays
  misc_feature: Ceres CLONE 1515320
MAVEEEAEEDALSGIALRKYVKQRLPGGFAAQRITATGRRKTAIARVVLQEGTGKVFINFRSQIGLTSMLIP

SEQ ID NO: 59278 - DNA, 720 bp, Zea mays
  misc_feature: Ceres CLONE 1515331
  misc_feature: Encodes the peptide sequence at SEQ ID NO. 59279
ccccgctggagctcaccgcggtggcggccgctctagactagtggatcccccgggctgcaggaattcccactaaccccgagaaaaacatccaaaaggagtctacgctccacctcgtgctcaggctccgcggtggcatcattgagccctcgctgcaggcgctcgctcgcaagtacaaccaggacaagatgatctgccgcaaatgctatgcacggctgcaccctaaggctgtcaactgccgcaagaagaagtgtggtcacagcaaccagctgagggccaagaagaagatcaagaactgaggtgttgctgctagtcagtttcaatggacaatgttgtttggttgttgaaccgtgttagtttaaccaactgtatttttgctttgggttgttgaaaccgcgctcggttaccgaccatatctggccttatgttatgttttacccctgttcgccaatcacccccttctcacaaccccaaatacaaagcacaccctcctaagttaccccaattccctcccaaaaaggtgacccatatcccccccgcgcctcccatggacccccccttataaaacccccactcaccggggaaaaaaccatgggtcctaaaaacaaccactaacccccctttggcaaccaaacccccccccttctcataccacttggaccgctaaaaaccacaacaagccctctttatttcgaaccccaatttttcccccactatttcgcc

SEQ ID NO: 59279 - protein, 36 aa, Zea mays
  misc_feature: Ceres CLONE 1515331
  misc_feature (1)..(35): Pfam Name: Ribosomal_L40e Pfam Description: Ribosomal L40e family
MICRKCYARLHPKAVNCRKKKCGHSNQLRAKKKIKN

SEQ ID NO: 59280 - DNA, 740 bp, Zea mays
  misc_feature: Ceres CLONE 1515338
  misc_feature (1)..(1): n is a, c, t, g, unknown, or other
  misc_feature (2)..(2): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (18)..(18): n is a, c, t, g, unknown, or other
  misc_feature (44)..(44): n is a, c, t, g, unknown, or other
  misc_feature (47)..(47): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
nncctttttttnnntttnaacccgcaccaaacacaaatagaacntcntnnnnngttnnnnnnngaatgctggtactccccgcggtggcggccgctctagaactagtggatcccccgggctgcaggaattcgtctcacccctagaaaaacctgttccccacccatatcgtgaacccgccgccgacgcagcagcaggagacgcgccaaggagagcccgcaaggaggcgactatgagggccaagtggaagaagaagcgcatgaggaggctgaagaggaagcgccgaaagatgaggcagagatccaagtaggctgatggggattgtggatggtggtgtcggcatagttgtgttacgttttcttcgatgggagaattcatggaaagatggtcacatcccaaattcggcggtcaccggtttgccatggggttctttggcccccccccccgcaaaaggtggggggtgggggcacggcccatccttttcgtgggaattcccccccccctttgtgggagaaagggtggtcgggaggggaggggatggggggctgggcgcgcgaggcggtgggttgggggggagcggcgtagtggtcgggagggggcggccccctcgggtgttgggggcggggcaacgaggcttctgaatgctagccttcgcgttgactcggagactagtgtgtcgtgggagggaacaagacctaggggcgtgtggcctcttgcgttctgccaagataggccgacccacc

SEQ ID NO: 59281 - DNA, 696 bp, Zea mays
  misc_feature: Ceres CLONE 1515339
ctggctggagctcaccgcggtggcggccgctctagaactagtggatcccccgggctgcaggaattcctctcacccctagaaaacactgtttgtgtgccaaggtaagagaactgttgtacgctaggggagacgagggcacaggcgaccatgcgcctttggacgatgtgctcaatatctgctgccaagttcctgtaccctaacccgacagcctgccccaccgctccctattccgtccttggaaaccactttccgcctccttgattcttcaacttccttgaccgccagctagcaacaatgactccccccccaatgtggcgcaaatttctctcccacctgcatcggttacattgacatcccattcggaggtggaaaaaaaggttctgcccttgatctttcacccactttgcttccttccccgtttgtggtcccccttgtttcggtttgtctatggaccccagacaacgcctcccagttcccaccatccacatgtctccttctacatcccttcccccccacctcctttttcccccccccctctttaccccccccccgccctcttctgcccccccttgcccccccgatttcccctccctttttttcccctctgacccttaactccccggtaacccccattatttttcccccattcatgtccctccaccccgcctgttacacctttaattccccccaccctcc

SEQ ID NO: 59282 - DNA, 715 bp, Zea mays
  misc_feature: Ceres CLONE 1515342
  misc_feature (62)..(62): n is a, c, t, g, unknown, or other
tgttgttggttttttttattttctctttgactgagtttttaggatggctggtggcttgggtntcaaaactgggactccccgcggtggcggccgctctagaactagtggatcccccgaggctgcaggaattcgtctcacccctagaaaaaaaaaaaaaaaaaaatgtacttagttaatgcaaattcggagctgtcgcctttttattttcagtttagggtttcttctctttcttgtgttctcaagaactacatcccctgtgcaaaacacaaagagaggttgtttgataccagagatgaattgttagttataaaaaaaaaaaaaaaaacgagacgctcgaggtacccaattcgccctatagtgagtcgtattacgcgcgctcactggccgtcgttttacaacgtcgtgactgggaaaaccctggcggttccccaacttaatcgccttgcagcacatccccctttcgccaggctggcgtaatacccaaaaggcccgcaccgatcgccccttcccaactgttgcgcagcctgaatggcgaatggaaattgtaagcgttaaaattttgttaaaaatcccgttaaatttttgggtaaatcagcccatttttttttaccttttagggccgaaactcggcaaaatcccctttttaaatccaaaaagaattaaaccccaaaataaggggtttggaagtgttgtttcccagttttggaaaacaaag

SEQ ID NO: 59283 - DNA, 764 bp, Zea mays
  misc_feature: Ceres CLONE 1515348
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (42)..(42): n is a, c, t, g, unknown, or other
  misc_feature (43)..(43): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
ggggaagcagtggtttaattnnnntgtttatatatggtggannannnagcnnnnnnnaaatactggagctccccgcggtggcggccgctctataatagtggatcccccgggctgcaggaattcgtctcacccctagaaaagaataagacacctacacgcaggtttctggtggtgcatttttccatgttattagaaaataagtaatcaaaattcagtgccgttgtcaattattgcaggtggcctcataaactagtatatagtgggggcaaaggaaaacgagaatgcaatgtcattgtagtccatctcgcgcgtgttgtcaaactcggtcggaaagggaaaaactgttctcccggtattataccaaaaaaagactaaaaaaaaaaaaaaaaacgagacggctcgaggtacccaatttccccccctccgcgagttcttttttattgcgcgctctctgggccctcgtttttaaaacccccccccccctgggaaaaacccctggacgttaccccaactttaatccggccttgacagaaaaattgccccctttcagaccagctggggcttaaatagacgaaagaaggcccggctaccggaatggcctctttccccaaaaagtttgacaccaacctgggtaatgggcgaattggaaaatttgtaaaggcggtttaaatatttgtaggaaaaaatttccccagttgaaaatttttgggttaaaaacagtgcgggtgaatttcttttttaccctaattataggcgcaaaaaaa

SEQ ID NO: 59284 - DNA, 659 bp, Zea mays
  misc_feature: Ceres CLONE 1515350
  misc_feature (405)..(405): n is a, c, t, g, unknown, or other
aaaactggagctccccgcggtggcggccgctctagaactagtggatcccccgggctgcaggaattcgtctcacccctagaaaaaaaaatggaactgacactgaaccgaaggctgcggataccaacgggctatctgcatcggttaagtccactgtcaacgcaccatttggattggggacaacattggagtcgaagaagcagaaatcgaagcaaaagtcgtagaaaacctgtgcttggaatttcctttagcaacagttttggactgtagagtgatttgggtttttgacctttataggattgccacgttcacgtggtggaaaagttcatttgtttttgttggaagttttttaggaggtctctttcccccccacaagaaagggggagggggggtttcaaatcatccttnatacaccccctgatgagatattggcataaccttaagttgatgagtctgcgggcgataccaaaaaaaaaaaaaaaacgaaacgctcccaggtccccaattcgccctaaaagagactccaatttcccccccccccctgggcccccccttttacaaccccgggactgggaaaaacccctgaccctaccccaatcatattccccctggacacaaaccccccctttccccaatccggggggaaataaacaaaaaagccc

SEQ ID NO: 59285 - DNA, 634 bp, Zea mays
  misc_feature: Ceres CLONE 1515362
  misc_feature: Encodes the peptide sequence at SEQ ID NO. 59286
tccccgcggtggcggccgctctagaactagtggatcccccgggctgcaggaattcgtctcacccctagaaaaatcttcggcgtgaccaactacatagatacagctcgctctcccatggccagcttcgctgctcagctcaaggacaagttcctcggcgtcatcgacaacatcaccggctggaccagcagcggcgtcgccaaggatacgccgccagaggagtccaccaagttacagtcacgcaccgtgcagcagcccgttgaggtccgatcgagaggtgacgaggaacccattgtgcaaaagggggacgaaccagggccgaactgataccacccttgtctagaaatgtggctccaccacccccgtgcatgggtgtgctgatgctcccaattctcttaaaccccccccccccgctctcatgttggtcttttccctcccccgacaactgacagccggaatggaattccacgcccccgtgaggtgccaaaccggatacttctaatatcgcataacccgcccgaaagtagaaataaaccaagcccccccctcgcaccgccattcccccctaacatcgacctcttattaacgcgccccctcccttgagccccccgggttctatcacgccgccggggacccg

SEQ ID NO: 59286 - protein, 69 aa, Zea mays
  misc_feature: Ceres CLONE 1515362
MASFAAQLKDKFLGVIDNITGWTSSGVAKDTPPEESTKLQSRTVQQPVEVRSRGDEEPIVQKGDEPGPN

SEQ ID NO: 59287 - DNA, 680 bp, Zea mays
  misc_feature: Ceres CLONE 1515363
  misc_feature: SWISSPROT Homolog: EC 3.2.1.23 Beta-galactosidase
aaagctggagctccccgcggtggcggccgctctagaactagtggatcccccgggctgcaggaattcgtctcacccctagaaaaaatcgattatctcaaaaaaaaaaaactactgcaacgcctatatatacttggggtgaggaacatgtgaatgcaagctccggctatcatatacatgtaatatggatacaaactatatatataaatccgccgaggcgccgacaatacaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaaattcgcgttaaatttttgttaaatcagctcattttttttaccaataggcccgaaatcggcaaaaatcccttataaaatcaaaggaatagacccgagatagggtttgagtgtttgttcccgttttggaaacaagaattcccctattaaaaggaaacgtggacctcccaacgtcaaaagggcgaaaaaacccgtccta

SEQ ID NO: 59288 - DNA, 548 bp, Zea mays
  misc_feature: Ceres CLONE 1515374
  misc_feature: Encodes the peptide sequence at SEQ ID NO. 59289
  misc_feature (403)..(403): n is a, c, t, g, unknown, or other
ctccccgcggtggcggccgctctagaactagtggatcccccgggctgcaggaattcgtctcacccctagaaaaaaatcgaattgctttgccgtggaaacaggagaaggaagaatgcaaaacacgtagtgagttcagttgtgacacaagcaccaaactttgatgggtatcagtggagaaagctgcaattgagtatattcattctttatcaagggcacagcctgctcgttctctcaatggtgctggcctttgtcctgctagtagatcacttagcacccaggccgccactacgtcaagcacaccacagttgaaagcacaccccacgtcaagcagccaggccgccactacgttaagcaaaacagaagacgagaagaactgatgtagccatgttcatgcttccactgntgaaatgcatattcagcatagcttacttagttccctatctgctgtttcaacgttgaatttaaaagaagagctgggtagttggtgaactatctggaaatgaatctagttgggaaatgatatataattgggagagccttttgggaaa

SEQ ID NO: 59289 - protein, 52 aa, Zea mays
  misc_feature: Ceres CLONE 1515374
PRGGGRSRTSGSPGLQEFVSPLEKNRIALPWKQEKEECKTRSEFSCDTSTKL

SEQ ID NO: 59290 - DNA, 650 bp, Zea mays
  misc_feature: Ceres CLONE 1515375
  misc_feature: SWISSPROT Homolog: EC 3.2.1.23 Beta-galactosidase
ccaagctggagctcaccgcggtggcggccgctctagaactagtggatcccccgggctgcaggaattcccactagctccgggaaaaagaatgctttatgtgagcggtttaaacttaatcaattgtgggaacaggagattttgctttacctaggcaatatattgagaagctactcttactcatccaccatgaataatctttgctgcagtggagcttcatgtcggcgaacaatgcaaacgttgtacttctttcatgcgattgagtagttgatgttttaaaaaaaaaaaaaaaaaaaaaaaaaaaaaaaaaaaaaaaaaaaaaaaaagaaaaaaaaaaaaaaaaccgagccgctcgaggtacccaattcgccctatagggagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatatttttgtaaaattcccgttaaatttttgttaaaacagctcatttttttacccaataggccgaaatcggcaaaatccctta

SEQ ID NO: 59291 - DNA, 767 bp, Zea mays
  misc_feature: Ceres CLONE 1515379
cccgctgtagctcaccgcggtggcggccgctctagaactagtggatcccccgggctgcaggaattcctctcacccctagaaaaataatgtaatgtgctggtattctccaatgccatagcccatagacagccatggcttggaataacgcagtggctgaccgatatgccagtacgcaccttatctagtacttacagaactacaaaaagtctgtactatacatatatggacaaccttcttccacaaacgccaaactaattctaccctccttccatattgttttaataaacgtgacggggcccctcgggggaacccaatttggcaccatagggaccatatattacggtgcttttatagagttttaccctcttacaaggccaaagacccgggaaaaagcccctccttgttcccccaaaatccaccccccccttttgaaggaactctccccccctttcctacacccccgcccccaatataacacccccaggcccccgcaaccaccattctcccctcttaccccaccgcttgcctgtccccacttttaatttcccttaattgcccaaattttgaaaacagtttataccctctttgaataaaaaaacccccccctatacaatttcccccccccaccgtccacaaattattttgttataaccacaaaaaaccgacccctacaccgccgagccgccaaatcccttttctcccccccccacaacaatccttccccctaaacataacccgccccggatatttcccccgcctataccgcc

SEQ ID NO: 59292 - DNA, 823 bp, Zea mays
  misc_feature: Ceres CLONE 1515380
  misc_feature: Encodes the peptide sequence at SEQ ID NO. 59293
  misc_feature (30)..(30): n is a, c, t, g, unknown, or other
  misc_feature (35)..(35): n is a, c, t, g, unknown, or other
  misc_feature (39)..(39): n is a, c, t, g, unknown, or other
  misc_feature (47)..(47): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (570)..(570): n is a, c, t, g, unknown, or other
agcctcctctttgtcctggcgtgcggcccncacanggcnccgggggncnnnnngtcccnnnnccaaaactggagctccccgcggtggcggccgctctagaatagtggatcccccgggctgcaggaattcgtctcacccctagaaaaagtgcaccccgacatcggcatctcctccaaggccatgtccatcatgaactccttcatcaacgacatcttcgagaagctcgccgcggaggccgccaagctcgcccggtacaacaagaagcccaccatcacctcccgcgagatccagacctccgtccgcctcctcctccccgggaagttccacctggtcggccgtcctggaaggtaccacacgcctccaccaaaataccccctcccccaacacccctagaatcaaccactccattcctatgcaggtcgccccaccaacccccctccacaatggaaagcagaggaggtggtgggatgggattatgtgtaaatttttcacccccctctctaaaaaaactcagaaagtacaccgcgacatgggtatgccgtgttctttagtttcagtctataactatanataaagatacaaacaggccatcagcactctcctacacccgcgtgacggacggtactggcgtgagcgccacagccatccacggaggagctctcttctccgcaacgcgtacgcccccacccatcccatcgcccccttatccctctgcgtccgcctgttctctttaaatcagcgttttttctttcttttacagtgtcccacactcggtcccgccctctccgtggtattctttgttgcggactgtggcgtgttgtcg

SEQ ID NO: 59293 - protein, 70 aa, Zea mays
  misc_feature: Ceres CLONE 1515380
MSIMNSFINDIFEKLAAEAAKLARYNKKPTITSREIQTSVRLLLPGKFHLVGRPGRYHTPPPKYPLPQHP

SEQ ID NO: 59294 - DNA, 695 bp, Zea mays
  misc_feature: Ceres CLONE 1515382
  misc_feature: SWISSPROT Homolog: EC 1.11.1.11 L-ascorbate peroxidase
aaagctggagctcaccgcggtggcggccgctctagaactagtggatcccccgggctgcaggaattcctctcacccctagaaaaagctttctttgatgactacaaagaggcccacctcaagctctccgaactggggtttgctgatgcttaaatagaccctatcttggagtgatacattctgctgcctgtatggaatcatgtggtcttttgcatctggagtcaatgtgaacaagcagattgtcgtattgtctttctcgtaataaatttgtcgatgttgagcccttaggctgttgttggtacatatggtacttcgtcgatgcttgaattgggaccctttgtccgttttcctagactctgatgctttttgccactcccacgaggggagggggggggcttgaggccgcccgcaaggttcttggtgaccctggttgagaaaaaaaaaaaaaaaaaacggagatgctccgaggtacccaaattcccccttatagtgaacccgcatatacccccgctccccagcagcccccgattttccaccgacccgcgcctcggaaaaacccctgaccatacccaaaactcaatcatccccccgagaaacacccccctttttccccatgtcccttataataatggaaaccccttctcttacctcaattctctccttcccccccatgttttcccgtctcccattgtgacggg

SEQ ID NO: 59295 - DNA, 747 bp, Zea mays
  misc_feature: Ceres CLONE 1515447
  misc_feature: Encodes the peptide sequence at SEQ ID NO. 59296
  misc_feature (747)..(747): n is a, c, t, g, unknown, or other
ggcggccgctctagaactagtggatcccccgggctgcaggaattcgtctcacccctagaaaaactttcctagggtttcgtcgcttccagccgccgccgcgtccgcctcgccaagcgcagcagccgccgcagcacatcgctctctcgatctcagccatggcggaggtggagcagcaacaggacacgccgaagctcttcaaccgctggaccttcgatgatgtccaggtgaacgagctctcgctgaacgactacctccctgggaacgcccataaacccgcgatgtgcctgccgcacaccggggggaccgtaccttccgaaagggggttgtcgcgagggctctagtgtttgtaatgcccccccctcccccgggggggggggggggcgggccgccccgcgcgcccaaacagatagaaaggaaggcgttgaagggttggatactgcgaaacgtacccacccgacccccggggccccgcacctacccggcccggcagtccaccgcgcgtaggggggagccccgcgggcttatattacccgccacacgaccgccgagtgccgccgccctgtcgggtcctccgcccccggaccccgggtctggccccccctgcactacgcggcccttgacgtcgcgcgcccacccgcccctgcccaccgcggtttttcccgcgcggacccgccccgacccgcgccctcgtggggaaagcgcggtgcggcgcggagccgccccgcccccgcttctcttttttttttn

SEQ ID NO: 59296 - protein, 61 aa, Zea mays
  misc_feature: Ceres CLONE 1515447
MAEVEQQQDTPKLFNRWTFDDVQVNELSLNDYLPGNAHKPAMCLPHTGGTVPSERGLSRGL

SEQ ID NO: 59297 - DNA, 674 bp, Zea mays
  misc_feature: Ceres CLONE 1515449
  misc_feature: Encodes the peptide sequence at SEQ ID NO. 59298
ctggagctccccgcggtggcggccgctctagaactagtggatcccccgggctgcaggaattcgtctcacccctagaaaaaacccctgacgctcgacgcctctcctcctctcctcccccacccgtccatcgcccctccctccggtctgcgctcccacagcctcacccctgcgcccccgccgattcgcgtcgccctttgttggaaggaacgatggagcagaccttcatcatgatcaagcccgacggcgtccagcggggcctgatcggggacatcatcagtcgcttcgagaagaaagggttctacctcaaggggatgaagttcatgaacgtggagaggtccttcgcgcagcagcactacgctgacctttccgacaagcctttcttccccgggttggtggagtacatcatttccggccccgtggtggcgatggtgtgggaggggaaggacgtcctgttgactggccgcaggatcattggggccaccaggccttgggaggcagcccccggtaccattcgtggggactacgccgtgggaagtcggcagggaatgtcctccctggaaagcgactcccgtggagaaccgggaagaaaggagattcgctctcctgggtccctgaaagggtgtggcacagtgggaaagaacaaccctttcttccctgggatcttacaaggcttg

SEQ ID NO: 59298 - protein, 155 aa, Zea mays
  misc_feature: Ceres CLONE 1515449
  misc_feature (2)..(129): Pfam Name: NDK Pfam Description: Nucleoside diphosphate kinase
  misc_feature: SWISSPROT Homolog: EC 2.7.4.6 Nucleoside-diphosphate kinase
MEQTFIMIKPDGVQRGLIGDIISRFEKKGFYLKGMKFMNVERSFAQQHYADLSDKPFFPGLVEYIISGPVVAMVWEGKDVLLTGRRIIGATRPWEAAPGTIRGDYAVGSRQGMSSLESDSRGEPGRKEIRSPGSLKGCGTVGKNNPFFPGILQGL

SEQ ID NO: 59299 - DNA, 654 bp, Zea mays
  misc_feature: Ceres CLONE 1515450
  misc_feature: Encodes the peptide sequence at SEQ ID NO. 59300
aaagctggagctccccgcggtggcggccgctctagaactagtggatcccccgggctgcaggaattcgtctcacccctagaaaaaaaaaaccgctcgtctctcagcctgtctcgccgcgccgtccatctgccggagctcaccgctaccgtacgtgctgattcaagactcaccgtccgtcgtcgcgagggcgagatcgcggttcgtttcagagcttcgaggaatcgacggtcaagcttcggcgaccaaatgatccagttctttgagttctacgagatcgaagaccctgagcatctgtttggtgaaggttgtccgcattgtaaccactgctccggagaagacgaagtcgtggaaggagacttccaggagttccaagactacgacgaattctaggtgtggattggcggcaacccccagtcagctgcctgtgaaggccttatctttactgcgtttcgctagcactttgatttacttgttaagacaatgactatgtggatgtctatgactctatgatgtaataagtactcttttatgttcaacccggttctcctgcccaaaaaggtggcggaaaaggcgtccagcggcggcagcaacgagagcaagtcccctaagaaggccgccaagtccccaaagaaggctgcccagttcccgaagaag

SEQ ID NO: 59300 - protein, 129 aa, Zea mays
  misc_feature: Ceres CLONE 1515450
KAGAPRGGGRSRTSGSPGLQEFVSPLEKKNRSSLSLSRRAVHLPELTATVRADSRLTVRRREGEIAVRFRASRNRRSSFGDQMIQFFEFYEIEDPEHLFGEGCPHCNHCSGEDEVVEGDFQEFQDYDEF

SEQ ID NO: 59301 - DNA, 550 bp, Zea mays
  misc_feature: Ceres CLONE 1515451
  misc_feature: Encodes the peptide sequence at SEQ ID NO. 59302
  misc_feature (51)..(51): n is a, c, t, g, unknown, or other
aagctggagctccccgcggtggcggccgctctagaactagtggatcccccngggctgcaggaattcgtctcacccctagaaaaaataccctagccgccacacctaacgacccacacgagcactaagccgaggggaggggcgatggcgagaggtgtggtgtcgacgaagggcggcacggccgcgggcaagaagaaggggtcggtagccttcacgatcgactgcaccaagcccgtggaggacaagatcatggagatcgcctcgctcgagaagttcctgcaggagcgcatcaaggtcgccggcggcaaggccggcaaccctcgggcgactcccgtcaccactcttccccgcgagaatgacccaaaggtcccccgtaaaccctggcgaccgggggcccctttctccccaagaagggttttccttaaaaagtccttttgcccccaaaaagttcctttgaaaaaaaccccaaggggcccaaaatttggcccccccgggtgatttgcccccccaaaaagggcccccccccgccctttataaaccggggggctctttc

SEQ ID NO: 59302 - protein, 117 aa, Zea mays
  misc_feature: Ceres CLONE 1515451
  misc_feature (16)..(101): Pfam Name: Ribosomal_L22e Pfam Description: Ribosomal L22e protein family
MARGVVSTKGGTAAGKKKGSVAFTIDCTKPVEDKIMEIASLEKFLQERIKVAGGKAGNPRATPVTTLPRENDPKVPRKPWRPGAPFSPRRVFLKKSFCPQKVPLKKTPRGPKFGPPG

SEQ ID NO: 59303 - DNA, 669 bp, Zea mays
  misc_feature: Ceres CLONE 1515456
  misc_feature: Encodes the peptide sequence at SEQ ID NO. 59304
  misc_feature (669)..(669): n is a, c, t, g, unknown, or other
aaagctggagctccccgcggtggcggccgctctagaactagtggatcccccgggctgcaggaattcgtctcacccctaaaaaaagcccgacgatttcgtccttatcgatctcctcgcacctcgtggcggcacctctccccttctatccaccaagggtttaagatctgtggcaatggctgttaggctggttcaactgcatctctcttgctgtgcaagctgcgaagatctcctcgattccggcggctcctactacgtatgtagctcatggagaagaactggcaatactgtcatgcttccccccaccatcactaaatgcccggagctctccacgctcctcttctacacccgcctcgcaagcctaccatgactgaatgagtcattctggagtgagcttgatggtgtctagcaggtatggaacaacctgacggaccctcacgtagacgacctatgcgattgcgacttcacttggagctgatctttatgcatggttctacatcagcgaaattgttggccgagtaatcacctcacccggctatgacgtcgagaagatttcctccgaatacagacgtgctgttcactctacgctacttgtgatgcttgtcaaaacactatgatacctgcctgtcttccaaatgtggttcatgtagcagactccctagcgctgactgn

SEQ ID NO: 59304 - protein, 64 aa, Zea mays
  misc_feature: Ceres CLONE 1515456
MAVRLVQLHLSCCASCEDLLDSGGSYYVCSSWRRTGNTVMLPPTITKCPELSTLLFYTRLASLP

SEQ ID NO: 59305 - DNA, 653 bp, Zea mays
  misc_feature: Ceres CLONE 1515458
  misc_feature: Encodes the peptide sequence at SEQ ID NO. 59306
aagctggagctccccgcggtggcggccgctctagaactagtggatcccccgggctgcaggaattcgtctcacccctagaaaaaatcagcttccttccacattcgtctcgagatctcgccccgtcgccatggacgcgatcgacagcgtggtggatcccctccgcgacttcgccaaggacagcgtccgcctcgtcaagcgctgccacaagcccgaccgcaaggagttcaccaaggtggcggcgcggacggcgatcgggttcgtcgtcatgggcttcgtcggcttcttcgttaagctcatcttcatccccatcaacaacatcatcgtcggttccggctaggcttacaggagtacagggcgactagcatgggagtagtgcaatacttttgggagcaatagataacgaggatcctggtctttcgaattgtattgttaatgaaatttttcgttcggttgtgtttctaatgtaatcgttgtactgagtagaccttctggataccggattctgagtagaccttgaatccttgatggatcagccaatctcggaaaggaagtttcgtattttgttgttccgttaagctgtttgctgtttgtagctctcatggtgatggtaagcctgatttaggtgtcgttcgggtgcttctggatcgaagaga

SEQ ID NO: 59306 - protein, 69 aa, Zea mays; identical to SEQ ID NO: 53984
  misc_feature: Ceres CLONE 1515458
  misc_feature (10)..(66): Pfam Name: SecE Pfam Description: SecE/Sec61-gamma subunits of protein translocation complex

SEQ ID NO: 59307 - DNA, 613 bp, Zea mays
  misc_feature: Ceres CLONE 1515460
aaagctggagctccccgcggtggcggccgctctagaactagtggatcccccgggctgcaggaattcgtctcacccctagaaaaaacacggtttttgcctcgcacacgaaaagacaccaacccgggcccggagggtcaagtgcagagcagggcaggaggggagaggaaagggaaaagcgggtcgcgagttccgactcgggagtgcccgcttttgctccgatccaatcggtgcctcctcgagcgagatccgctccacgtgccccttccctgccgacataaagggtgtcgacccccctccccagcatctggttacgcggagagatgttgatcttggatacctgatccgctctttgggcttgattgcactatttgaccttttcgctgtctgccccgactcctgctgcctttctcactctccgaggttggcctgcctccagagatgattcttatacttagtgccgatgggtcctagcgacaaagagcgttccctaacaatccccggccggaagggcccatttcctaaaacgcccccggggttttgcctcccctgacaaggggtaatagatccctccgggaaaaccctccccctattttgttgagaaaaagaccccccc

SEQ ID NO: 59308 - DNA, 737 bp, Zea mays
  misc_feature: Ceres CLONE 1515461
aagctggagctcaccgcggtggcggccgctctagaactagtggatctcttgggctgcaggaattcgtctcacccctagaaaaaagtgagtgttgttcccttccctttataaaccagagaacctgcagtgcagtgcaggcagagtactccgtctgatctcggtgatctgtctccacgacaaggagtgcactgtcagctctagcttgctgcagaacaagggcaagatggcaagaggtggtcggctactgatcctctccctggggcttgtgctcctctacttcgtcccatgtaacgccgcagctgctgctggcacaaaacacctggtgctttgccaagcccctatgcgttcaaccatttcccgtctttttttccccccccccaccgggggcccgaaagggggtccctccttcatccataaatccctgttttcgtttacaacccgaaaacaccccgcccccccccccctggtgggcggccatggaccccctttatcatgttcgcacatctacccccccccccccgaccgttgcggtcccaccccccctcgcttggtccccccgcgcccctctcaactccacccccgcccccaaccgtttccgccatttccccaatccaaattccaccatcacatttcttccccctttgccccccgcatcgcctttctcccgcggcacctgcccctgtctcccccctggcgtcgcaccttctgccccctgtaccgcgccccccaatccttcc

SEQ ID NO: 59309 - DNA, 650 bp, Zea mays
  misc_feature: Ceres CLONE 1515469
  misc_feature: Encodes the peptide sequence at SEQ ID NO. 59310
ctggagctccccgcggtggcggccgctctagaactagtggatcccccgggctgcaggaattcgtctcacccctagaaaaaaaactcccagccgtctcctccgcacgcgaaaaccctagcagttcggtagtccctctcctctcgaggtattagcagtcgaccggttcctcggagcacgatgaagtttgttgctgcctacctgcttgctgtcctcgctgggaacgccagcccctccgctgacgatttgactgccattctggagtcagttggctgtgaagttgacaatgaaaagatggaactcctgctgtcccaactgagcggtaaggacatcaccgagctcattgccgcgggcagggagaagtttgcttcagtcccatgtggtggcggcggtgtcgctgttgcggcagctgcacctgctgctggcggagctgctcctgcagctgaggcaaagaaagaagagaaggtggaagagaaggaagaaagcgatgatgatatgggcttcagcctcttcgactaggctgcacagtcatcacagtattgttttgggcagtgaaaccagaggaaaaccagagtcatgtttagattttaagcttgttttatgttggaaagtactggaaagactgctacttgtctttatacttggtaattcag

SEQ ID NO: 59310 - protein, 112 aa, Zea mays
  misc_feature: Ceres CLONE 1515469
  misc_feature (17)..(111): Pfam Name: Ribosomal_60s Pfam Description: 60s Acidic ribosomal protein
MKFVAAYLLAVLAGNASPSADDLTAILESVGCEVDNEKMELLLSQLSGKDITELIAAGREKFASVPCGGGGVAVAAAAPAAGGAAPAAEAKKEEKVEEKEESDDDMGFSLFD

SEQ ID NO: 59311 - DNA, 666 bp, Zea mays
  misc_feature: Ceres CLONE 1515470
aaagctggagctccccgcggtggcggccgctctagaactagtggatcccccgggctgcaggaattcgtctcacccctagaaaaaatcttcgcatttccatctccccgtgggatcccagccgccgccgcaagaagaagagctcggggacttgcaggtctcgagagaagatggtcttagtgttgccgacatcgctgacggacccagacaatgtgctcttgttttgtacaatctctgtccgaaacagatacacgagatcaaggattttcttctcaccgcgaggaggaaggatgcccgatcagtgaagatcaagaggagcaaggatgttgtcaagttcaaggtccgctgctccaagtacttgtacaccctctgcgtattcgatgctgagaaggcaaacaagttgaagcaatctctccccccaggcttgagcgtccaggaggtttgattggatacatgacaacgtcgggtcgaacctctagagcatctttatcatcagcagagcatgctgtttatgtagttttggatcttaagctattagaagtgttggatttgtggatcttgaatttttggagaaataccaatttgcctcgttctaaaaaaaaaaaaaaaaacgagacgctcgaggtacccaattcgccctatagtgagtcgtattacgcgcgctcactg

SEQ ID NO: 59312 - DNA, 627 bp, Zea mays
  misc_feature: Ceres CLONE 1515471
  misc_feature: Encodes the peptide sequence at SEQ ID NO. 59313
ggagctccccgcggtggcggccgctctagaactagtggatcccccgggctgcaggaattcgtctcacccctagaaaaagaggaagcggtaagcgcggagggaggacgggagagagagataggcgtgccttcgtcgtccgtgccggtgcgtggcgtggtggccgtgccgaccgtccgtccaccccctctcctcttcccggcgccggcgacagcgggagggactccctgggaggaatggccgtggtgagggctccgctcggcgcggtggcggtggccgctctcgtcgtcgccatcttcatgccggccgccgcagcggcgcaggcaccggcgcccgcgcccaccagcgacggcacatcaatcgaccctgggatcgcgtacatcccttatggctggtggccccctgggtgcctcaccctacctctgaatcccaccccgcttggacgcggtccttcccccctacaaagctccttttaatcctcctgctcccttttcccgtttgggccatggcgggttattggggggcctttagggaaatttttaggggggccccaaaaatgttttaaggggaaggtttgggaagggtttaaaaatggtgagaggattggccacccctttggaacctttgggg

SEQ ID NO: 59313 - protein, 79 aa, Zea mays
  misc_feature: Ceres CLONE 1515471
  misc_feature (9)..(64): Pfam Name: DUF1070 Pfam Description: Protein of unknown function (DUF1070)
MAVVRAPLGAVAVAALVVAIFMPAAAAAQAPAPAPTSDGTSIDPGIAYIPYGWWPPGCLTLPLNPTPLGRGPSPLQSSF

SEQ ID NO: 59314 - DNA, 584 bp, Zea mays
  misc_feature: Ceres CLONE 1515472
  misc_feature: Encodes the peptide sequence at SEQ ID NO. 59315
  misc_feature (21)..(21): n is a, c, t, g, unknown, or other
ccccgcggtggcggccgctcnatcctagtggatcccccgggctgcaggatttcgtctcacccctagaaaaaacaacctagacagagagagataggcaggccagctagcttcttagtagctaggtctcctggattactgtgacaatgtccaagataggcagcttcgtgtccggcctggtcagccggcggagctacggcagcgtccagcacgcgatggcggtgaatgctcaagcctccgctgctgcagcggcggcgacgaaagcgggcgtcgtcgcggcagcggatgcgtcgggggcgaccaacaacaagacgaagcaggacaagttctggatgagggaccccaagacgggctgctggatcccagagaaccggttcgaaagaggtggacgtggtcgacctgcggaaccggctgatccacgtccaccaccacaactaaactccttccgaaagcaccagcagatcaaacaggcgtttggggctaaatgagaacccttggcgtggaatcaagcgttcaggttgacccccccgcaagcatttttttcacggggggatttattatttggggctgggaaaaaaaaaaaaaat

SEQ ID NO: 59315 - protein, 113 aa, Zea mays
  misc_feature: Ceres CLONE 1515472
MSKIGSFVSGLVSRRSYGSVQHAMAVNAQASAAAAAATKAGVVAAADASGATNNKTKQDKFWMRDPKTGCWIPENRFERGGRGRPAEPADPRPPPQLNSFRKHQQIKQAFGAK

SEQ ID NO: 59316 - DNA, 666 bp, Zea mays
  misc_feature: Ceres CLONE 1515474
  misc_feature: Encodes the peptide sequence at SEQ ID NO. 59317
  misc_feature (410)..(410): n is a, c, t, g, unknown, or other
aagctggagctccccgcggtggcggccgctctagaactagtggatcccccgggctgcaggaattcgtctcacccctagaaaaaatcatccagtgctctctcctcttgcgattcgctcgctcgatcctagcttcccttccaagaagcgcagcgcccatggccatggccacgcaagcctccgccgccacgcgccacctgctggccgccgcctgggcgccggcggcgaagccgcggcagctgagctcgcagctcgcgctgccgtcgtcgtcctcccgcgggccggccccgctccgcgcgtccaccgaggaggcggtggaggcgcccaaggggttcgtggccccgcagctggaccccagcacgccgtccccgatcttcggcggcagcgcgggcgggctgctccgcaaggcgcangtggaggagttctacgtcatcacgtggacgtcccccaaggagcaggtgttcgagatgcccaccggcggcgccgccatcatgcgggagggccccaacctcttgaagctggcgcgcaaggagcagtgcctggcgctcggcaccaggttgcgcccccaagacaagatcacctaccagttctaccgcggctttccccaacggggaagtgcagtacctccacccccaggagggcgtctccccggaagaaggccaaacccgg

SEQ ID NO: 59317 - protein, 170 aa, Zea mays
  misc_feature: Ceres CLONE 1515474
  misc_feature (62)..(170): Pfam Name: PsaD Pfam Description: PsaD
  misc_feature (85)..(85): Xaa is any aa, unknown, or other
MAMATQASAATRHLLAAAWAPAAKPRQLSSQLALPSSSSRGPAPLRASTEEAVEAPKGFVAPQLDPSTPSPIFGGSAGGLLRKAXVEEFYVITWTSPKEQVFEMPTGGAAIMREGPNLLKLARKEQCLALGTRLRPQDKITYQFYRGFPQRGSAVPPPPGGRLPGRRPNP

SEQ ID NO: 59318 - DNA, 629 bp, Zea mays
  misc_feature: Ceres CLONE 1515478
  misc_feature: SWISSPROT Homolog: EC 3.6.3.14 H(+)-transporting two-sector ATPase
  misc_feature (450)..(450): n is a, c, t, g, unknown, or other
tggagctccccgcggtggcggccgctctagaactagtggatcccccgggctgcaggaattcgtctcacccctagaaaaatttattatgttagatgaaggggaaaaaatgggaactcaaagatatcgaagagtaaaaaaaaggatggaataaaagagtgattggttgaaaagaaagagaaatagaataatgagaatcatatggatttacacaaacctctaatgattaaaaacgagatctcgaagtaattcgaacgatttcgattatcatttatttgtacttattagttacttctacccgatagagcttagaagttggaagtaataatttcttggttgattgtatccttaaccatttctttttttttgacacgaggaactcatcatgaatccactaattgctgctgcttccgttattgctgctggattggccgtagggcttgcttctattgngcccggagttggtcaaggtactgctgcaggacaagctgtagaaggtattgcgagacagccagaagcagaaggtaaaataagaggtactttattgcttagtctagcttttatggaaagctttacaatttatggactggttgtggcactagcgcttttattgcgaaccctttttgttaatc

SEQ ID NO: 59319 - DNA, 645 bp, Zea mays
  misc_feature: Ceres CLONE 1515480
  misc_feature: Encodes the peptide sequence at SEQ ID NO. 59320
aaagctggagctccccgcggtggcggccgctctagaactagtggatcccccgggctgcaggaattcgtctcacccctagaaaaagagtttcctcctccactccctcccccccgcctccactaccccactcccaggagccgcccaggtacgtcgccggcggcgatgacgacgcgcttcaagaagaaccgcaagaagcgcggccacgtgtccgccgggcacggccgcatcggcaagcaccggaagcatcccggaggtcgcggtaacgccggtggcatgcaccaccaccgcatcctcttcgacaagtaccatcccggctacttcggtaaggtcggcatgcgctacttccacaagctccgcaacaagttctactgccccgcgggggggggcgagcgcctctggtcgatggtgcccgccgaaaaggcggcggaagccggcggcgacaaggccccgcagatcgacgtcacgcagttcggcttcttcaaggtgctcgggaagggggtgctgccgcccaagcccatcgtcgtcaaggccaagctcatctcccaggtcgcccgagaaaaaaatccaggcccccggcggcccccttcgggctccaccgcctaagtttccaggcccttattccccctcctgggttttggagaatca

SEQ ID NO: 59320 - protein, 146 aa, Zea mays
  misc_feature: Ceres CLONE 1515480
MTTRFKKNRKKRGHVSAGHGRIGKHRKHPGGRGNAGGMHHHRILFDKYHPGYFGKVGMRYFHKLRNKFYCPAGGGERLWSMVPAEKAAEAGGDKAPQIDVTQFGFFKVLGKGVLPPKPIVVKAKLISQVAREKNPGPRRPPSGSTA

SEQ ID NO: 59321 - DNA, 666 bp, Zea mays
  misc_feature: Ceres CLONE 1515483
  misc_feature: SWISSPROT Homolog: EC 3.6.3.14 H(+)-transporting two-sector ATPase
ctggagctccccgcggtggcggccgctctagaactagtggatcccccgggctgcaggaattcgtctcacccctagaaaaatttattatgttagatgaaggggaaaaaatgggaactcaaagatatcgaagagtaaaaaaaaggatggaataaaagagtgattggttgaaaagaaagagaaatagaataatgagaatcatatggatttacacaaacctctaatgattaaaaacgagatctcgaagtaattcgaacgatttcgattatcatttatttgtacttattagttacttctacccgatagagcttagaagttggaagtaataatttcttggttgattgtatccttaaccatttctttttttttgacacgaggaactcatcatgaatccactaattgctgctgcttccgttattgctgctggattggccgtagggcttgcttctattgggcccggagttggtcaaggtactgctgcaggacaagctgtagaaggtattgcgagacagccagaagcagaaggtaaaataagaggtactttattgcttagtctagcttttatggaagctttacaatttatggactggttgtggcactagcgctttttattgcgaacccttttgttttatcataaaaaaaaaaaaaaaaacgagacgctcgaggtac

SEQ ID NO: 59322 - DNA, 644 bp, Zea mays
  misc_feature: Ceres CLONE 1515484
  misc_feature: Encodes the peptide sequence at SEQ ID NO. 59323
  misc_feature (397)..(397): n is a, c, t, g, unknown, or other
  misc_feature (400)..(400): n is a, c, t, g, unknown, or other
  misc_feature (472)..(472): n is a, c, t, g, unknown, or other
gaagctggagctccccgcggtggcggccgctctagaactagtggatcccccgggctgcaggaattcgtctcacccctagaaaaaaggccgagagttgtcaaggacgacgtctgccggcagtgctcctgctcctcctcctccttcctggccgccgcgcgagcttgggttagttagtgtctcttcttcgcggagacctgtgagaggagccatcatcatggccgctgttgagactgttgtcctcaaggttgctatgtcatgcgagggctgcgccggggcggtcagaagagtgctctccaagatggaaggagttgaaaccttcgacatagacctcaaggagcagaaggtgacagtcaaaggcaatgtcacgcctgaggacggggggggggggggttccaantcnggaaaaaggacttcgtactgggagggcgaaaccacggccccggacgctggggcggctccagaacccaaacanctcccagcaccgcggcagaaacgcctcctgctgctgcttccgggggccccgaaatcaccccaacccaagctgaacccttgaccgcccggctatttttccctcacatgggatgccgccgcttgcgaactcctaaaccttaaatctagaaatgggtggggattgctgggggggg

SEQ ID NO: 59323 - protein, 112 aa, Zea mays
  misc_feature: Ceres CLONE 1515484
  misc_feature (7)..(84): Pfam Name: HMA Pfam Description: Heavy-metal-associated domain
  misc_feature (61)..(61): Xaa is any aa, unknown, or other
  misc_feature (86)..(86): Xaa is any aa, unknown, or other
MAAVETVVLKVAMSCEGCAGAVRRVLSKMEGVETFDIDLKEQKVTVKGNVTPEDGGGGGSXSGKRTSYWEGETTAPDAGAAPEPKXLPAPRQKRLLLLLPGAPKSPQPKLNP

SEQ ID NO: 59324 - DNA, 686 bp, Zea mays
  misc_feature: Ceres CLONE 1515490
  misc_feature: Encodes the peptide sequence at SEQ ID NO. 59325
  misc_feature (392)..(392): n is a, c, t, g, unknown, or other
  misc_feature (393)..(393): n is a, c, t, g, unknown, or other
ctggagctccccgcggtggcggccgctctataactagtggatcccccgggctgcaggaattcctctcacccctagaaaaaacggcagctctgaagggaaagagatcgatcgtatctgcggaacaagcagcgaaggatcggagcctatccaatggccgagggcaacagcagctccggcggcgacctgttctccagcggcaagctggtggcgggggccgccgtgtcggtgttccagcagaagagcgtggagaacgtcgacaagcaggaggtcgccggcgcggcggccgagctcctgcacgcggcgtccgcgtacggtaagctcgacgacaagccggccgggcagtacgtcgagaaggcctatgggcactccaaggagggggggggggggcgccnnacacaccccctaacaggagcagcttgcggcggcagcaagcgaccactcggtgtcccaagcaccggcccccggaagcaccctaggaagctggcggcggtgcctgttctctggccccgaaggaaaggaaacaagcccacgaagggcttcccgcccccgcggaattattcattcgcccccccaacaccccggcgggtacggacaattacccctggttagcagggataagcataacccccccccgtctcgctcaggtctgtttaacaaagcggacctcagggctcccctatccgggg

SEQ ID NO: 59325 - protein, 152 aa, Zea mays
  misc_feature: Ceres CLONE 1515490
  misc_feature (81)..(81): Xaa is any aa, unknown, or other
MAEGNSSSGGDLFSSGKLVAGAAVSVFQQKSVENVDKQEVAGAAAELLHAASAYGKLDDKPAGQYVEKAYGHSKEGGGGRXTHPLTGAACGGSKRPLGVPSTGPRKHPRKLAAVPVLWPRRKGNKPTKGFPPPRNYSFAPPTPRRVRTITPG

SEQ ID NO: 59326 - DNA, 650 bp, Zea mays
  misc_feature: Ceres CLONE 1515491
  misc_feature: Encodes the peptide sequence at SEQ ID NO. 59327
ggagctccccgcggtggcggccgctctagaactagtggatcccccgggctgcaggaattcgtctcacccctagaaaaaccccacctccatccagcttgagccagcccgtcgcctgcgcgcatctctctacacttctactgcttcatactctcgtagagagatccccgcggcccaataaaaacccgactcgctagctgcactacacactcgcagatggccggcctcaggatgaagttcgtcgccgtcgccgccatggccgccgcgctcgtggcgtccgccgcagccgccgaggcccccgccccggcccccgcctccgacgccgcggccgccgtgcccctcgccgcggcctccctcgccgccgccgccttcggctacctcttctgctagatccgcgctggacgcgtggtttgtgcttgatttgtgattcgtctggcgcgagtggagtccgtgtcgtgcgcgtgtctgtgtgagttgtttcggcgggcgtgtgtctgtatgtatggagtcggcggcggcggaggtgtgcgcgtggtggtacgtgcgtcgacgctccattgtttgtggcggcgatcatgtgcctggcccgttttctggttatcaatgagatgatttatttgattctttccagcctgaaaaaaaaaaaaaaaacg

SEQ ID NO: 59327 - protein, 57 aa, Zea mays; identical to SEQ ID NO: 43282
  misc_feature: Ceres CLONE 1515491

SEQ ID NO: 59328 - DNA, 740 bp, Zea mays
  misc_feature: Ceres CLONE 1515492
  misc_feature: Encodes the peptide sequence at SEQ ID NO. 59329
  misc_feature (396)..(396): n is a, c, t, g, unknown, or other
aagctggagctccccgcggtggcggccgctctagaactagtggatcccccgggctgcaggaattcgtctcacccctagaaaaatcagaatcggaccaccacacgcccgaggcccgactgcaagcgcctgagcccaagacccatggccatggccgccgccaccgtcgcagcgtctctgcccgtggcgcaggggctcgggaagcccctctgcgccggaagcaacgcgccgtcgctccgggccgtcgcgggcgcgccccgtcgtcggtcggccaggaccaggatggccgtcctccgggcgtccgcgcaaaagcagcacccggccaaggagtgggcggccgcggctgccctggcggcgggtcttggtgctcccccgaggtggggggggggggggggcccnaaaatctcccccctccctttaaaaaatttcctccctcagcatactactttccgggggggtcccggcttctttcccccatctttcgggcccccctttgttccccccgtctcttaaatttccaatcgccgcttcgggggggggggtatagacacgcctgggcttcaacttgtgggcgttgtttccgcccctattgccctgagcattgtcctcctttccgcgggggcgatacccccattacaaaaatgggtgttaaaagccctccagccgggctaaatattttctttttctccgccccaccccaatcttccttatattggcaccgcttatctccacacggttcatcc

SEQ ID NO: 59329 - protein, 120 aa, Zea mays
  misc_feature: Ceres CLONE 1515492
MAAATVAASLPVAQGLGKPLCAGSNAPSLRAVAGAPRRRSARTRMAVLRASAQKQHPAKEWAAAAALAAGLGAPPRWGGGGGPKISPLPLKNFLPQHTTFRGGPGFFPPSFGPPFVPPVS

SEQ ID NO: 59330 - DNA, 675 bp, Zea mays
  misc_feature: Ceres CLONE 1515495
  misc_feature: Encodes the peptide sequence at SEQ ID NO. 59331
agagctggagctccccgcggtggcggccgctctagaactagtggatcccccgggctgcaggaattcgtctcacccctagaaaaaaagaccaccgacgcgtagcacagtccattattgccgtctcccttttgcgtgagcaaagaaagagagcgagaagagcagtcgccatgtctggcatcatccacaagatcgaggagaagctccacatggggggcgaccacaagaataaggaggaggagcaccacaagaaggccgaggagcaccacaagaaggaggagggggagcaccacaagaaggacggcggggagcacaaggaaggcatcgtggagaagatcaaggacaagatcaccggcgagcacggcgacaagtccggccaccacaaggaagagagggacaagaaaaagaagaaccacggcgagggccacgaccacgacggcggccacattagcagcagcagcgacggcgactgagatctggtgtcgcaacccaggtgcaacccatgtatgcttgcttgaaggaggattcataccacctgatgccgatgtagggtttccctggggccatgcatgaatcccggctattataatccaaaaaaaaaaaaaaaaaccaaacccctgaggggcccccaattccccctcaaaggggggccgtattaacccccgccctcacgccccc

SEQ ID NO: 59331 - protein, 100 aa, Zea mays
  misc_feature: Ceres CLONE 1515495
  misc_feature (2)..(100): Pfam Name: Dehydrin Pfam Description: Dehydrin
MSGIIHKIEEKLHMGGDHKNKEEEHHKKAEEHHKKEEGEHHKKDGGEHKEGIVEKIKDKITGEHGDKSGHHKEERDKKKKNHGEGHDHDGGHISSSSDGD

SEQ ID NO: 59332 - DNA, 707 bp, Zea mays
  misc_feature: Ceres CLONE 1515497
  misc_feature: Encodes the peptide sequence at SEQ ID NO. 59333
agagctggagctccccgcggtggcggccgctctagaactagtggatcccccgggctgcaggaattcgtctcacccctagaaaaaaccgcaatcttcaatctccccagcaatccctagcagaagccttccatcctcactcgctcgatggcccgcacgaagcagacggcgaggaagtccaccggcggcaaggcgccgaggaagcagctggcgactaaggcggcccgcaagtctgcccctgcgaccggcggagtgaagaagccccaccgcttccgccccggcaccgtcgcgctccgggagatccgcaagtaccagaagagcacggagctgctgatccgcaagctgccgttccagcgcccggtgcgggagatcgcgcacgacttcaagaccgacctactcttccagagctctgctgtctccgcgctgcaggaggcggctgaggcctaccttgtcgggctcttccaaggacccaccttctgcgccatcccgccaagggccgtccccttcttgccccaaggaaatccaactttgccccgcctgactccgactggggagaggggcctcaatccctccttaatttcttggattaccgcgggcccccccaccaaaaagaatgttccgaaattcgcccctggggttccccgaacaactcgggcgtttacatggttcacacacaactcgcaaggcgggcgggattatgccccccccgc

SEQ ID NO: 59333 - protein, 187 aa, Zea mays
  misc_feature: Ceres CLONE 1515497
  misc_feature (58)..(125): Pfam Name: Histone Pfam Description: Core histone H2A/H2B/H3/H4
MARTKQTARKSTGGKAPRKQLATKAARKSAPATGGVKKPHRFRPGTVALREIRKYQKSTELLIRKLPFQRPVREIAHDFKTDLLFQSSAVSALQEAAEAYLVGLFQGPTFCAIPPRAVPFLPQGNPTLPRLTPTGERGLNPSLISWITAGPPTKKNVPKFAPGVPRTTRAFTWFTHNSQGGRDYAPP

SEQ ID NO: 59334 - DNA, 675 bp, Zea mays
  misc_feature: Ceres CLONE 1515498
  misc_feature: Encodes the peptide sequence at SEQ ID NO. 59335
aaagctggagctccccgcggtggcggccgctctagaactagtggatcccccgggctgcaggaattcgtctcacccctagaaaaagttccatcgccccccattgctcgccaagagttcttcttgtttaggcaaaggcaaaagcaggagcaaaaaggtttcgttggcgatggcgagctcgtggacgcttcctgaccacccgaagctccccaaggggaagccggtggctgttgtcgtgctggacggatggggcgaggccaaccccgaccagtacaactgcatccatgtcgctcagactcctgtcatggactcgttaaagaatggtgctcctgagaaatggacactagtgaaggctcatggaacagctgtgggtctcccatctgatgatgacatgggcaacagtgaagttggtcacaatgcacttggtgctggtcggattttcgccccaggtgctaagcttgttgatcaagctcttgcctcatgacagatttatgatggagatgggttcaactacatcaaagaatctttttgaaaatggtactcttcaccttattgggttgttgagtgatggtggtgtccactcccccctttgacaaactacagtttacttcttaaaaagtgtccattgcagacaggatcaaaaaaaaaaaaaaaaaaaccaaggactctcctatgtag

SEQ ID NO: 59335 - protein, 104 aa, Zea mays
  misc_feature: Ceres CLONE 1515498
  misc_feature: SWISSPROT Homolog: EC 5.4.2.1 Phosphoglycerate mutase
MASSWTLPDHPKLPKGKPVAVVVLDGWGEANPDQYNCIHVAQTPVMDSLKNGAPEKWTLVKAHGTAVGLPSDDDMGNSEVGHNALGAGRIFAPGAKLVDQALAS

SEQ ID NO: 59336 - DNA, 677 bp, Zea mays
  misc_feature: Ceres CLONE 1515502
  misc_feature: Encodes the peptide sequence at SEQ ID NO. 59337
  misc_feature (677)..(677): n is a, c, t, g, unknown, or other
acagctggagctcaccgcggtggcggccgctctagaactagtggatcccccgggctgcaggaattcgtctcacccctagaaaaaatcagggttcagtgaagtgtagtgcagccaaggcagcagagcgtgaggtgcactaccaggcaacaaggaaaaaaatggagctccaggcaaggtgcgtctgcgtcgtcgcgatgctcctggtggccagcttcgcggggctggatacggcgcacggcgcgggagagtgcggccgcgtcccggtggaccaggtggcgctcaagcttgctccgtgcgcggcggccacgcagaacccgcgcgccgcggtgccgccgagctgcttgccgcaggtgcgcgccatcgggcgcgtccccaagtgcctgtgcgccctcatgctgtccgacaccgcgcggaaggccggcgtcaagcctgccctggccataaccatccccaagcccttcgccatcgccaacccccccgacgggctcaaagtgcggccaataacccctgccctgagggggattcttgacgaccccaattcattggcccgcccctggtttcggtccgctgtacccttaaacgacctccaaaactcttgacttggcccaaaacttcccgggaaccctctttttccccaatccattactttttcccaaaaaatcccccaacaaaaaaan

SEQ ID NO: 59337 - protein, 146 aa, Zea mays
  misc_feature: Ceres CLONE 1515502
MELQARCVCVVAMLLVASFAGLDTAHGAGECGRVPVDQVALKLAPCAAATQNPRAAVPPSCLPQVRAIGRVPKCLCALMLSDTARKAGVKPALAITIPKPFAIANPPDGLKVRPITPALRGILDDPNSLARPWFRSAVPLNDLQNS

SEQ ID NO: 59338 - DNA, 721 bp, Zea mays
  misc_feature: Ceres CLONE 1515504
  misc_feature: Encodes the peptide sequence at SEQ ID NO. 59339
tccccgcggtggcggccgctctagaactagtggatcccctgggctgcaggaattcgtctcacccctagaaaaaaggccacttacctgcagtcaccactcccaagccagtacccacagtcctacgagcagtcgcacgcaagtgtcaagagacaaaacggtcgacatggctcgcacgcaatctgccgtagcggtcgccgtggtggccgcggtgctgctgctggcagcgacggccacgacctcggaggccgccatcccctgcgggcaggtgagctccgttttcccgccctgcctctcctacacccgcggcacgggggtctggcccctccgcgtcctgctgtaccggcatcatttttttcccccccccccgggggggggggggggggattttcctcacccccctccccttgttctccaggaacgccttcttagggtttttatgcctgcctcctcggcgggcccacgccccctcagcttatctctaccaagtggcccgcgtcccgaactcccccttccccctttaattgacccccccccgtactgcctccccctggtgaatcccaccaccttaccccgctaccctccctcatgacatgtcccgccccccgctttacccccatgcctctcaagacccccgctcctgtctcgtcctactcccggcgacccacccatcccttatgacacctgggtcactatttccccctcggctttatacgccccaccc

SEQ ID NO: 59339 - protein, 141 aa, Zea mays
  misc_feature: Ceres CLONE 1515504
MARTQSAVAVAVVAAVLLLAATATTSEAAIPCGQVSSVFPPCLSYTRGTGVWPLRVLLYRHHFFPPPPGGGGGDFPHPPPLVLQERLLRVFMPASSAGPRPLSLSLPSGPRPELPLPPLIDPPPYCLPLVNPTTLPRYPPS

SEQ ID NO: 59340 - DNA, 586 bp, Zea mays
  misc_feature: Ceres CLONE 1515506
  misc_feature (209)..(209): n is a, c, t, g, unknown, or other
  misc_feature (210)..(210): n is a, c, t, g, unknown, or other
  misc_feature (218)..(218): n is a, c, t, g, unknown, or other
  misc_feature (219)..(219): n is a, c, t, g, unknown, or other
  misc_feature (220)..(220): n is a, c, t, g, unknown, or other
  misc_feature (387)..(387): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (434)..(434): n is a, c, t, g, unknown, or other
  misc_feature (435)..(435): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (474)..(474): n is a, c, t, g, unknown, or other
  misc_feature (475)..(475): n is a, c, t, g, unknown, or other
  misc_feature (493)..(493): n is a, c, t, g, unknown, or other
  misc_feature (516)..(516): n is a, c, t, g, unknown, or other
  misc_feature (533)..(533): n is a, c, t, g, unknown, or other
  misc_feature (534)..(534): n is a, c, t, g, unknown, or other
  misc_feature (536)..(536): n is a, c, t, g, unknown, or other
  misc_feature (548)..(548): n is a, c, t, g, unknown, or other
  misc_feature (549)..(549): n is a, c, t, g, unknown, or other
aaagctggagctccccgcggtggcggccgctctagaactagtggatcccccgggctgcaggaattcgtctcacccctagaaaaaatcggtcaatcagcaatcaccccaaatcctagggttctagtcgcttctcgtcgtttcgttcgtagatcacagagacaatggtgaaggcagttgctgtcctcgccggcactgatgtcaagggcacnncatcttcnnntttcacaggggaagggggggatggggtccccaaacccccccccggaaacctggggaaaaaattttttttggggggccccaaaaacccagggggggccccccccggggggggttccccccccctggggcgcccccccccccttttttttgggtgggaaaaaaaaaccnccccccccaaaaaaagggagagggggnnnngtggggtgtgttttttnntgtagggggggggggggggcccccccaccccccccnnnnnacaaaaaaaaaaacactnccttttttgttgggggggggttncggaaggagaaggaaannanagagaaggtggnngtgtggtggtggggcgcgcggccccgaaaaaaaaaaa

SEQ ID NO: 59341 - DNA, 687 bp, Zea mays
  misc_feature: Ceres CLONE 1515507
  misc_feature: Encodes the peptide sequence at SEQ ID NO. 59342
  misc_feature (687)..(687): n is a, c, t, g, unknown, or other
aaagctggagctccccgcggtggcggccgctctagaactagtggatcccccgggctgcaggaattcgtctcacccctagaaaaactgccatcagaatcagaccaccacacgcccgaggcccgactgcaagcgcctgagcccaagacccatggccatggccgccgccaccgtcgcagcgtcactgcccgtggcgcaagggctcgggaagcccctctgcgccggcagcaacgcgccgtcgctccgggccgtcgcgggcgcgccccgtcgtcggtcggccaggaccaggatggccgtcgtccgggcgtccgcgcaaaagcagcactcggccaaggagtgggcggccgcggctgccgtggcggcggcgctggtgctgccggaggtcgcggaggccgcgccggggatctccccgtcgctcaagaacttcctcctcagcatcgtctccggtggggtcgtgctcgtcgccatcgtcggggccgtcgtccccgtcctcaaacttcgatcccgtccaggcgggggttgagcttgcatgcccccctggggggcttgttgtattggaccctatgaactggaaaactcccccccccgtgggctttccccatgaaaacccgggttttaatggcctggaatggggaaaattttcattttccaggccatcccgtaatggtatgaaaaccggattccccccgn

SEQ ID NO: 59342 - protein, 121 aa, Zea mays
  misc_feature: Ceres CLONE 1515507
MAAATVAASLPVAQGLGKPLCAGSNAPSLRAVAGAPRRRSARTRMAVVRASAQKQHSAKEWAAAAAVAAALVLPEVAEAAPGISPSLKNFLLSIVSGGVVLVAIVGAVVPVLKLRSRPGGG

SEQ ID NO: 59343 - DNA, 893 bp, Zea mays
  misc_feature: Ceres CLONE 1515509-R
caattgggtacctcgagcgtctcgtttttttttttttttttgcgcctgactttattttattccatctcgactgggaagggacacccaatcaaacatgcaaaacaacagcaagagctagcttattggtggctgcctgcctgcttatagcaaggcggacggacggaggagcatggaaggatccatctggctgtgccgctgtggatgagtctagtggatcttgcagccgcagttttcggggaggaagtcgcggcacctgtacttggtggtgcccttgtccgtggacacggggacgcagttcttgcaggtggcggcgcacttggtgaggaggtcgtcgcaggtccacacgcccgaccagctggtgcactcgccgcaccagcactgcttcttcgtcgtcggccctgcaggtcctttggccacggccgcagagaccagaaggggcctggagaactaggatcgccaacagaaggtgctgctcttcatctttctcggacctcttcgctctaacggctttgctggccgaacttcctactacaaggaaaccgcaggcttttcagatttcgtcacctggctcaaatgatccctttcccgccagggttcccccttacggaaaacctttggttaacgaactttctccttttccccttaaaaaggaataaagggttcaaatgggaccctctcccggaaaaatttgggggggggggggggggaaaaaacgccccccccccgttccgcgcgggaaattttagaaaaaacctttctcccgggggaccatttttttaatttttttttttagggagacccccccacggggggcggggttgtttttccaaaaagggggggcgggggggggactttttttttaccaccccccccgggggggttttgataaattc

SEQ ID NO: 59344 - DNA, 677 bp, Zea mays
  misc_feature: Ceres CLONE 1515510
atagctggagctccccgcggtggcggccgctctagaactagtggatcccccgggctgcaggaattcgtctcacccctagaaaaagcttcgctcgcgggcgctcatctccactcctccgatggcgccgccacccaccagcccctcattcctccgcccgccgccgctgccacaccacccgcaccctcgcctccttttgcgacctccctccgcctctttccgcgtcgccgaaatactcggcggtcggggcctctgcaatggtgaggtcggcgtccgcaaagaactcgcatccggatccaccacctcctcgcccgcgccctctcctcctccttcgacagattctcctccgcccgcggttgatccggacgcgttcgagaaggagatgatgggcctcacaggcggcttccctggcggtgaggtcggcctcaaggacttcttagccaagaacccgcctccctccaagaaatcagaatcccagccccaagccacgctctccgcgccgccgcggccgccggagctgccgctgttcttgccccggcatggcggtgcttgtcaagaacccccaacaacgcctaccagctgggctgcggtaacttggagccgcgtaaaacacggcaagggccccggggcccttccaagaaagaagtgtgggacaagctttttcccctttaacctccaac

SEQ ID NO: 59345 - DNA, 819 bp, Zea mays
  misc_feature: Ceres CLONE 1515517
  misc_feature: Encodes the peptide sequence at SEQ ID NO. 59346
  misc_feature (37)..(37): n is a, c, t, g, unknown, or other
  misc_feature (38)..(38): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (819)..(819): n is a, c, t, g, unknown, or other
cctctttttcttctggctcgccgatattccccttttnnccnnnnnnnnnnnnnnncaaaactggagctccccgcggtggcggccgctctatttctagtggatcccccgggctgcaggaattcctctcacccctagaaaaatccgccgcggctcgtctccgtctctccggctcggcgtctagctcgtcaacgcgcgcgtccgccgtcggctcctccgaccggcgtcccaccgcaggggatacagatcggcgatccgctgggcttgcaaacatgtatatccgagtgaagcgcaacacgagtacctacttcattcaatgtgaaccgacagagacagctttgagcatcaaacagaagttgcactcgctgatagatcaaccttctagtagtcagcagttggtccttgcggcctaccctttttgtgcctccccccacccccagaggttgggcggattaaaaggtgcgataacaacttcgcattgttggcatcgggcacctcaaaaaaacgacgaaccgccgaagttttgtaaggaaattttttcattttgttcccggccccaccaggaattttcccatgggcatccctgcctgaataccagagactagtttgccctcctctctcctacaccagggggaacacactgttcaacttcctctttgaaaaaagagacctcgggcggctttctaagtgtcttgcatccctttatttctataaaccggtggtaacgggaggggtattggtatttggtcgcccgttcgttggcggacgcactcaactctgaagcaactccgtattttcttgttgacatcacccctcacccan

SEQ ID NO: 59346 - protein, 110 aa, Zea mays
  misc_feature: Ceres CLONE 1515517
MYIRVKRNTSTYFIQCEPTETALSIKQKLHSLIDQPSSSQQLVLAAYPFCASPHPQRLGGLKGAITTSHCWHRAPQKNDEPPKFCKEIFSFCSRPHQEFSHGHPCLNTRD

SEQ ID NO: 59347 - DNA, 718 bp, Zea mays
  misc_feature: Ceres CLONE 1515518
aaagctggagctccccgcggtggcggccgctctagaactagtggatcccccgggctgcaggaattcgtctcacccctagaaaaaatgccacttacctgcagtcaccactcccaagccagtacccacagtcctacgagcagtcgcacgcaagtgtcaagagacaaaacggtcgacatggctcgcacgcaatctgccgtagcggtcgccgtgatggacgcgttgctgctgctggcagcggacgacgacgacctcggaggcccccatcacctgcgggaaggtgatgtccgccatcgcgccctgcctctcctagacccgcgagcacggggtccggaccctccgcgtcctgctgtagcgccataaggaacctcaagagcgcctccgggaaccgcggccgaaaggcgcgcccccttgcaactgcctcaagaacgccccccggggcttcccgctgtctcaacgcccggtaacgccccccggcaaccccttcaaaggcgggcctcagcagccccttacacccttcaggaccctcactccacctgctccagggtttaacttaaaaacccaatagcacagggacaacaaacagtccgccccgaatcgaaacgcaccaaaccatttttcgcccgggccaccgcccacgccccggataaatcaaatcgggcgcgtccatgggatggaaactcttgttaaaatccacacacctgtggattgatacccacag

SEQ ID NO: 59348 - DNA, 773 bp, Zea mays
  misc_feature: Ceres CLONE 1515525
  misc_feature: Encodes the peptide sequence at SEQ ID NO. 59349
  misc_feature (1)..(1): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (51)..(51): n is a, c, t, g, unknown, or other
nccgtttctgttattttcttgtggtcgcttaacatgtttgtnnnnnngttngtggcaaagtggagctccccgcggtggcggccgctctagaactagtggatcccccgggctgcaggaattcgtctcacccctagaaaaagattcatttagcgctgatggaagtgtttcaccaaagaagccatcgtcgatacctgaggtggctaagcagcgagagcttagtggcaccctggaagatgctgatgctaaaatcaataggcagctttctgaagccaagaccaaggagcttagtgggagtgacatctttggtccgcctcctgagattccaacgcggccattggctgctcgtaacctggaactacaaggaaatggcgattgttcgcttccataggggattggccgcgcgtcagttagaggtatctaatcctgccggagggccgagaaacccttttttcatagaacagtctgtgttgtggaacaccttcatgaaaaatcttcgagcagaaggttcccagcacctgaacgggttaccaacatcctttcccagggacggacaccccctttccccccggcctaaaaaggtccctagaaccttttccgcaatatttcaagcgagattggacgatttgcagggtgagtattctttattccccaatggcgaaagccccggctctcccccagagaaagattctttgtgtcgggtcgtccgggaaagggccctccctgggatgtgccgtagaagaccagtcctaccggcgggtttaactccgcgagac

SEQ ID NO: 59349 - protein, 128 aa, Zea mays
  misc_feature: Ceres CLONE 1515525
  misc_feature (14)..(14): Xaa is any aa, unknown, or other
  misc_feature (15)..(15): Xaa is any aa, unknown, or other
  misc_feature (16)..(16): Xaa is any aa, unknown, or other
  misc_feature (17)..(17): Xaa is any aa, unknown, or other
PFLLFSCGRLTCLXXXXWQSGAPRGGGRSRTSGSPGLQEFVSPLEKDSFSADGSVSPKKPSSIPEVAKQRELSGTLEDADAKINRQLSEAKTKELSGSDIFGPPPEIPTRPLAARNLELQGNGDCSLP

SEQ ID NO: 59350 - DNA, 722 bp, Zea mays
  misc_feature: Ceres CLONE 1515526
aaagctggagctccccgcggtggcggccgctctagaactagtggatcccccgggctgcaggaattcgtctcacccctagaaaaaagcccagcccagcccatgtacattccgcagaccctataaacttgcaggttgtagccgcgtctctgaccatcgtcgaggaaccaaagctagagacaaccgctgcgtaaacgaatccatcgtcatggcgtctcgtctcgttgcggcggcggcctcctcctcctccctctcctcagcgtcccccctcgctcgcctaatctctcgccgcggccttgccggtgccgcagacggccatgggtctgccgaggtgcccttgtggaaagatccgttgaacccgagcaagtgcaaggaaaagcactttgttctagaaagcctcccaatgtggggggttattttttaatgggggtcacaaccttttttgtcggacacaaggaaacccagcacttgaggccggcatcaccccccgccaatcgtgggacttaaaccgcaggtcctcccccatttccccggggtcctggccaacccagtggtaaaaaaaaaaggaagggccttctttggacggcgccttctcaacgcttggaataatattgtgggctccccccaacaaatttttgtctttcccctgaagtcacacattattttctgccaacctcttcccctttcccccccccccaccagtcaaaacaagtgttctcccttcc

SEQ ID NO: 59351 - DNA, 655 bp, Zea mays
  misc_feature: Ceres CLONE 1515528
  misc_feature: Encodes the peptide sequence at SEQ ID NO. 59352
aaagctggagctccccgcggtggcggccgctctagaactagtggatcccccgggctgcaggaattcgtctcacccctagaaaaatctcacggctagctagcacaagcatagtgcaggggcttgccacctaaataaggcccgcctgagagccatgggatccaaggccgtcctcttcttggctctcaacctcctgttcatcacggcggtcaacgactgcggcaactgcccgaccccaacgccccctgtcgagccaccgccgccgcctcctgctgctaccccacccccttcgtccagcggaaagtgcccgctgaacgcgctcaagttcagcgtgtgcgccaatatgctcggcctcgtcaaatgcaaggatagcaaggtgcctgccgagccatgctgtaccctcatcaaaagccttgcggacttcaaggccgccgtctgcctctgcacggccatcaaggccaacgtgctcacagtcatcatcgatgaccccatcaagctcagcgccctcgacaactactgtggcaagtgcgtgctcaagacctacttatgcgcgcaatcagcttccggcagtcacacgctcgcagatgataccgtacgacattacttatgctcgccccctgcaatgtacgaatgcctgcatggtgtcggctgaaatatc

SEQ ID NO: 59352 - protein, 165 aa, Zea mays
  misc_feature: Ceres CLONE 1515528
  misc_feature (51)..(132): Pfam Name: Tryp_alpha_amyl Pfam Description: Protease inhibitor/seed storage/LTP family
MGSKAVLFLALNLLFITAVNDCGNCPTPTPPVEPPPPPPAATPPPSSSGKCPLNALKFSVCANMLGLVKCKDSKVPAEPCCTLIKSLADFKAAVCLCTAIKANVLTVIIDDPIKLSALDNYCGKCVLKTYLCAQSASGSHTLADDTVRHYLCSPPAMYECLHGVG

SEQ ID NO: 59353 - DNA, 889 bp, Zea mays
  misc_feature: Ceres CLONE 1515530
  misc_feature (38)..(38): n is a, c, t, g, unknown, or other
  misc_feature (39)..(39): n is a, c, t, g, unknown, or other
  misc_feature (582)..(582): n is a, c, t, g, unknown, or other
ccctttctcatagtccacccctccccctttttgttggnngggcgcaaaaaaaccataactcagattaccgcgggggcggccgctctataactattggatcccccgggctgcaggaattcgtctcacccctagaaaagagtttcctcctccactccctcccccccgcctccactaccccactcccaggcgccgcacaggtacgtcgccggcggcgatgacgacgcgcttcacgaagaaccgcaagaagcgcggccacgtgtccgccgggcacggccgcatcggtaagccccggaagcatcccggagggtgtggcaacgccggcgggatgcacctccaccccatcccccgtcgccaaggaccatccccggcccccttcggtaagggccggcatgccccttactttcatatggttaccccattttttccccccccccccccccgggggggggggggggtccccttttccccacaccggtttccccttctcaataatgtgcggccgtacagacgcggaccgcgaataaccatgatctgtacggccgcctaccgtcttgtcccactttatccccatgttctctctcnttgggcaacgcacttgaccacaggacgcgaggtgttcacacctcttccgcaatgcccccgctttccccccccctgttggtcttccccctcctttatattccctgcacccaccctttttcgcaccacccgtgctacctccgatcctttcacaggactacgggtacacccttgtttatttttcccaccccccttacttcttccgtccggttccattatctgtggactcactacctacgctcccggacgagctagaccagtgattgtagagatattagctcactctcacaccccaggttatctacggtcg

SEQ ID NO: 59354 - DNA, 669 bp, Zea mays
  misc_feature: Ceres CLONE 1515532
  misc_feature: Encodes the peptide sequence at SEQ ID NO. 59355
  misc_feature (502)..(502): n is a, c, t, g, unknown, or other
  misc_feature (503)..(503): n is a, c, t, g, unknown, or other
  misc_feature (515)..(515): n is a, c, t, g, unknown, or other
aaagctggagctccccgcggtggcggccgctctagaactagtggatcccccgggctgcaggaattcgtctcacccctagaaaaaaatctccttgcccgttgtgctctctctcttcattcgttcccggcctcaccccgagccagtcgtctcgctagggtttcgccgccgccgccgccatgcctcgccgcagctcaggaaggtctgccccacgcccagctccccgtgctgcttcactgaggaacccgccacagccagcacgccaggctcctcctccagctcctgttcgagatggtggtggctccatgtttggaggaattgggtccaccattgctcaaggtatggcgtttggcacgggtagtgccatggcacacagggctgttgactctgtattaggtccccggaacatccagcatgagactcttgccacagaagctcctgctgctgcccctgctgctccagcgatgaatgctgatgcttgcagcttccattctaagggcttccnnagatgtctgaancactatggcagcgagatcagcaagtgccagttctacctagacatgctgaacgagtgccgccgtgggtggtgtgtctgtctaaactgccttctgaattattcatgaattttcttttcggatgaggggatctcattaaataagacacgttgaactt

SEQ ID NO: 59355 - protein, 105 aa, Zea mays
  misc_feature: Ceres CLONE 1515532
  misc_feature (52)..(93): Pfam Name: CHCH Pfam Description: CHCH domain
  misc_feature (67)..(67): Xaa is any aa, unknown, or other
  misc_feature (71)..(71): Xaa is any aa, unknown, or other
MFGGIGSTIAQGMAFGTGSAMAHRAVDSVLGPRNIQHETLATEAPAAAPAAPAMNADACSFHSKGFXRCLXHYGSEISKCQFYLDMLNECRRGWCVCLNCLLNYS

SEQ ID NO: 59356 - DNA, 864 bp, Zea mays
  misc_feature: Ceres CLONE 1515533
  misc_feature (13)..(13): n is a, c, t, g, unknown, or other
  misc_feature (16)..(16): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
ccctgtctttaanatncccacaacccgtggtacnnnnattttnnnnnttaagctggagctccccgcggtggcggccgctctagaactagtggatcccccgggctgcaggaattcgtctcacccctagaaaacccttctccgccgccacgctatacaggaagagcgcgcggagagcgagagcccgggagaaacagcggccggcggcaaaatggtgcagcggctcacctaccggaagccgccgcagctacgccacagaatctaatcagacccgcgtggtcaaagacccctggtgggaggcttgtgtaccagtacgccaagaagcgcgcgagcggaccgaaatgcccggtccaccgggaaggaaggatccaaggaattccacacctttgaaaacctgcttgagtatcaagaggttccagggtttggggaaagggacccgccgggaattggtgaaacccgtcccattaatggggggggggttccccgacctgggccacccgcccggctttttaagagggcggactcaatccccgtggccctttttttggggccccccgggaacccccgaaaagaatcccttgggaaaaaacagggtttttttgggaaaaaacccccttaacaaatatccccacggggaataacgggtccttccccaaagtaaatttagggcgccgaattattggggccattctcttccccaaaaatgggtttcaaagcttccccttcttaaaattttgtttttccatcgcagcaaagttttttttccggggaggtttctggggaaaaatcccttaaactttttggtcaactataatgccgaaaaaggattttgggttcttaaatttctccagctgataagctccccaa

SEQ ID NO: 59357 - DNA, 639 bp, Zea mays
  misc_feature: Ceres CLONE 1515536
  misc_feature: Encodes the peptide sequence at SEQ ID NO. 59358
  misc_feature (571)..(571): n is a, c, t, g, unknown, or other
  misc_feature (590)..(590): n is a, c, t, g, unknown, or other
  misc_feature (592)..(592): n is a, c, t, g, unknown, or other
  misc_feature (639)..(639): n is a, c, t, g, unknown, or other
ggcggccgctctagaatagtggatcccccgggctgcaggaattcgtctcacccctagaaaaattctacaattcgaggtgatagcttcagtgagttaatgcaccctggcaattctacctgcaaggaagttttccctggtttggatcactggaaatctggtaaaatttctggttggcataatacggaaggcaactctgtccaatggctttgcatagcctgtgttgaccgaaaagggatgatggcggaggttacatcgactcttacagcttgtggaattaccatatggtcttgtgtggcagaagtcaataaaaggaggggaatgggtgtgatgctgttccattttgagggaagctatgacaacgtggtcagtgcgtgttcaagtgttgacatgattcttggtgttcttggttggtctgtggcatgtagctggtgtccattgggtgttcttgagtgctaatcggtaccaagagacgtgtaccacaatagttcaccactgtcttctcaaagatggagttaatttttggagcactaagaacatcgggtgctcaaaatttttgttggtcaaatcatgnttgggtgactggttgaacnantgaaacccctttacttctctgtcaaatcagaaaagtggggggtgatn

SEQ ID NO: 59358 - protein, 119 aa, Zea mays
  misc_feature: Ceres CLONE 1515536
MHPGNSTCKEVFPGLDHWKSGKISGWHNTEGNSVQWLCIACVDRKGMMAEVTSTLTACGITIWSCVAEVNKRRGMGVMLFHFEGSYDNVVSACSSVDMILGVLGWSVACSWCPLGVLEC

SEQ ID NO: 59359 - DNA, 668 bp, Zea mays
  misc_feature: Ceres CLONE 1515537
  misc_feature: Encodes the peptide sequence at SEQ ID NO. 59360
  misc_feature (582)..(582): n is a, c, t, g, unknown, or other
ctccccgcggtggcggccgctctagaactagtggatcccccgggctgcaggaattcgtctcacccctagaaaaaaaccccaccgcagcacagcgccggcaaccgccgccatcgatcgatcgcccggaaactgacctctaccgatgtctggagccggcgaggaggataagaagcccgcggagggcggcgcccacgtcaaccttaaggtcaagggacaggatggcaatgaggtgttctttcgcataaagaggtccacccagctgaagaagctgatgaacgcctattgcgaccgccagtctgtggacatgaatgccattgcattcctgtttgatggccgcaagcttcacggcgagcatacccctgatgagctggagatggaggacggcgacgagatcgacgccatgcttcaccagaccggaggcagcgttcctagcaccacctaatagcagcagctgcggagcctcgttttgctctccgccctgcgtagtactaaacaaaagggaaaaagtctttttaaggaacttgtgatgctctggctccttgtgccattgctgacggaatccttagcctttatttagtgggnatggctttggtactttgttctgtcatcactcgtttatctatccctaatacatgcccgccatgttttgtacttccaaagaaacaaaa

SEQ ID NO: 59360 - protein, 99 aa, Zea mays
  misc_feature: Ceres CLONE 1515537
  misc_feature (21)..(91): Pfam Name: ubiquitin Pfam Description: Ubiquitin family
MSGAGEEDKKPAEGGAHVNLKVKGQDGNEVFFRIKRSTQLKKLMNAYCDRQSVDMNAIAFLFDGRKLHGEHTPDELEMEDGDEIDAMLHQTGGSVPSTT

SEQ ID NO: 59361 - DNA, 968 bp, Zea mays
  misc_feature: Ceres CLONE 1515538-R
ggtactcgagcgtctcgtttttttttttttttttaaggagggatggggtatatatatatagcatcaacattccgtcctgaagaggagaactgattattgttacctgacgaaggttgagcatttctggaggctggattatagacagacaccctgattttacatgaccaatcgcaagaagcgcatgcattgcatatccttaccctgagagggcactagtgatgtagacgaggagggcgccgccgccgaggatcccatttagggtgacggcccagattagaagcccattggttccaacgacgtatacgtcccctgtgggagaccagtcatcctccttgtagattgggctgtatcacgtcgacattcacgccgtacgggtcgacgaactgggacatgagcaccccctggccctttatcaagttggcggctacttcaacagtcatgccacccccaatggcgaagggcgagtcgggtttgatcttcaacgtcgaccagacgacggagacgggaggaggcgaggagagccccagggcccgggggcccctccggagggaaggggggggttctcccccaggcggaatgctagcacggacatccctcccctggccccaaacgtgctaaacccctaagggggattggtttagccctgtatgttgctcgcccttttagacaaataaagaaaggttgtttactatagtttggaaagaggaatcttatatagtgtctgaaagaggaacgttcctgtgtttaagtggggccgctatctctgttcatgctgttactagggtactggagatatcatattattgtaacgcaacgccgcggtcgcgtagtacatcgcagtctatttggagctgccgtcgatattcttatgcgtgtaattgatgtggtgttgcgatctcttgtcgtacgagtgtgtgtgaggagcgtatgaatgctgatgcattgccttcgtaagctactctgagctg

SEQ ID NO: 59362 - DNA, 646 bp, Zea mays
  misc_feature: Ceres CLONE 1515538
  misc_feature: Encodes the peptide sequence at SEQ ID NO. 59363
ggagctccccgcggtggcggccgctctagaactagtggatcccccgggctgcaggaattcgtctcacccctagaaaaagcctccgatcctctaccagagactcaacgagcgagagcagcacacgctgcgagcagcaagctatgagcagcgacagcggcggcaatggcagtctccatgatctccacgtcagctctggcggcggcgactcatggcctgtggtgcctcgggcggcgctcctcctccctcgccgtcgtctgctcgactaaatgatcgggagcgacaagccctacgggattgtgggtggcctgaccgtcgacgtccagaccgacttgagaaagagaaagggctccgacgtgtaccacgttctcgacaagttctgtgcgtacgtctacggatacggtccggtctacagataggatgagaggtctcccactatcgacgacgacgtcggtggaagcctgagtgttctgatgtgcgccgtctacctcgctaggatcgtcagcggcggcgacatcctcgtctacaagagcagtgacctgtccggctaacggtatccgatgcatgcactgcttgcgattactctgaaacactgacggtgtctagtctataagctaacctccatggttgcactaccgttcgtcatgtg

SEQ ID NO: 59363 - protein, 49 aa, Zea mays
  misc_feature: Ceres CLONE 1515538
MIGSDKPYGIVGGLTVDVQTDLRKRKGSDVYHVLDKFCAYVYGYGPVYR

SEQ ID NO: 59364 - DNA, 623 bp, Zea mays
  misc_feature: Ceres CLONE 1515539
  misc_feature: Encodes the peptide sequence at SEQ ID NO. 59365
ggagctccccgcggtggcggccgctctagaactagtggatcccccgggctgcaggaattcgtctcacccctagaaaaaaacgacctgcagccaaccatctaccagcgactcagcgagcgagagcagcacacactgcacgcagctagctaggagcagcagcagcggcggcgatggcggcctccatgatctcctcgtcagctctggcggtggcgcctcagggcctgccgcccctcggccgccgcgcctcctccttcgccgtcgtctgctccaagaagaagatcaagaccgacaagccctacgggattgggggtggcctgaccgtcgacgtcgacgccaacgggagaaagggcaagggcaagggcgtgtaccagttcgtcgacaagtacggcgcgaacgtcgacggatacagcccaatctacaacgaggatgactggtctccccacggcgacgtctacgtcggtgggaccactgggcttctgatctggggcgtcaccctcgctgggatcctcggcggcgggggcctcctcgtctacacaacagcgccctctcggctaaggaaatccatgcatgcgcctctttggaatcctcctgaaaaatcaggggggccgtcaatatccaacctc

SEQ ID NO: 59365 - protein, 151 aa, Zea mays
  misc_feature: Ceres CLONE 1515539
  misc_feature (32)..(130): Pfam Name: PsbR Pfam Description: Photosystem II 10 kDa polypeptide PsbR
MAASMISSSALAVAPQGLPPLGRRASSFAVVCSKKKIKTDKPYGIGGGLTVDVDANGRKGKGKGVYQFVDKYGANVDGYSPIYNEDDWSPHGDVYVGGTTGLLIWGVTLAGILGGGGLLVYTTAPSRLRKSMHAPLWNPPEKSGGPSISNL

SEQ ID NO: 59366 - DNA, 637 bp, Zea mays
  misc_feature: Ceres CLONE 1515547
  misc_feature: Encodes the peptide sequence at SEQ ID NO. 59367
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
tggcggccgctctagaactagtggatcccccgggctgcaggaattcgtctcacccctagaaaaaatttttgcgagagggaagagcgatgtgcttgccggtattattactggttaaatggcttgctgcaggaaggaagagcgatgaactagccgggtattgttactgccactggagaggcgcgaagttttggagattcagcgtcagccttatcagttaaatgcccccttcgatttgttagtatgtctcccatctgtgatgtcagtcttcctagatatagggtatatcaatcatatattcagttgtaactcgtactttccagtgattggcgataggtccgttttttctttgtaaaagtggccgtgttactgtattatgcattcacagcatatgtatgaggcattcttaagtttgattatatttctctgtaacaatgaagcgaggcacgatgggctctggccctgctgggctgggcctccaatatgaagagccgaggaacaggagggaaagaacagtgatatactccctcattccaaatcnnnnnnnnnnnnnnnnnnnnnnnnnnnnnnnnnnnnnnnnnnnnnnnnnnnnnnnnnnnnnnnnnnnnnnnttnnnnannnnaacgaggacgctcgaggg

SEQ ID NO: 59367 - protein, 37 aa, Zea mays
  misc_feature: Ceres CLONE 1515547
GGRSRTSGSPGLQEFVSPLEKIFARGKSDVLAGIITG

SEQ ID NO: 59368 - DNA, 646 bp, Zea mays
  misc_feature: Ceres CLONE 1515548
  misc_feature: Encodes the peptide sequence at SEQ ID NO. 59369
  misc_feature (475)..(475): n is a, c, t, g, unknown, or other
ggcggccgctctagaactagtggatcccccgggctgcaggaattcgtctcacccctagaaaaactcagtcctccctcacacaccgaaccgagcgcaccatgtcgtcggcggctggaggagtggaggagacggtgcgggcgtcgcacatcctcatcaagcacgagggttcccgccgcaaggcctcctggaaggaccctgacggccgcatcatctccgccaccacgcgcggcgacgccgcagcgcgcctcctggacctccgcaaccagattctctccggccaggccaacttcgccgacctcgccgctcggcactccgactgctcgtccgcgcgacgcggtggggacttaagtacctttgggaggaggcagatgcaaaaacccttcgaggacgccacatatgccctcaaggttggtgagctcagcgacgtcgtggacactgacagtgaggttcacatcatcctgcggactgcctgaangaggggatcacactgtcctctcaggctttcagttagtgctcatggcggttttgttagaaacctgtatttgaatttcctgctgggagcctgagtttccattccgtgcaagattaattcatgtggtgacgacaccgtttgcaacagcatttatgctttaactgcatttaaggg

SEQ ID NO: 59369 - protein, 124 aa, Zea mays
  misc_feature: Ceres CLONE 1515548
  misc_feature (16)..(124): Pfam Name: Rotamase Pfam Description: PPIC-type PPIASE domain
  misc_feature: SWISSPROT Homolog: EC 5.2.1.8 Peptidylprolyl isomerase
MSSAAGGVEETVRASHILIKHEGSRRKASWKDPDGRIISATTRGDAAARLLDLRNQILSGQANFADLAARHSDCSSARRGGDLSTFGRRQMQKPFEDATYALKVGELSDVVDTDSEVHIILRTA

SEQ ID NO: 59370 - DNA, 639 bp, Zea mays
  misc_feature: Ceres CLONE 1515549
  misc_feature: Encodes the peptide sequence at SEQ ID NO. 59371
  misc_feature (468)..(468): n is a, c, t, g, unknown, or other
  misc_feature (591)..(591): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (600)..(600): n is a, c, t, g, unknown, or other
  misc_feature (601)..(601): n is a, c, t, g, unknown, or other
  misc_feature (607)..(607): n is a, c, t, g, unknown, or other
  misc_feature (609)..(609): n is a, c, t, g, unknown, or other
  misc_feature (619)..(619): n is a, c, t, g, unknown, or other
  misc_feature (621)..(621): n is a, c, t, g, unknown, or other
  misc_feature (636)..(636): n is a, c, t, g, unknown, or other
gctctagaactagtggatcccccgggctgcaggaattcgtctcacccctagaaaaagttcggatctttcccccacccggttgtataaaagcgggcgcctgggattcccctctcatccctccttcaccatcagcaaatcggtctgccctggtttcccccgtcgtgaagcagaaacctctctgctgccattaccgtgctgcgcgccgtcgcggtgaggcttggccacaaccgtggaactgtctccatatggcgtaggcggcgtaccgagcttcgcctgatggatttgcagtccagtgggcccataatttctcgccggaccgcgagcagcaacaacctctcctcgccggccatgacctctacgcactccaagctctcctccgaggaccgtcatcttcgtgcatgtagtcgaggagaagagcaggtggttcaggaggagccgcctaacactgaggagttcgatctgatctangtggcgtttcccagtcgacattggcgccgacgatccttagttcgttttatgtttattcttttattttgtaagaagtcttccgctatgtaataagtactctgatgttttatgacatttatctcntnnnnnnanngaaaananggaatttcancngaggacaaaattccnaag

SEQ ID NO: 59371 - protein, 93 aa, Zea mays
  misc_feature: Ceres CLONE 1515549
  misc_feature (64)..(64): Xaa is any aa, unknown, or other
MDLQSSGPIISRRTASSNNLSSPAMTSTHSKLSSEDRHLRACSRGEEQVVQEEPPNTEEFDLIXVAFPSRHWRRRSLVRFMFILLFCKKSSAM

SEQ ID NO: 59372 - DNA, 672 bp, Zea mays
  misc_feature: Ceres CLONE 1515551
  misc_feature: Encodes the peptide sequence at SEQ ID NO. 59373
  misc_feature (495)..(495): n is a, c, t, g, unknown, or other
  misc_feature (552)..(552): n is a, c, t, g, unknown, or other
  misc_feature (579)..(579): n is a, c, t, g, unknown, or other
  misc_feature (592)..(592): n is a, c, t, g, unknown, or other
  misc_feature (596)..(596): n is a, c, t, g, unknown, or other
tggagctccccgcggtggcggccgctctagaactagtggatcccccgggctgcaggaattcgtctcacccctagaaaaagcgcaaacatcgaatcgtctcactcgtgtctgccctgctcatactgcttgccctcgccgtatcgtccacccgcaacgcacaggaggattccatggccaacaacaccgggacgttggtgggcggcatccaggacgtgccggggagcgagaacgaccttcacctccaggagctcgcccgcttcgccgtcgatgagcacaacaagaaggccaatgctcttctggggttcgagaagcttgtgaaggccaagacacaagtggttgctggcacgatgtactatctcactattgaagtgaaggatggcgaagtcaagaagctctacgaagctaaggtatgggagaagccatgggagaagttcaaggagctgcaggaattcaaacctggttgaagagggtgctagcgccctaaggatgtctccnttctcccatgtgcgagcctgaagctcaaagcaaaagtgcagaataaggagccatgcntcccttgtggtattttcataaaatacnaccctataaggcntggnttgggttgggcccggatcccagggaaattggagggggattaaatttccttctatctaaaaaaaagggggttttact

SEQ ID NO: 59373 - protein, 97 aa, Zea mays
  misc_feature: Ceres CLONE 1515551
  misc_feature (10)..(98): Pfam Name: Cystatin Pfam Description: Cystatin domain
MANNTGTLVGGIQDVPGSENDLHLQELARFAVDEHNKKANALLGFEKLVKAKTQVVAGTMYYLTIEVKDGEVKKLYEAKVWEKPWEKFKELQEFKPG

SEQ ID NO: 59374 - DNA, 664 bp, Zea mays
  misc_feature: Ceres CLONE 1515554
  misc_feature: Translation starting site: 205
acccgcggtggcggccgctctagaactagtggatcccccgggctgcaggaattcgtctcacccctagaaaaagatacctattggtttactgcaacaaggaaggccacattagttgctagtgctaccaagaacaggaaggaaacaccgccgccgccgcgccttccattccagtactcgcggaggaaaggaacaccagccagcgccatggtcacgtcgacgaccgccgccgccgtgctgtccccgccgtccgtggccgggcttcgcctggcgccgtctccccgggcgcgcgtggagttccgcgcggcgcggtcccgacgatccgtgtcggcacgcgcgtatctgaccccgtcactggtgatcagcttgagcacgggggtgtcgctctttcctgagccgcttcgtcttcgtcaacttccggcggcagaacgtgactaaacaggtgcccgagcaaaacggtaagaccctgttcaacgacgccaactagcgcgccaatggatttctcggggctgatcaaatccattaacccggagggcttcaacatcgtcaaatttctgcctctggggttccgctcggccacattcgccgcctaataaatcctcccccacttcaaggaaaggaatacaacccccaacttctttctgagcgggccgggttggcgggcttg

SEQ ID NO: 59375 - DNA, 626 bp, Zea mays
  misc_feature: Ceres CLONE 1515562
  misc_feature: Encodes the peptide sequence at SEQ ID NO. 59376
tggcggccgctctagaactagtggatcccccgggctgcaggaattcgtctcacccctagaaaaaaatttttctccagccgccgcgctcctgatccttatctctgcgcgcgctgcatcggcgcccgccgggaggcggatcccgcccgcctcgtccatgttgtgggtccgcaatatccgccgcttcgtcgacacgggcgccggcctcggatccgaggccatcatggaactggagactaaaaggatattgcttgagattttcaaggagcggcagcggaagagtgccgaggctggttccatcccaagtttttacaagaaacctgaagaaggatccattagctctagagttcaaaggttggccaagtacaggtttctaaagaaacaatcaaagcttctgctgaatgctgatgatcttgatgccatgtgggtttgtctcagagaaaattgtgttattgatgatgctactggtgctgaaaagatgaattatgaagatttctgccatatcccccccgtctgcactgagtaaatttggtcaaaaatgcaaacaattttttcagcccttcaaacttcctgaaagcctgcacggaagcccttggaacagattggttggctaaattacaaaattatct

SEQ ID NO: 59376 - protein, 173 aa, Zea mays
  misc_feature: Ceres CLONE 1515562
GGRSRTSGSPGLQEFVSPLEKNFSPAAALLILISARAASAPAGRRIPPASSMLWVRNIRRFVDTGAGLGSEAIMELETKRILLEIFKERQRKSAEAGSIPSFYKKPEEGSISSRVQRLAKYRFLKKQSKLLLNADDLDAMWVCLRENCVIDDATGAEKMNYEDFCHIPPVCTE

SEQ ID NO: 59377 - DNA, 668 bp, Zea mays
  misc_feature: Ceres CLONE 1515563
  misc_feature (272)..(272): n is a, c, t, g, unknown, or other
  misc_feature (317)..(317): n is a, c, t, g, unknown, or other
  misc_feature (355)..(355): n is a, c, t, g, unknown, or other
  misc_feature (361)..(361): n is a, c, t, g, unknown, or other
  misc_feature (545)..(545): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (566)..(566): n is a, c, t, g, unknown, or other
  misc_feature (567)..(567): n is a, c, t, g, unknown, or other
  misc_feature (598)..(598): n is a, c, t, g, unknown, or other
  misc_feature (600)..(600): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (609)..(609): n is a, c, t, g, unknown, or other
  misc_feature (613)..(613): n is a, c, t, g, unknown, or other
  misc_feature (644)..(644): n is a, c, t, g, unknown, or other
ggcggccgctctagaactagtggatcccccgggctgcaggaattcgtctcacccctagaaaaagcgcgtcgcagcgcctgccactcgattagtggagtcgaccaaccaagcacgcgtccctccccggcccagataccatcccgcggcagccggtcagtccgatccatctccagtacccagcccgtcacccgccttccccggtcgctctcgtcggcgcgcgatggagggtctcatcaaggggttgggccacgtggccttcgactccgggatgnacgccgtgagggatagggaccacggccgcgccgacgtacagcaangtgtgtagcgaagagggcggcccaccgctccgatcagnatgacnagcacgggagggagagactgcgacgactcggatttgggggggggatacctggcctttcgggggggcccctgggagggggatccagaggcccttcccgggaagaccttacaaaaaagtgccccggggccaaaaagtatactgggggaaaaagaaaaagggttttcccctgggggaaaaaagcgtntttttttttttnnnnnnnggnngggagggggggagggagggagagagaagggngngggnnnngngggntgttcccctccccgttgggggggcggtggtnggtggggggggggggagaaaggag

SEQ ID NO: 59378 - DNA, 646 bp, Zea mays
  misc_feature: Ceres CLONE 1515566
  misc_feature (561)..(561): n is a, c, t, g, unknown, or other
  misc_feature (562)..(562): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (577)..(577): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (584)..(584): n is a, c, t, g, unknown, or other
  misc_feature (585)..(585): n is a, c, t, g, unknown, or other
  misc_feature (589)..(589): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (646)..(646): n is a, c, t, g, unknown, or other
ggcggccgctctagaactagtggatcccccgggctgcaggaattcgtctcacccctagaaaaaatcatctaggatttcttcataccgaattatcgattgacttcgaccacataccgtgcttttgttcatgtctttgaacacaggcacacccaaatttcgaggtagcaaattttgcccacatacactgtatataaagtagttacagtgcaagaacaatgctaactgatcaggtgatgtctcgtcctccccccggttctattattgttactgtatagctgtaattagtccaagtgtacagctgaatctactaaggtttacaaggaaaatcgccaggcagtaaaccttcaatgcttttggctaggttttcattctgaaagtcatgtcttccgcgtcagcataatcctgtattcctgtataacctctgttcggacttcgtagtgctcatctgagttctgattcggccgggcaactgtaaattctgtagtgttcgagaaaaaactgtaaattctgtaatattgccaagaattatgaatttacatgaactttacaggtataaagtannaaannnnnnnnnaanannnncnnctgnaaaaaaaaaagaaaaaaaaaannnnccggggcgctcggagtacccaattcgccctan

SEQ ID NO: 59379 - DNA, 634 bp, Zea mays
  misc_feature: Ceres CLONE 1515567
  misc_feature: SWISSPROT Homolog: EC 2.3.1.50 Serine C-palmitoyltransferase
  misc_feature (406)..(406): n is a, c, t, g, unknown, or other
  misc_feature (510)..(510): n is a, c, t, g, unknown, or other
  misc_feature (511)..(511): n is a, c, t, g, unknown, or other
  misc_feature (513)..(513): n is a, c, t, g, unknown, or other
tccccgcggtggcggccgctctagaactagtggatcccccgggctgcaggaattcgtctcacccctagaaaaactgttaactatctcgaggaaaatccctcagttcttgcaaacctaaggagcaatattgctcttttgcataaagaactatcagatactccagggcttgaaatttccagccatgttctgtcacctatcgtcttccttaagctgaagaagtcgactggttctcctaccactgatctagaccttcttgaaactattgctgacaaggccttgaaggaagactcagttttcgttgtgacatcaaagaaatcaaatctggataggtgcaaacttcccattggaatccgcctgtttgtatcagctggccatactgaattagacatctccaggctttcctcantccttgaagagggtttctgcatcggttctttcagattacttttgatccacatcggattcccttaagccgaaagccatccattttctacgcgctttgtactctanngnccgtgtgtgttttggtaaatgtacataacctgtacatttctacatgttatgaatttgactttgttgcaaaataaaattttggtagaatgggtatactcccctcgttctttttaaatttgtt

SEQ ID NO: 59380 - DNA, 676 bp, Zea mays
  misc_feature: Ceres CLONE 1515569
  misc_feature: Encodes the peptide sequence at SEQ ID NO. 59381
  misc_feature (572)..(572): n is a, c, t, g, unknown, or other
  misc_feature (582)..(582): n is a, c, t, g, unknown, or other
  misc_feature (589)..(589): n is a, c, t, g, unknown, or other
ctccccgcggtggcggccgctctagaactagtggatcccccgggctgcaggaattcgtctcacccctagaaaaagcgcaaacatcgaatcgtctcactcgtgtctgccctgctcatactgcttgccctcgccgtatcgtccacccgcaacgcacaggaggattccatggccaacaacaccgggacgttggtgggcggcatccaggacgtgccggggagcgagaacgaccttcacctccaggagctcgcccgcttcgccgtcgatgagcacaacaagaaggccaatgctcttctggggttcgagaagcttgtgaaggccaagacacaagtggttgctggcacgatgtactatctcactattgaagtgaaggatggcgaagtcaagaagctctacgaagctaaggtctgggagaagccatgggagaacctcaaggggctgcaggaattcaagcctggttgaagagggtgctagcgcctaaggatgtctccttctccatgtgcgagcctgaagctcaaagcaaagttgcagaataaggagccatggctccctttgtgtaatttcataagactacnaccctattanggctttntttggggtgtgtctgtatcgaaggggaattgaaggggattaatttttccttctattcaaaaaaaaaggggtttttaatctccttcca

SEQ ID NO: 59381 - protein, 97 aa, Zea mays; identical to SEQ ID NO: 58276
  misc_feature: Ceres CLONE 1515569
  misc_feature (10)..(98): Pfam Name: Cystatin Pfam Description: Cystatin domain

SEQ ID NO: 59382 - DNA, 638 bp, Zea mays
  misc_feature: Ceres CLONE 1515573
  misc_feature: Translation starting site: 127
tggcggccgctctagaactagtggatcccccgggctgcaggaattcgtctcacccctagaaaaagactgctctaccggactgactagcgactaagtgcgcacaaagagaagagcctcggagctgagatggctgaatccgtggtgtccatgataggcctctcgcacgttgtcctgcccagtgtgctcgccgacagcagaaccatgacgggcgtcgtcgtcgtcaaggagtccgcggacggtgacgtggttgtgcaggctgttcttctcgccgtgatcgggcttgtggccactggcatcatcggtcggcgccttgtcgaaagcgttgcgtgccgagaccagtcaagactcttcggattggagccccggcgccgccctccagtggactccccggtactctgaactctgaccgatcgagggacttctacctccccttgaaggattggttctacctgcaatcgctgccgccggcggatgcggcggctacgttaaagacgtcggcgcatgacatcatcaagctcaagccgctcatcgactagaatgcgtgaccgtacatccagaacgatctccggctccaggactcctactgcgctacgaccctcagagcgtcatcaggttcatgcccaatgtagcagagtagg

SEQ ID NO: 59383 - DNA, 652 bp, Zea mays
  misc_feature: Ceres CLONE 1515577
  misc_feature: Encodes the peptide sequence at SEQ ID NO. 59384
  misc_feature (379)..(379): n is a, c, t, g, unknown, or other
cgcggtggcggccgctctagaactagtggatcccccgggctgcaggaattcgtctcacccctagaaaaactgcccgatctgacatccgctgtttcgccgccgtgtgcgccgccgcatctatcggaggtccctccgccgcagcaggaggcgagatgcctctccgaaaagagattgatctgctcgtcccgcatgcggatcgctaaagcttcacgccgactaccgtgacactcgtgcgttcaccgggatcgttcttcatggatgttacgtgccatgggtgcttcctgatagccgctgtttacttacgctgcccgatggtagcagcgtgccctggctgccaaactgacctctgtcgactcacaggacgtcaggcacgaccagntgatgggtgctctctccgtgcgagtgcacactataccggacgtggtcttcacgtctgctctatgccagaaccagccggatgaacgtgctttactaaaatgttgcatagatcgttctccaacccccaggtgtgggatgttgcctaactcccagcttctaaacgggtttgggttgtatttgcattaagataacgggcaccttagagttaatttctaggaaggccaacaaaatttccggccgattaagaaatttccaagccaatgcttttctaagt

SEQ ID NO: 59384 - protein, 68 aa, Zea mays
  misc_feature: Ceres CLONE 1515577
  misc_feature (42)..(42): Xaa is any aa, unknown, or other
MDVTCHGCFLIAAVYLRCPMVAACPGCQTDLCRLTGRQARPXDGCSLRASAHYTGRGLHVCSMPEPAG

SEQ ID NO: 59385 - DNA, 627 bp, Zea mays
  misc_feature: Ceres CLONE 1515579
  misc_feature: Translation starting site: 334
  misc_feature (498)..(498): n is a, c, t, g, unknown, or other
gctctattactagtggatcccccgggctgcaggaattcgtctcacccctagaaaaagtgctttcttacatgtgggttggcttctcctccacctccggttcgggttcgggttcgtgaggctctccggggttcggtttcgtgggtgagcggatctagatggaggcgtcggatgtttaataccggtgcttcttcggcggcctcccctggggcacagacgaccactccctccacaacggcttcagcacctaaggcgaggtcctcgagtccaacataatcctcgatcgggagactcagaggtcccgcggcttcggcttcgtcaccttctccacggattatgcgaccccccagcgggggggggggggggaactgcaagaagctggacagccgccccatcaccgtcaacaaaggccactcccgcggcggtcgtggaggctgcgccgaggggaactgtgatggccgtggaagccacggctacggctttggacggcacccagatttngtgggccgcaaccgtatttgcggcggcggaaaccccagccctgccactttcttggtgttggccctggcaattgaggggccaccggtccgccgccaaattacctccaacaggacttgaaaaacttacggc

SEQ ID NO: 59386 - DNA, 639 bp, Zea mays
  misc_feature: Ceres CLONE 1515712
  misc_feature: Encodes the peptide sequence at SEQ ID NO. 59387
ggagctccccgcggtggcggccgctctagaactagtggatcccccgggctgcaggaattcgtctcacccctagaaaaaaaaccctaacactcatcacgccgccactgatctgctctgttgctggtgactaggagcagtagcgagagggattctggatggccaagtcgaagaaccacacggcgcataaccagtcgttcaaggcgcacaagaacggcatcaagaagcccaagcgccaccgccagacctccaccaaggggatggacccgaagtttctgaggaacttgaggtactcaaggaagggcaacaagaagagtggcgaggctgagtccgaggagtaagatgatggtgattgagtttgtggcgacaaatgcatctcttgtatcgctaagagtcttagctgtgaacttagttctcacttctgtgtgactgtgatcaaaggacttgtgtatgatcaaaggagatccatcagttggtaccgaagtgtattttatgtcttgttggttacctggaatttaattaacaccatcacttgtatccttttgagaattgggcaaaaacgaaaaggacaaataaaaaaaaaacgagacgctcgaggtacccaattcgcgttatagtgagtcgtattacgcgcgctcactg

SEQ ID NO: 59387 - protein, 60 aa, Zea mays; identical to SEQ ID NO: 1569
  misc_feature: Ceres CLONE 1515712
  misc_feature (3)..(42): Pfam Name: Ribosomal_L29e Pfam Description: Ribosomal L29e protein family

SEQ ID NO: 59388 - DNA, 582 bp, Zea mays
  misc_feature: Ceres CLONE 1515716
  misc_feature: Encodes the peptide sequence at SEQ ID NO. 59389
  misc_feature (428)..(428): n is a, c, t, g, unknown, or other
  misc_feature (534)..(534): n is a, c, t, g, unknown, or other
ggagtccccgcggtggcggccgctctagactagtggatcccccgggctgcaggaattcgtctcacccctagaaaaacttccaccacgcagtcactcccgggtcgccgccgccgccgccgccgccgccgcgaaaaaccctagcaggcttcgccgctatcactcctaggggcgcgaccatggtggccacaaagaagacgaagaaatccacgggacaacatcaacaaacaagctgcaactttggtattgaaagaaaggggaaaagtaacattcttggggttaaaaaaaacccgccccctagggagatcccccgggggaaactcttttattccaaaaaaccctttgggggatccccccccccaaaaaaaaaaaaggggcgcccccccccccctctcccctaaaaaaggcggcgaaaaaaaaaaatggggggngtttttttttttttttttttttttcttttgtcgcggggaggggggaatctattttttttctccccccccccaccctccctctttttttttggggggggaggagaanaaaaaaaagggggggggggttgcccctcccctcctctgaggagaggag

SEQ ID NO: 59389 - protein, 73 aa, Zea mays
  misc_feature: Ceres CLONE 1515716
MVATKKTKKSTGQHQQTSCNFGIERKGKSNILGVKKNPPPREIPRGKLFYSKKPFGGSPPPKKKKGRPPPPLP

SEQ ID NO: 59390 - DNA, 676 bp, Zea mays
  misc_feature: Ceres CLONE 1515721
  misc_feature: Encodes the peptide sequence at SEQ ID NO. 59391
ggagctcaccgcggtggcggccgctctagaactagtggatcccccgggctgcaggaattcgtctcacccctagaaaaaaacctcgaatgccaagctagcaagagaggcctcgatcgcagaacgaacccagcggcaaagcgagcaagcccgtctacaacgacgcacagatagctctgtccatggcgcccaagaggagcagcgaggagcgcgcggcggcggagcaggagcaggagcagccgaggctccgcggcgtgcggaagcggccgtggggcaggtacgcggcggagatccgggaccccgtgcggaaggcgcgcgtgtggctcggcaccttcgacacgcacgagcaggccgcgcgggcctacgacgcccgccgcgcgcaggctccgcgggccacgcgccacccccaactacccgggtgatgtggtccgagaagcgccgtgcaccgcccccggctctggcatgcaagggcgagcggcagacaccaattcgtcggcgtcgacgtcctcaagggaatacgggccacccccacacccccgctgccaaaggggccagtcgtggataggaccggggccctcggtatcttacccgaaaaacggtgggacaatcagaatgggtgctgctcctttgaaccctgcgccccggataaacaagggaagaaaaaggaaggcagcgaccc

SEQ ID NO: 59391 - protein, 79 aa, Zea mays
  misc_feature: Ceres CLONE 1515721
  misc_feature (20)..(71): Pfam Name: AP2 Pfam Description: AP2 domain
MAPKRSSEERAAAEQEQEQPRLRGVRKRPWGRYAAEIRDPVRKARVWLGTFDTHEQAARAYDARRAQAPRATRHPQLPG

SEQ ID NO: 59392 - DNA, 875 bp, Zea mays
  misc_feature: Ceres CLONE 1515724
  misc_feature (1)..(1): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (34)..(34): n is a, c, t, g, unknown, or other
  misc_feature (38)..(38): n is a, c, t, g, unknown, or other
  misc_feature (45)..(45): n is a, c, t, g, unknown, or other
ntttttttttnnnttttnnntttattaatttatnttcncttgccnccgccctcataactggagttccccgcggtggcggccgctctagaactagtggatcccccgggctgcaggaattcgtctcacccctagaaaaacttccaccacgcagtcactcccgggtcgccgccgccgccgccgccgccgccgcgaaaaaccctagctggcttcgccgctatcactcctaggggcgcgaccatggtggccacaaagaagacgaaaaaatccacggacaaaatcaacaacgagctggtagttgatatgaatagtgggaagtacactctctgttactagatacgtcctcagggatctcacggaactctaagtccgaagcctcgcgatcttccctggtttacttggcccccccccttcggaaaggctggagaattgaaggatactatgtctaaggattgggcaataggtccacttgtaccacccaactattcaatgtgaaaacccagggtgcctttgccattgggaaatatttgtccctgaggggtgaaaaaaaaactttttctggaggttcgtggctctgtctcttccgataacatttatgtttgaattccattgggatgtccgctaagggagtttttgtgagcacagaaacgtgcgccgcggcgggggggctgctccggtagtaagggatgcgcccccctggcccctccccgcgggggtatctcaaactcgggcaattctttctcacccatccgggtgaaaagataaatataaggccgttgttgcgcttgggtctttgtggttcttggggggctgcctcggggatttgtttcttcctttcgcacttatatatgtttttatccgacacaggaggctagaac

SEQ ID NO: 59393 - DNA, 661 bp, Zea mays
  misc_feature: Ceres CLONE 1515732
  misc_feature: Encodes the peptide sequence at SEQ ID NO. 59394
tggagctccccgcggtggcggccgctctagaactagtggatcccccgggctgcaggaattcgtctcacccctagaaaaaatctccaaattaagtcgccgagctctgaagaatctagctaggagcaggccgcctacgccatcggccgtccacagcaacatgtgctccggatcctggttctggagcaacagcggaagcggaaaggagcacccgtctcttgtcgacgtcaacctcgagcggcagctaaagaagacgctggccgtcaggagaacgacgatgttgaggctgacgacgatgcgagacagacgatcagaggccatggatatggtgaacctgaagctgtatctggagaaacggtgcatcatcgcatagaacgagaggctccgggagagggccagcgcgctccgccgcgagaacctcgcgctgctccagaacctgtcgtccaggacggcggccgtgccagaaccaggagcgggagctgcgtgaggttgctgcttcaatcctctgcctgcctgcctgctgaacatgaagtatcgagctcgcgtcaccctcgtcggtggtgcttgtgctacttgtgtggacaggacacaggccagtgaactcgtagccctacgacgccatctgcttggctgcaccgccatgactgtgtggctctgtgctcaa

SEQ ID NO: 59394 - protein, 70 aa, Zea mays
  misc_feature: Ceres CLONE 1515732
MCSGSWFWSNSGSGKEHPSLVDVNLERQLKKTLAVRRTTMLRLTTMRDRRSEAMDMVNLKLYLEKRCIIA

SEQ ID NO: 59395 - DNA, 823 bp, Zea mays
  misc_feature: Ceres CLONE 1515734
  misc_feature: Encodes the peptide sequence at SEQ ID NO. 59396
  misc_feature (13)..(13): n is a, c, t, g, unknown, or other
  misc_feature (14)..(14): n is a, c, t, g, unknown, or other
  misc_feature (16)..(16): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
gtgtatttttttnntntttttaggggtaaaannnggnnnnnnnnngggtaannnnngcaagctggagctccaccgcggtggcggccgctctagaactagtggatcccccgggctgcaggaattcgtctcacccctagaaaaaagacataagacagcccgtcagcccctctcgtttttcatccgccttcgcctccaaccgcgtgcgctccacgcctcctccaggaaagcgagagcttctgcataagaacaacaaatcaaaagcaggatcagctcggtgccaacaaaacctcaacaaccaagtttcatgtctgatctcgacgtccagcttccatctgcctttgatccgtttgctgaggcagatggtgaggactctggtggtggtcctggaacgaacgattatcgtgcatgtgggcatgcaggagcgcagcgggggagggagtgtggacgcaggccacgggcctgaagtaaggagttgcggctagagaggacgttcccgcgatggagtctgaaggaaaggagattcggggtgccgagtggagatggttgcgtgcaagggagcggtgaagcggggggcgcggggggtgtgcggctgccaagggtgggtccgggggggaggggatgggcgcgtgcgtttccgggaggcggccgggcccgggggttcggcgcgaacgaagagggggcgcctccaggtttgtcgcccggtggtggcccgcgtggtgagcgcgccgcagcgtggccgcggtgcccccccgaacagacggcgctcggtcgcgcgcgcgcgttctgtgccgtgcagggtgtgggagcgcgattcggcgggagg

SEQ ID NO: 59396 - protein, 52 aa, Zea mays
  misc_feature: Ceres CLONE 1515734
MSDLDVQLPSAFDPFAEADGEDSGGGPGTNDYRACGHAGAQRGRECGRRPRA

SEQ ID NO: 59397 - DNA, 690 bp, Zea mays
  misc_feature: Ceres CLONE 1515735
gctcttacctaccgctatcccccgggctgcaggaatttctctcacccctagaaaaaaccagccgcccggaacccgcaaagctgcttcccggactagctagggtttcgtctacgccgcttgatctagtcctctctcccggcacgcgagggcgcacccttgatggccgcggcaccggctgacgctaaggctgaggccgcccacatggaactcctccaggacgatgactattccaagagttcgaaatcctcacgactgggatgatccgcaataaggcgacgcagacgtcccgccatgtcaggttcatcgcgctccccatgacggcacctattttttcttcctacccctgcatgaacggccgggaggtaccctaggcttaaaaaatctgagaaaccactctctctccttgaccgtgactgcctcgtccctcgccgttgccttttgtggctagccctggaggctgccgcttacaggactcgtgtcgaacatcctgcattatggcggaaaacctcctgccccagcttagccggctggtagcgatgcgggctaggaccggtctgcggttctcaggtacgtccctctaacgggcgcttgcgtccacgcctgtatattgaacaaaaaacagccatccccacttatccttgtggagcctcaaccttaccccccctgggggcgcgtgtacgcctctccccg

SEQ ID NO: 59398 - DNA, 639 bp, Zea mays
  misc_feature: Ceres CLONE 1515749
  misc_feature: Encodes the peptide sequence at SEQ ID NO. 59399
  misc_feature (361)..(361): n is a, c, t, g, unknown, or other
  misc_feature (421)..(421): n is a, c, t, g, unknown, or other
  misc_feature (473)..(473): n is a, c, t, g, unknown, or other
atagctggagctccccgcggtggcggccgctctagaactagtggatcccccgggctgcaggaattcgtctcacccctagaaaaaaaaaataccgaccttgcattttctcaataccttgagcacctaagcaagtccaatgtctcatgcccagccccttcgtttacaggcccagtggaaacacgtcgatattcaggataaccaagccaatgctatgaaggaaccaggaaccagtggtgggtatggctccccaatgaaagatgacaagaacaaggatgtggatacaataacttctaacctcatcaagcttaagcacagggctttgggcactccagaaaaacacaaccatgtgccaaccctccancttaaaagtagttgctagttcaataagtcaatactatataccttatgcttgtctctatantagccataaggtcctagttcaaataacagatgctgcttgcagccttggatantttgtggagtgaacacattgttgatagcatatggataagaaagtaatgtaattatctggagatgtgtaattatgtggcaatattatttgcaacaatgatgcatggagtactttcatgtatgatactgaggctttgcaattgatttgcttctatttggaaaaaaaaa

SEQ ID NO: 59399 - protein, 80 aa, Zea mays
  misc_feature: Ceres CLONE 1515749
  misc_feature (75)..(75): Xaa is any aa, unknown, or other
MSHAQPLRLQAQWKHVDIQDNQANAMKEPGTSGGYGSPMKDDKNKDVDTITSNLIKLKHRALGTPEKHNHVPTLXLKSSC

SEQ ID NO: 59400 - DNA, 673 bp, Zea mays
  misc_feature: Ceres CLONE 1515755
  misc_feature: Encodes the peptide sequence at SEQ ID NO. 59401
aagctggagctccccgcggtggcggccgctctataatagtggatcccccgggctgcaggaattcgtctcacccctagaaaaagcgcaaacatcgaatcgtctcactcgtgtctgccctgctcatactgcttgccctcgccgtatcgtccacccgcaacgcacaggaggattccatggccaacaacaccgggacgttggtgggcggcatccaggacgtgccggggagcgagaacgaccttcacctccaggagctcgcccgcttcgccgtcgatgagcacaacaagaaggccaatgctcttctggggttcgagaagcttgtgaaggccaagacacaagtggttgctggcacgatgtactatctcactattgaagtgaaggatggcgaagtcaagaagctctacgaagctaaggtatgggagaagccatgggagaagttcaaggagctgcaggaattcaaacctgttgaagagggtgctagcgcctaaggatgtctccttctccatgtgcgagcctgaagctcaaagcaaagttgcagaataaggagccatgctcccttgtgtaatttcataagactaccacccctataagggcttgtattggtgtggtctgtatccaaaaggaattggaaggtgaattaatttttccttccaatttcaaatagaaggggttttaa

SEQ ID NO: 59401 - protein, 103 aa, Zea mays
  misc_feature: Ceres CLONE 1515755
  misc_feature (10)..(98): Pfam Name: Cystatin Pfam Description: Cystatin domain
MANNTGTLVGGIQDVPGSENDLHLQELARFAVDEHNKKANALLGFEKLVKAKTQVVAGTMYYLTIEVKDGEVKKLYEAKVWEKPWEKFKELQEFKPVEEGASA

SEQ ID NO: 59402 - DNA, 672 bp, Zea mays
  misc_feature: Ceres CLONE 1515756
  misc_feature: Translation starting site: 152
  misc_feature (336)..(336): n is a, c, t, g, unknown, or other
  misc_feature (344)..(344): n is a, c, t, g, unknown, or other
  misc_feature (345)..(345): n is a, c, t, g, unknown, or other
  misc_feature (346)..(346): n is a, c, t, g, unknown, or other
  misc_feature (370)..(370): n is a, c, t, g, unknown, or other
  misc_feature (371)..(371): n is a, c, t, g, unknown, or other
  misc_feature (372)..(372): n is a, c, t, g, unknown, or other
  misc_feature (373)..(373): n is a, c, t, g, unknown, or other
  misc_feature (374)..(374): n is a, c, t, g, unknown, or other
  misc_feature (381)..(381): n is a, c, t, g, unknown, or other
  misc_feature (382)..(382): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (419)..(419): n is a, c, t, g, unknown, or other
  misc_feature (426)..(426): n is a, c, t, g, unknown, or other
  misc_feature (434)..(434): n is a, c, t, g, unknown, or other
  misc_feature (435)..(435): n is a, c, t, g, unknown, or other
  misc_feature (436)..(436): n is a, c, t, g, unknown, or other
  misc_feature (444)..(444): n is a, c, t, g, unknown, or other
  misc_feature (445)..(445): n is a, c, t, g, unknown, or other
  misc_feature (448)..(448): n is a, c, t, g, unknown, or other
  misc_feature (449)..(449): n is a, c, t, g, unknown, or other
  misc_feature (450)..(450): n is a, c, t, g, unknown, or other
  misc_feature (466)..(466): n is a, c, t, g, unknown, or other
  misc_feature (467)..(467): n is a, c, t, g, unknown, or other
  misc_feature (468)..(468): n is a, c, t, g, unknown, or other
  misc_feature (495)..(495): n is a, c, t, g, unknown, or other
  misc_feature (512)..(512): n is a, c, t, g, unknown, or other
  misc_feature (543)..(543): n is a, c, t, g, unknown, or other
  misc_feature (544)..(544): n is a, c, t, g, unknown, or other
  misc_feature (551)..(551): n is a, c, t, g, unknown, or other
  misc_feature (602)..(602): n is a, c, t, g, unknown, or other
  misc_feature (613)..(613): n is a, c, t, g, unknown, or other
  misc_feature (645)..(645): n is a, c, t, g, unknown, or other
  misc_feature (659)..(659): n is a, c, t, g, unknown, or other
  misc_feature (660)..(660): n is a, c, t, g, unknown, or other
  misc_feature (664)..(664): n is a, c, t, g, unknown, or other
atagctggagctccccgcggtggcggccgctctagaactagtggatcccccgggctgcaggaattcgtctcacccctagaaaaagaccggaccgactagcgacaaaccgcgcacgaagagaagaacctcgccagctgatatggcgcaagccatggcgtcgatgacaggcctctcgcagggcgtcctgcccaacaggcgcgccgacagccgaacccggacggccgacgacgtacgacgggcgtcagcggagggcgacgccgttgtacagggaggccgccgagccgtggtggggcttgtggccactggtttcttccgcggctccttgccacaagaagngcgccccnnnggccgtcgagcccctcaagattgnnnnnccgcccnncctcctccggtggattcggggggaatggnnnnccccncctaccnaagcactnnnacaacccnnttnnnggaaaggttctacccnnnctccaccacacccgaacgtgaggaggngtaaaaggcaaatggcntccggatgcagaccccgttcccaccacgggnnggctacntcaaaatacaaatccctgggacccctcccttcagaaaggaatgatcaacangcaaagaacangcttatgttccccatcaataactctccaagancatgcgattcgctnntccnaaccccca

SEQ ID NO: 59403 - DNA, 685 bp, Zea mays
  misc_feature: Ceres CLONE 1515759
  misc_feature: Encodes the peptide sequence at SEQ ID NO. 59404
  misc_feature (685)..(685): n is a, c, t, g, unknown, or other
tgagctcaccgcggtggcggccgctctagaactagtggatcccccgggctgcaggaattcgtctcacccctagaaaaaatctccaaattaagtcgccgagctctgaagaatctagctaggagcaggccgcctacgccatcggccgtccacagcaacatgtgctccggctcctggttctggagcagcagcggcagcggcaaggagcacccgtctcttgtcgacgacaacctcgagcggcagctaaagaacacgctggccgtcacgagaaggaggaggatgaggctgaggaggttgcaagacagaggagcagaggccatggagatggtgaacctgaagctgtatctggagaaccggtgcatcatcgcagagaacgagaggatccgggagagggtcagcgcgctccaccacgagaacctcgcgctgctccagaacctgtcaaccaagaaagcggccgtgccaaaaccaaaaacgggagctgctcgaggttgcaacttcgaacctatgccagcctgcctgctgaacatgaagtatcaaaagctcctgtcaaccctcgttcattgggggcctgtgcttccttgggcggaacagggaaacgggccccgctaaactccctatcccctatagagaaatatcttggtttgggttgacccccccctcgtatctgtattgtcctccttgttacctn

SEQ ID NO: 59404 - protein, 149 aa, Zea mays
  misc_feature: Ceres CLONE 1515759
MCSGSWFWSSSGSGKEHPSLVDDNLERQLKNTLAVTRRRRMRLRRLQDRGAEAMEMVNLKLYLENRCIIAENERIRERVSALHHENLALLQNLSTKKAAVPKPKTGAARGCNFEPMPACLLNMKYQKLLSTLVHWGPVLPWAEQGNGPR

SEQ ID NO: 59405 - DNA, 644 bp, Zea mays
  misc_feature: Ceres CLONE 1515760
  misc_feature: Encodes the peptide sequence at SEQ ID NO. 59406
tccccgcggtggcggccgctctagaactagtggatcccccgggctgcaggaattcgtctcacccctagaaaaaagcagcgagcgaacagggaaaaaggagaggccgagaagcgctttagcgataagactggtgcacccgtagcggcacggcatggcggccacggcgtactccgtggcgctcctcggcggcgcacgcctgccggccgccctcctccctcggcgcagcagcgtgtgccaccagcagcttcgcctccaagacgcgccgaggctctccctgcaccgtgccagggccgcttccgaggacacgtcggcctccggcggcgacgagctcatcgaagacctcaaggcaaagtgggacgccgttgaggacaagcccaccgtcctcctgtacggcggcggcgccgtcgtggcgctatggttgacgtccgttgttgtcggcgccatcaacgccgtgccgctgctccccaagatcctggagctcgtcggcctcggctacaccggctggttcgtgtaccgctacctcctcttcaagcaaagcaggaaagagctggtcgacgacattgagaccctcaagaaaaagattgctggaacggcggaataagcgctagctctcgtggaaagctttagaaccaacgacgagaggg

SEQ ID NO: 59406 - protein, 149 aa, Zea mays
  misc_feature: Ceres CLONE 1515760
  misc_feature: SWISSPROT Homolog: EC 6.1.1.9 Valine--tRNA ligase
MAATAYSVALLGGARLPAALLPRRSSVCHQQLRLQDAPRLSLHRARAASEDTSASGGDELIEDLKAKWDAVEDKPTVLLYGGGAVVALWLTSVVVGAINAVPLLPKILELVGLGYTGWFVYRYLLFKQSRKELVDDIETLKKKIAGTAE

SEQ ID NO: 59407 - DNA, 778 bp, Zea mays
  misc_feature: Ceres CLONE 1515761
  misc_feature: Encodes the peptide sequence at SEQ ID NO. 59408
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
ccccgcggtggcggccgctctagaactagtggatcccccgggctgcaggaattcgtctcacccctagaaaaaaaagacgccgtcgccgctcttgttgtttccgatcccaaaccccaaacacgctccaccggcacctccgctcccacaccacaccgatggcccgcacgaagcagacggcgcgcaagtccaccggaggcaaggcgccgcggaagcagctggcgaccaaggcagcgcgccaagtcggccccggcaaccggcggcgtgaagaagccgcaccgcttccgcccggtcaccgtggcgctccgcgagatccgcaagtaccagaagaagcagggagctgctcattccggaagatcccccttccagcgcccagggcgcggggagaaatcgcccctaggaatttcaagaaccggagtgtccggtgttatgggttggtgtggggccccccaccccgccccctctcaaggaatggcccgctgtgaagggccctaaaccgagccgtatcaggctacccttttgcgagggggaaaatactaaaacctttttatggtgccaaatccccccctactcccacaggtaccgttcccctgcactacggggggtttcctccgcgggagagacatnnnntattactaacccttgccgggcgaaactagagtccgcctaccagtgccactagggagcgcctttgcgccagcgcggcgtgcgcgccgcgcccgcccggtagaaccctacacacgtgaacgatatctggccatccataatagataagagacgg

SEQ ID NO: 59408 - protein, 108 aa, Zea mays
  misc_feature: Ceres CLONE 1515761
MARTKQTARKSTGGKAPRKQLATKAARQVGPGNRRREEAAPLPPGHRGAPRDPQVPEEAGSCSFRKIPLPAPRARGEIAPRNFKNRSVRCYGLVWGPPPRPLSRNGPL

SEQ ID NO: 59409 - DNA, 654 bp, Zea mays
  misc_feature: Ceres CLONE 1515771
  misc_feature: Encodes the peptide sequence at SEQ ID NO. 59410
aaagctggagctccccgcggtggcggccgctctagaactagtggatcccccgggctgcaggaattcgtctcacccctagaaaaaagtctgcagcttcccgcaccgcatcctgcggaagaagtttctaacgggctacatcccaccaccgtacgatgtccgcagcggcgcgagtgctgccgaaggcggtaaccttcgggacgggccacgccaagaagctggaggaggtccgcgccctcctcaggtcttccgtcccattccagtcactcaatctcgacctgcctgaactgcaaggggagccacagtacgtatcctaagagaaagcacgaatcggtgcatctcacgagaatgggcctgtactggcggaagacacctgcctatgttttcatgcgctcatacgcctaccaggaccctacataaagcggcttcttgataagattgggcatgaaggtttcaatgatctgataaaagcttctgaagataaatcagcggttgcaatgtgcatcttctctcttgatcttggacctggagaggaaccaatcacacttgttggcaaaactgcgggatagatcatgcctgctagaggccctaattattttggctgggatcctgtctaccagccagatggttctgaacaaacatatgctgagatgccca

SEQ ID NO: 59410 - protein, 53 aa, Zea mays
  misc_feature: Ceres CLONE 1515771
  misc_feature: SWISSPROT Homolog: EC 3.6.1.19 Nucleoside-triphosphate diphosphatase
MSAAARVLPKAVTFGTGHAKKLEEVRALLRSSVPFQSLNLDLPELQGEPQYVS

SEQ ID NO: 59411 - DNA, 643 bp, Zea mays
  misc_feature: Ceres CLONE 1515773
  misc_feature: Encodes the peptide sequence at SEQ ID NO. 59412
atagctggagctccccgcggtggcggccgctctagaactagtggatcccccgggctgcaggaattcgtctcacccctagaaaaaagggtttttggtgccgttctaccgcggcccatggcagaggaggccaatcgagcggccctgatggagctgcactcgcggtacgatggattccaccgcgaagatggagctgttacggaccctcctgggttccaaagaacgggaaatgaagcgtgcctaccttactttggaggaacttctccagctgccagatgatacccacacctacagaccactgtccgaaaagtgttctctctgtcacccaaagtccattctgtgcagtgcagcaagagcaaaaacttgactgacactcagagtgccgatagcttcaatgccaacatccaaagactaccttgagaaacagcagggcgcaatgctggataacaatattgagggagctgcttctactcgacccaatgacttgcgcgtgagatcctctcaatgaccgttctctgagagttgtggatccctccatttaattatgtatatgaacttgaaatgtcaacagtttgagcagtcccgctgtagacttaccctatctgcgagacatgtgcagactgtaatttcagaagtacttgcccgg

SEQ ID NO: 59412 - protein, 65 aa, Zea mays
  misc_feature: Ceres CLONE 1515773
MDSTAKMELLRTLLGSKEREMKRAYLTLEELLQLPDDTHTYRPLSEKCSLCHPKSILCSAARAKT

SEQ ID NO: 59413 - DNA, 663 bp, Zea mays
  misc_feature: Ceres CLONE 1515777
  misc_feature: Encodes the peptide sequence at SEQ ID NO. 59414
ccccgcggtggcggccgctctagaactagtggatcccccgggctgcaggaattcgtctcacccctagaaaaagtgctctctcagaggtgggctggcttctcctccccctcttaccaagtcctcttcgggttagggttacttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagtactccatgctcgacgctatcgagaacatgaacggcaaggagctcgacggccgtaacatcaccgttaaccaggcccagtcccgtggcggtggcggtggcggcggtggctaccgcggcggtcgcggcggcggcggctatggtggcgggcgccgtgacggcggttatggcggcggggggcggctaccgccgtccgcccaagggtgggtggccggctgctcctgaaggcgggtggccggctactgcggatcggcgccgagggttggtcgttggccgccttatagtctgcagccggccggccggtttggaaagcgaattgtattgtcgtg

SEQ ID NO: 59414 - protein, 132 aa, Zea mays
  misc_feature: Ceres CLONE 1515777
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAAADVEYRCFVGGLAWATSNESLENAFASYGEILDSKVITDRETGRSRGFGFVTFSSEYSMLDAIENMNGKELDGRNITVNQAQSRGGGGGGGGYRGGRGGGGYGGGRRDGGYGGGGRLPPSAQGWVAGCS

SEQ ID NO: 59415 - DNA, 872 bp, Zea mays
  misc_feature: Ceres CLONE 1515778
  misc_feature (5)..(5): n is a, c, t, g, unknown, or other
  misc_feature (6)..(6): n is a, c, t, g, unknown, or other
  misc_feature (20)..(20): n is a, c, t, g, unknown, or other
  misc_feature (21)..(21): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
ttttnnttttttttctttcnntgtgccnnnccnnnnggggggannnnaaaaagctgggactccccgcggtggcggccgctctagaatagtggatcccccgggctgcaggaattcgtctcacccctagaaaaaaggggccctcggatccaagaagagggaagagcacctaggaccttcggcgcccgttcacgagccatatcttcgcgagcgagttcttgggtgacctcctcctcttcggaccacctccaacgctcttggtgtagcttgccactctccccactcaggtttccgtgtctgatctcgacgttcgcatctccactggctacgatcccttccttgacgcccatgccggggactcctggggcggcctataggtccagagggcttcccttacacgagccccattatttacgctcttattggtaccgcaggaaagccggacgggcgggcccccccgacatttctaacaaagggcggttctagtctgcggcctatagattgtgatcgaaagaaatgctttccgcaaccaaataccactccgccctgctcgctgcgcaccccacgatggtcctctacggccaaccccttctcccgttttctgcggtgggggccccgattccccattccccccccgcatcgatctcttatggacacaatacgggcccgcgcaaatgtggctactttacgtcccacatatcttttcccccttttcggacccccctgtgcttccccgctcccccgataccccaccgggtttgtctttgctcataaaccttgttatgccgaagcaccctgccccttgccgtaccattttgtgcaactcccctgggtacccccaattcgtcgctcaccctcactaacctgcgtcccgg

SEQ ID NO: 59416 - DNA, 656 bp, Zea mays
  misc_feature: Ceres CLONE 1515779
  misc_feature: Translation starting site: 186
atagctggagctccccgcggtggcggccgctctagaactagtggatcccccgggctgcaggaattcgtctcacccctagaaaaactaaaccctacccgactccgccgccgctcccgctccgccccagcgcatcgcccgccgccacagcgtaccgcgacctcatctatcaccttcagctttcaatcatggcggacgtcgatgtcgaaccggaggttgccgccggagctcccaagaagaggacgttccgcaagtacagctaccgcggcgtcgacctagatgcgcttctcgacatgtccactgacgacctcgtccagctcttccccgcgcgcgccaggagaaggttccagaggggtctgaagaggaagcccatggcgctcatcaagaaactgcgcaaggcgaaaaaggatgctcccccccggtgagaagcctgagccagtcaagacacatctccgtaacatgatcattgtccccgagatgattggaagcattgttggggtctacaacggcaagaccttcaaccaggcgtgaaatcaagccctgaaatggatcggccccctaccctggctggagattcccactctccctacaagagcaggttaaatcaccggctaggccccgggtattcaggggccccccccactctccatccccgggtt

SEQ ID NO: 59417 - DNA, 647 bp, Zea mays
  misc_feature: Ceres CLONE 1515781
  misc_feature: Translation starting site: 203
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
  misc_feature (444)..(444): n is a, c, t, g, unknown, or other
  misc_feature (445)..(445): n is a, c, t, g, unknown, or other
  misc_feature (446)..(446): n is a, c, t, g, unknown, or other
  misc_feature (447)..(447): n is a, c, t, g, unknown, or other
  misc_feature (448)..(448): n is a, c, t, g, unknown, or other
  misc_feature (449)..(449): n is a, c, t, g, unknown, or other
  misc_feature (450)..(450): n is a, c, t, g, unknown, or other
  misc_feature (451)..(451): n is a, c, t, g, unknown, or other
  misc_feature (452)..(452): n is a, c, t, g, unknown, or other
  misc_feature (453)..(453): n is a, c, t, g, unknown, or other
  misc_feature (454)..(454): n is a, c, t, g, unknown, or other
  misc_feature (455)..(455): n is a, c, t, g, unknown, or other
  misc_feature (456)..(456): n is a, c, t, g, unknown, or other
  misc_feature (457)..(457): n is a, c, t, g, unknown, or other
  misc_feature (458)..(458): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (462)..(462): n is a, c, t, g, unknown, or other
  misc_feature (463)..(463): n is a, c, t, g, unknown, or other
  misc_feature (464)..(464): n is a, c, t, g, unknown, or other
  misc_feature (465)..(465): n is a, c, t, g, unknown, or other
  misc_feature (466)..(466): n is a, c, t, g, unknown, or other
  misc_feature (467)..(467): n is a, c, t, g, unknown, or other
  misc_feature (468)..(468): n is a, c, t, g, unknown, or other
  misc_feature (469)..(469): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (474)..(474): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (527)..(527): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
ggcggccgctctagaactagtggatcccccgggctgcaggaattcgtctcacccctagaaaaaggtgactcacactcacaccgaaagcgcctcaactctgaaggcgctacagccacgtcgccacttcactcacgattggagtctcacctcggcagccagccagtggttcctcggctcggaggaacagcaagagcttctgaagatgaaggcgatccccgtggctctcctgctcctcgtcctggttgctgccgcctcctcgttcaagcatctcgccgaggcagcagacggcggcgcggtgccggacggcgtgtgcgacggcaagtgccgcagccggtgctcgctgaagaaggccgggcggtgcatgggcctgtgcatgatgtgctgcggcaagtgccagggcccccatnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnntnnnnngnggnnnnnnnnnnnnnnnnnnnnnnnnnnnnnnnnnnnnnnntnnnnnnnnnnnnnnnnnnnnnnnnnnnngnnnnnnnnnnnnnnnnnnnnnnnnnnnntnnnnnnngtgtttggttgtt

SEQ ID NO: 59418 - DNA, 687 bp, Zea mays
  misc_feature: Ceres CLONE 1515790
  misc_feature: Encodes the peptide sequence at SEQ ID NO. 59419
  misc_feature (601)..(601): n is a, c, t, g, unknown, or other
aagctggagctccccgcggtggcggccgctctagaactagtggatcccccgggctgcaggaattcgtctcacccctagaaaaaatcatccagtgctctctcctcttgcgattcgctcgctcgatcctagcttcccttccaagaagcgcagcgcccatggccatggccacgcaagcctccgccgccacgcgccacctgctggccgccgcctgggcgccggcggcgaagccgcggcagctgagctcgcagctcgcgctgccgtcgtcgtcctcccgcgggccggccccgctccgcgcgtccaccgaggaggcggtggaggcgcccaaggggttcgtggccccgcagctggaccccagcacgccgtccccgatcttcggcggcaggacgggcgggctgctccgcaaggcgcacgtggaggagttctacgtcatcacgtggacgtccccaaggagcaggtgttcgagaatgccaccggcggcgccccccctcatgggggaagggccccaaccttcttgaagctgggcccgcaaggaaccagtgccctggcgcctcggcacccaaggtggcccccccccaagacccaaaaacccccccaccccagnttttcgccgggggcctttccccccaaaggggaaaagggggccaaacaccctcccaccccccaatggaacaggggcgttacaaaccc

SEQ ID NO: 59419 - protein, 119 aa, Zea mays
  misc_feature: Ceres CLONE 1515790
MAMATQASAATRHLLAAAWAPAAKPRQLSSQLALPSSSSRGPAPLRASTEEAVEAPKGFVAPQLDPSTPSPIFGGRTGGLLRKAHVEEFYVITWTSPRSRCSRMPPAAPPLMGEGPQPS

SEQ ID NO: 59420 - DNA, 625 bp, Zea mays
  misc_feature: Ceres CLONE 1515804
  misc_feature: Encodes the peptide sequence at SEQ ID NO. 59421
tagctggagctccccgcggtggcggccgctctagaactagtggatcccccgggctgcaggaattcgtctcacccctagaaaaaactaaccacccgaccaattcccctagcttcagctgcgcgcttctcttttctctcctatacgttctaggttcgttgctgttcgagcggggtaagcttagccagcctctagcaagagcaagagcaagggcaaagggcatggcggcggctgtctccttctcccgggtgcgagctctcccgacgtggtccagctcggtttccggcgacgaccaccacgcctactccgtgttggcgacgtcgtcggtgtcagccagacctcggtctggcgcgcgaccgctgcggtcgccggcgcagatgatgggcaacgtgaacgatggcaaggggctgttcgcaccgctcgtcgtggtggcgcgcaacatcattggccgcaaacgcttcaaccagctgagggggaaagcaatcgcgctgcactcgcaggtcatcaacgagttctgcaagaccatcggcgccgactctaagcagcggcagggcctcatccgcctcgccaagaagaacggagagaagctcggattccttgcctgatctgatgatcgacgcccacgatg

SEQ ID NO: 59421 - protein, 127 aa, Zea mays
  misc_feature: Ceres CLONE 1515804
MAAAVSFSRVRALPTWSSSVSGDDHHAYSVLATSSVSARPRSGARPLRSPAQMMGNVNDGKGLFAPLVVVARNIIGRKRFNQLRGKAIALHSQVINEFCKTIGADSKQRQGLIRLAKKNGEKLGFLA

SEQ ID NO: 59422 - DNA, 658 bp, Zea mays
  misc_feature: Ceres CLONE 1515806
  misc_feature: Encodes the peptide sequence at SEQ ID NO. 59423
  misc_feature (606)..(606): n is a, c, t, g, unknown, or other
tggagctccccgcggtggcggccgctctagaactagtggatcccccgggctgcaggaattcgtctcacccctagaaaaaaaaccaatcagatagagagagcatagtcgatcatgaagggtggcaagaaggaagtggccggtgcgatggtggccatactgctggttctgcagctcatggcagctccaccgacggccatggccgcccgctcgccgcacggagccgtgccggatggctccctcgccacgacgcccaaggtgacgatgctgtcggccacgctgtgctacacgggggagacatgcaaatacattggctgcctcactcctgcttgctcctgcaactatagtgatcgtctatgctacatcatatttactcctgttgcttgaggccattccgcgaagccacaactcttacaatatgcatgcgccggccgacgacgacgcgcgctgcctctcgtgagcttctgttcaagtgatgcatgtttcaaggcatccatggatgctttacgtatatgcgtattaattagccgtgtcagggaaccggacagaagggggtgttgttttatatttacgtcttctggtgatcaaataaaggggaaatatatgttnggatgtgtgtaaaaaaaaaaaaaaaaacgagacgctcgaggtacccaattcg

SEQ ID NO: 59423 - protein, 90 aa, Zea mays; identical to SEQ ID NO: 58696
  misc_feature: Ceres CLONE 1515806

SEQ ID NO: 59424 - DNA, 669 bp, Zea mays
  misc_feature: Ceres CLONE 1515809
  misc_feature: Encodes the peptide sequence at SEQ ID NO. 59425
  misc_feature (667)..(667): n is a, c, t, g, unknown, or other
ctggagctccccgcggtggcggccgctctagaactagtggatcccccgggctgcaggaattcgtctcacccctagaaaaagcaggccgtcatcccacgcattcacatccttccccgctctcgctctctcagccgcagagccactcgtgtcggtgacggcggcgaaggcaatgtcatccctccgcccgtccctcctgctcgtggtgtcgctgctcgcggcggctctgcttgcagcggcgccgtcctccgcgtctcgcgacctccgcccgctccaggcgagcttcctcgtgcgcggccgcgtctggtgcgacaactgccgtgcgagcttcgagactcccgcatccacctacattgcaggagctaaggtgagagtcgactgctaatcaaagaccaccggggcaaatacatgcagcttcgaggggcatactgaccgcaccggcacctacaacatccttgtcattgatcagcgtgagcatgagctctgcgagtccgtccttgtgagcagcccggacaaggggtgtgccaatgttgtggctggtcgtgagagggcccccgtcttccttaccagcaacaacggtgttgcatccaacgttcgtttggcatatgctctggggttccagaaagacgttgcccttcctagatgcgcgcagatcctcaagacgtaccanga

SEQ ID NO: 59425 - protein, 70 aa, Zea mays
  misc_feature: Ceres CLONE 1515809
MSSLRPSLLLVVSLLAAALLAAAPSSASRDLRPLQASFLVRGRVWCDNCRASFETPASTYIAGAKVRVDC

SEQ ID NO: 59426 - DNA, 628 bp, Zea mays
  misc_feature: Ceres CLONE 1515820
  misc_feature: Encodes the peptide sequence at SEQ ID NO. 59427
ctggagctccccgcggtggcggccgctctagaactagtggatcccccgggctgcaggaattcgtctcacccctagaaaaaacaactgatgacaagccatcgccccgatggacaccgccgcctcatgacggctcctctcgccgggctcctcatctccgcccccctgtccgaagcagctacccaaacggcgaccgaccttcgcggcctcgcatcaacagtcgcccagctccagcgccaagttcaggctcctctgcctcctccatgacaagtccacgccccctacaacctcagtgcagatgcagatctcacagtcacactagcagatgccggccacagtgttgcagtagcggagccgtctggacagctgctgaggcgccggcggcgctggcggtgaccagcaaggacgacatcgacctggtacggatcctgccgccgctcacggtgttcgacttcttctacttcctcgtcgctcctcccgtgatcatgaactgcatgatggtgaggcgccacaagcacgaattcgaggagactgacctgcagttcatgttcacctacctcttctacccagatatgatgttctaggcgccattcttcaacttcatgtaattccctaaggatcccaccttgca

SEQ ID NO: 59427 - protein, 106 aa, Zea mays
  misc_feature: Ceres CLONE 1515820
MTSPRPLQPQCRCRSHSHTSRCRPQCCSSGAVWTAAEAPAALAVTSKDDIDLVRILPPLTVFDFFYFLVAPPVIMNCMMVRRHKHEFEETDLQFMFTYLFYPDMMF

SEQ ID NO: 59428 - DNA, 659 bp, Zea mays
  misc_feature: Ceres CLONE 1515823
  misc_feature: Encodes the peptide sequence at SEQ ID NO. 59429
tggagctccccgcggtggcggccgctctagaactagtggatcccccgggctgcaggaattcgtctcacccctagaaaaagtgctctctcagaggtgggctggcttctcctccccctcttaccaagtcctcctcgggttagggttccttagggttttgtggaggggcgatggcggcggctgatgtggagtaccgttgcttcgtcggagggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccacgcccagtcccgtggcggtggcggtggcggcggaggctacggcggcggtcgcggctgcggcggctatggtggcgagcgctctgacggcggttatggcggcggtggcggctactgcggtcggcgcgagggtggtggctgcagctactgaagcagtggccgctacggcggtcggcacgagggtgagaggtcgcggctaccgctgcggcggaggcggctggaaggactgatgtgtgggccccatccg

SEQ ID NO: 59429 - protein, 131 aa, Zea mays
  misc_feature: Ceres CLONE 1515823
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAAADVEYRCFVGGLAWATSNESLENAFASYGEILDSKVITDRETGRSRGFGFVTFSSENSMLDAIENMNGKELDGRNITVNHAQSRGGGGGGGGYGGGRGCGGYGGERSDGGYGGGGGYCGRREGGGCSY

SEQ ID NO: 59430 - DNA, 638 bp, Zea mays
  misc_feature: Ceres CLONE 1515829
  misc_feature: Encodes the peptide sequence at SEQ ID NO. 59431
aaagctggagctccccgcggtggcggccgctctagaactagtggatcccccgggctgcaggaattcgtctcacccctagaaaaagtgctttcttagaggtgggttggcttctcctccccctccggttcgggttcgggttcgtgaggttctccggggttcgggttcgtgggtgagcggatcgagatggcggcgtccgatgttgagtaccgctgcttcgtcggcggcctcgcctgggccacggacgaccactccctccacaacgacttctgcacctacggcgaggtcctcgagtccaagatcatcctcgatcgggagacgcacaggtcccgcggcttccgcttcgtcaccttctccaccgacgaggcgatgcggaacgccatcgacggcatgaacggcaaggagctggacggccgcaacatcaccgtctacgatgcccactccctcggccgacgtggaggcggcctccgtgggtactgtggtggccgtggaggcggcggctacggcggtggcgggcgccgtgatggcggtggcggctacagcggtggcggcggctaccgtggcggcagccgctacggtggtggtggcggcggctactgcggtggcaaccgtggcggctgctacggcaactcccacgggaa

SEQ ID NO: 59431 - protein, 151 aa, Zea mays
  misc_feature: Ceres CLONE 1515829
  misc_feature (10)..(81): Pfam Name: RRM_1 Pfam Description: RNA recognition motif. (a.k.a. RRM, RBD, or RNP domain)
  misc_feature (48)..(150): Pfam Name: GRP Pfam Description: Glycine rich protein family
  misc_feature: SWISSPROT Homolog: EC 5.2.1.8 Peptidylprolyl isomerase
MAASDVEYRCFVGGLAWATDDHSLHNDFCTYGEVLESKIILDRETHRSRGFRFVTFSTDEAMRNAIDGMNGKELDGRNITVYDAHSLGRRGGGLRGYCGGRGGGGYGGGGRRDGGGGYSGGGGYRGGSRYGGGGGGYCGGNRGGCYGNSHG

SEQ ID NO: 59432 - DNA, 656 bp, Zea mays
  misc_feature: Ceres CLONE 1515832
  misc_feature: Encodes the peptide sequence at SEQ ID NO. 59433
aagctggagctccccgcggtggcggccgctctagaactagtggatcccccgggctgcaggaattcgtctcacccctagaaaaaacggcagctctgaagggaaagagatcgatcgtatctgcggaacaagcagcgaaggatcggagcctatccaatggccgagggcaacagcagctccggcggcgacctgttctccagcggcaagctggcggcgggagccgccgtgtctgtgttccatcagaagagcgtggagaacgtcgacaagcaggaggtcgccggcgcggcggccgagctcctgcacgcggcgtccgcgtacggtaagctcgacgacaagccggccgggcaatacgtcgagaaggccgaggggtacttgaaggagttcagcgcgggcgcgggacacgccaccgagcaggagcagcctgcggcggcagcaggcgacgacgcggcgcccaagccaccggcgccggaggcgcccaaggagccggcggcggtgcctgcgccggccgcggaggaaggcagtaagtcgtcagagggcttcggcctcggcgacgtcatgaagggcgccgagcagctggtgggagggaagcagcagggcggcggggaggagagcgccagcagcggtgagttgtttaagatggcccagggcttcctcaagta

SEQ ID NO: 59433 - protein, 167 aa, Zea mays
  misc_feature: Ceres CLONE 1515832
MAEGNSSSGGDLFSSGKLAAGAAVSVFHQKSVENVDKQEVAGAAAELLHAASAYGKLDDKPAGQYVEKAEGYLKEFSAGAGHATEQEQPAAAAGDDAAPKPPAPEAPKEPAAVPAPAAEEGSKSSEGFGLGDVMKGAEQLVGGKQQGGGEESASSGELFKMAQGFLK

SEQ ID NO: 59434 - DNA, 627 bp, Zea mays
  misc_feature: Ceres CLONE 1515833
tccccgcggtggcggccgctctagaactagtggatcccccgggctgcaggaattcgtctcacccctagaaaaaactgactctcattcgcaatttccctacgagctcgagatcacggctcatcgcagctcaagaagccagcaaaggcaaacccccgtcatggcctcctccaagatactgcgcgccgccatcgtcgtcgtggccgtcgacgtgtcctccttcgccggcgccggcctcggctgctaggcccccgcgccgagcccggtctccggtgccgcggccgtctcctcgtcgctcttggacgccgacctctgccaggccgtctcactccttctcagcaacctgcgccgatgatgacggctgcctgcctgtcctacgagagccgccgtgtgctgtcgagcgacgtcattgtcctctatatagtaagtgagatgtaacggaactgtgcgtgacttgtatcggcttccctgggaagtgattgggactccatcgatcgttcggagaattcacatgttggtttccctaacagcattggtttcaaaattccgaaaaggaaaaaaaaaacccgatatgggttcaaaggttccccctttcaacccccaaatgttggagtggaaaataaacccccc

SEQ ID NO: 59435 - DNA, 823 bp, Zea mays
  misc_feature: Ceres CLONE 1515835
  misc_feature: Encodes the peptide sequence at SEQ ID NO. 59436
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
nnnnnnnnnnnnnnnnnnnnnnntttaaatttnnnnnnggtttnnnnnntgggcagtggggctccccgcggtggcggccgctctagaactagtggatcccccgggctgcaggaattcgtctcacccctagaaaaatctaaaccctacccgactccgccgccgctccgccgccgctccgcctcagggcatcgccctccgccacagcgtaccgcgacctcgtcgatcaccttcaactttcaatcatggcggacgtcgatgtccaaccggaggttgccgccggcgctcccgaaaagaggacgttccgcaggtaccgctaccgcggcgtcgacctagatgcgcctcccgagaggggggcgggacggcctcgggccggctcttcccccgcgtcgcgcccatgataccgtctcgcgaatttttttgcccccccaccccgggggggggggggggggggcaaaccttcctccccactcccccacaccccccccctcccctccccggtcacaaacccctctagcccctttccggacagcgcatggttctttataatcggaccgacctgtgccgccctccacgagggagagggcggtgtgggtgccgatgggcgggccgcgggtgtcgccctttgcctccctccccctcccccccccgctcctccgtccccgcgatcgggggggggggacgggctgggggtggcccgagcgccgtgccggcccagccaacggaggtcggcggtaggaggggggtgtcgggctggcggcgcggtgtgttgctctccctgtcaggcgctggggcggtgctcccgggggtcttggaccccagcccg

SEQ ID NO: 59436 - protein, 51 aa, Zea mays
  misc_feature: Ceres CLONE 1515835
MADVDVQPEVAAGAPEKRTFRRYRYRGVDLDAPPERGAGRPRAGSSPASRP

SEQ ID NO: 59437 - DNA, 760 bp, Zea mays
  misc_feature: Ceres CLONE 1515837
  misc_feature: Encodes the peptide sequence at SEQ ID NO. 59438
  misc_feature (11)..(11): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (51)..(51): n is a, c, t, g, unknown, or other
  misc_feature (52)..(52): n is a, c, t, g, unknown, or other
aaagggggagngggnnngnnnaataatataatattgttttttgcgtgtggnnccaaactggagctccaccgcggtggcggccgctctagaactagtggatcccccgggctgcaggaattcgtctcacccctagaaaaacaaccgagacaccgcgtgcgaaccaagcagaccccagcagaagaagcgaagtcgtcgccggagcaggaggaagagcgagcagcaagatgtcgtggccggcgtacgtcgatgaccacctgctgtgcgacatcgaaggccagcacctcagcgccgccgccatcgtcggccacgacggcagcgtctgggcacagtccgagaacttccccgagttaaagcctgaggaggttgctgggatgataaaggactttgatgaacctggaactcttgcaccaactggtctttttgttggaggtacaaagtacatggtgatccaaggtgaacctggagttgtcatccgaggaaagaagggcactggaggcattactatcaagaaaactggcatggccttgattatcggaatctaggatgagccaatggctcccgggcaatgcaatatggagcgagggagaggactcggccactaacctggaccgaacaggggcttcctaggtttgtccaaaaatgccaattgttgggtcacttagggccctctaaggtttagcaccctaactctgggtttcatgtaaatatcgtgcggccttcgtggactggtgccccagcacccaaatggtctcgacaagag

SEQ ID NO: 59438 - protein, 105 aa, Zea mays
  misc_feature: Ceres CLONE 1515837
  misc_feature (2)..(105): Pfam Name: Profilin Pfam Description: Profilin
MSWPAYVDDHLLCDIEGQHLSAAAIVGHDGSVWAQSENFPELKPEEVAGMIKDFDEPGTLAPTGLFVGGTKYMVIQGEPGVVIRGKKGTGGITIKKTGMALIIGI

SEQ ID NO: 59439 - DNA, 656 bp, Zea mays
  misc_feature: Ceres CLONE 1515842
  misc_feature: Encodes the peptide sequence at SEQ ID NO. 59440
ggagctccccgcggtggcggccgctctagaactagtggatcccccgggctgcaggaattcgtctcacccctagaaaaaagactcccgtctgctctagccgtctcgtgcgcttcaccttccccaccccgccgccgccatcgcacgcccgcacgcgcatccgctatgggtgcgtacaagtacgtctcggagctagtggcggaggaagcactccgatgagatgcagttcgtgcagcacgtgcgctgctgggagtacaggcagcagccggacatcgtccgcctcacaaggcccactcaccctgaccaggcgcgccgcctcgactgcgaggtcaagcatggatatgttgtataccgagtccgtgttaggcctggtggtaggaacaggcctgtgcctaatggtattgtctatggcgagccgaagcgccagggtatcactcagcgtcagttccagaggaacaagacgtctgttgctgatgagagggctggacgagagcttgctggactcagggttgtcaactcctactgggtgagagacgatagcagctaacactacttcgagatcattcgtgttgatgtggcgcacactaccatccgcaatgatactatgatgcactggctatgcaatcctgtgcgcaagcacccagcagctcgtgaactcc

SEQ ID NO: 59440 - protein, 108 aa, Zea mays
  misc_feature: Ceres CLONE 1515842
  misc_feature (1)..(108): Pfam Name: Ribosomal_L15e Pfam Description: Ribosomal L15
MQFVQHVRCWEYRQQPDIVRLTRPTHPDQARRLDCEVKHGYVVYRVRVRPGGRNRPVPNGIVYGEPKRQGITQRQFQRNKTSVADERAGRELAGLRVVNSYWVRDDSS

SEQ ID NO: 59441 - DNA, 637 bp, Zea mays
  misc_feature: Ceres CLONE 1515843
  misc_feature: Encodes the peptide sequence at SEQ ID NO. 59442
ccccgcggtggcggccgctctagaactagtggatcccccgggctgcaggaattcgtctcacccctagaaaaagtctttcttctgctcttccatcgcgccagtgttatgagaaggtggtcggcgctcctagatcccttcgcctctctcgcgttcgaggctaggtagccgccaccatgagccgctcggggcagcctccggatctcaagaagtacatggacaagaagcttcagattaagctgaatgcaaaccgtgttgttattggcacacttcggggattcgaccagttcatgaatctggtgatcgacaacactgtggaggtcaatggaaatgacaagacagatattggaatggtggttatcaggggaaacagtgttgtcatgatcgaggcactggagccagttgccaagtcgcagtgaatccttatttttcagctgatatagtcgcagcatgaaaactgatgtaaatgctatgagtgaaccctgttgtacttcggactcgtgcttttgcacagcaacataactcggctaccagcacccctgtttctaaagcaatcacccctgccactgtaaataaacgagcatgatggggctgctgctattgtaaacctgtgtatatacctcagactcataggcgctgg

SEQ ID NO: 59442 - protein, 80 aa, Zea mays; identical to SEQ ID NO: 53165
  misc_feature: Ceres CLONE 1515843
  misc_feature (8)..(72): Pfam Name: LSM Pfam Description: LSM domain

SEQ ID NO: 59443 - DNA, 689 bp, Zea mays
  misc_feature: Ceres CLONE 1515845
  misc_feature: Encodes the peptide sequence at SEQ ID NO. 59444
ggagctccccgcggtggcggccgctctagaactagtggatcccccgggctgcaggaattcgtctcacccctagaaaaaatcagctcagcatacacaacatcatcatcatcatcttctcgctagtcgagcgagcccttatagttaattaagctagtcgatcgatccaagagaagaagaagcagcagacaggaatggcgtcgctctcgatgacgacgagcgcagcggcccgcgcgcagtggacgcctaggcagaacaagctgttcgagcaggcgctggcggtgtacgacaaggacacgcccgaccgctggcacaacatcgcctgcgccgtcggcggcgggaagtccgcggacgacgtcaggcgctactacgagctgctggaggaggacgtcggccacatcgagtccggcaaggtgcccttccccgcctaccgctaccccgccggctacggggccgccgacaggctgaaacagctgaagatctaggaggccaattgaacatataggacgaacgatcgatgatccagaagatgcaaacatgtgtgtatataggaattaatggggacaagtatccgtatgcctgcaatgggcccatgcctccacagtgccttgccaagtggttgtgtgaaaagccaaaaagtcaagagttagaatggcttgccaccaaggccctgggggtcagattttaagtag

SEQ ID NO: 59444 - protein, 96 aa, Zea mays
  misc_feature: Ceres CLONE 1515845
  misc_feature (13)..(63): Pfam Name: Myb_DNA-binding Pfam Description: Myb-like DNA-binding domain
  misc_feature: The sequence is a functional homolog of SEQ ID NO 2720 in the 10/374,780 US patent application
  misc_feature: The sequence is a functional homolog of SEQ ID NO 360 in the 10/225,066 US patent application
  misc_feature: The sequence is a functional homolog of SEQ ID NO 876 in the 11/435,388 US patent application
MASLSMTTSAAARAQWTPRQNKLFEQALAVYDKDTPDRWHNIACAVGGGKSADDVRRYYELLEEDVGHIESGKVPFPAYRYPAGYGAADRLKQLKI

SEQ ID NO: 59445 - DNA, 638 bp, Zea mays
  misc_feature: Ceres CLONE 1515846
  misc_feature: Encodes the peptide sequence at SEQ ID NO. 59446
tggagctccccgcggtggcggccgctctagaactagtggatcccccgggctgcaggaattcgtctcacccctagaaaaagcacccgcgctcaccgtacctcctccgaatccgccgaccgccggcgagcccctcctcctccacgacacgcgcttccccggctatcatggattcagatccatcgtcacagaacccaacagatatgactgcatttgtccagaacctccttggacagatgctaacaaggttcgagtccatgtcgcataacgttgcgtcccagatagatgaaatgggaaccaacattgatgagctcgagcagagcatcaacgatctcaaagctgagatgggcactgagactgctgtcgagaagcctgatgagccaaagcctgctgactctgcctaagttgggtgtaacccagagattgttgtgcgacgatttgatgatggtgtgacaaatttcagcactacgtgatcgtatctgttttcatgagtcctgacaattatgtaaacacgaacccatcgtaggacagatgaatccatgtttgggctctccagacatcgacgcatgctcttagcttttctgtcaaaacataaataaaaagcgagacgctacgagtacccgattcgccctataatgagt

SEQ ID NO: 59446 - protein, 78 aa, Zea mays
  misc_feature: Ceres CLONE 1515846
  misc_feature (10)..(63): Pfam Name: HSBP1 Pfam Description: Heat shock factor binding protein 1
MDSDPSSQNPTDMTAFVQNLLGQMLTRFESMSHNVASQIDEMGTNIDELEQSINDLKAEMGTETAVEKPDEPKPADSA

SEQ ID NO: 59447 - DNA, 638 bp, Zea mays
  misc_feature: Ceres CLONE 1515850
  misc_feature: Encodes the peptide sequence at SEQ ID NO. 59448
aagctggagctccccgcggtggcggccgctctagaactagtggatcccccgggctgcaggaattcgtctcacccctagaaaaaatctccttatcccaacacaacacactactaccctacccgtccgcctctctcgaaagcgcagcacccgagagcatgtcgcctgtgaccgggctcctggcgggcacggaggagccgccggcctcggccccagccccgtcgccgagcgaggcacgaccgccattactccgtctgcttctccccgctccacagcagcgggcagcgccacgctagcggtggagtgctcgtcgcggccgcagaagaaggggacctaccgccacatgaagacgcggcccacgaagacgcagccgtgggacatcaagcgccgacccacgcagtacccgccgccgccgccactcccaccagactggacgctcgccccctcccgcgccccgctcgacgtgcaagaggcggaggccccggcaccagccgcgactctcgtcctcgacgtggacgcagacgcccactgacgccggcgcggcgtgtcgccaaagatgttcccttgaacctccgcgtatgctgtttttctccgagacttgtctctcaaagcactggttgcccctattttgagactattta

SEQ ID NO: 59448 - protein, 62 aa, Zea mays
  misc_feature: Ceres CLONE 1515850
MKTRPTKTQPWDIKRRPTQYPPPPPLPPDWTLAPSRAPLDVQEAEAPAPAATLVLDVDADAH

SEQ ID NO: 59449 - DNA, 675 bp, Zea mays
  misc_feature: Ceres CLONE 1515852
  misc_feature: Encodes the peptide sequence at SEQ ID NO. 59450
tggagctccccgcggtggcggccgctctagaactagtggatcccccgggctgcaggaattcgtctcacccctagaaaaaaacgaccgctttaatcgattttccggaaactgaattctaccgatgtcggttcccggtcagatacgatatgatgcctccgcgacggcggggccctggtcagacttactgacaaaggaccggatggccaagatgtgtgatgtcttctacctaggcccaccccgactgagaaggctgattaacgcactattgagactcggcagtcgtgtggacatgaatgccattgcattccctgctagatgtgacctccgctacatgatcagtgaagcccagatcaattggaaatggacgatcgatactacatagattccgagcttcatcgcaccggagatgacggacctcgactctgatgaagacctcaagtgcggattctcgtgtgtgctatccggactgcatcggcttcatctctgcgcgacaagtccttttatggcatgagagatgttgctgacacattgtgccgatgctgaggaaactacatgatctttgtatgctgatatcgatgtgtgacgtcgtactaactacgaggagtttgctatcgctatgacgtgcaaccgtgtctgtgcttcctaagctcaaggcaaacaggactgtgcattgcc

SEQ ID NO: 59450 - protein, 86 aa, Zea mays
  misc_feature: Ceres CLONE 1515852
MSVPGQIRYDASATAGPWSDLLTKDRMAKMCDVFYLGPPRLRRLINALLRLGSRVDMNAIAFPARCDLRYMISEAQINWKWTIDTT

SEQ ID NO: 59451 - DNA, 650 bp, Zea mays
  misc_feature: Ceres CLONE 1515854
  misc_feature: Encodes the peptide sequence at SEQ ID NO. 59452
tggcggccgctctagaactagtggatcccccgggctgcaggaattcgtctcacccctagaaaaatcgcacaaacgcgctcccggtccgaaaggcaaaccagccaccagtcccaccaccaccaccctctgtcttcgcctccgctgccgattcgaaagcacccgtcctgtcccctcgcaaaaccctagctccagccaccatgaagggcaaggctgacacctccaataaggacgagggcaggctccgggcgggcggcgccgccggaaagcgcaagaaggccgccgcgagcggaaaacccaagcgcccgcccttcgccttcttcgacttcatgtctgaattcttgcacgaccaaccggggggggggggggggggagaccaagaatcgttagaaaaccggcgagacaatggcaggtagggtataaaaaaggggaggggtgtcttggtgaaaaaaggagggggaaaagagcaaacccatatctatgggcaccccacaccgtcgatccacaagaataaaccctcccagcatctcctcaaaaagcatacaaaaggggccaagtttgtttctgtaaggcggccaaccccccacggccaataaaagaccgggcgcgaaaggtaaaccaaaataccgcactgcccctcccctcaaccaacg

SEQ ID NO: 59452 - protein, 71 aa, Zea mays
  misc_feature: Ceres CLONE 1515854
MKGKADTSNKDEGRLRAGGAAGKRKKAAASGKPKRPPFAFFDFMSEFLHDQPGGGGGGDQESLENRRDNGR

SEQ ID NO: 59453 - DNA, 678 bp, Zea mays
  misc_feature: Ceres CLONE 1515855
  misc_feature: Translation starting site: 156
ggagctccccgcggtggcggccgctctagaactagtggatcccccgggctgcaggaattcgtctcacccctagaaaaaaaccattcccctgcgccgtcgtcatccgacatcgtctcttcgacctgacgagccaccgataatccgccggcgctcatatgttggattaccaagatatcgtatctggccacaagctactgtcgcgattcattctcgtgcggcgagctcgccctccgaccacggtgggatgtcgagggaaagtgcgtcacacatggatcccggtcatgtacacattggggccaatccatccgcagagtgagctgcggatgaaagtatttgtgacccatccgcgcaggagggtgacattggagataccttccgtctacaggaccagcgtcctcttgacgagagatcatttctctcttccatgagctaatgcatcactactctcactgctgcgttgccatgcaccaccggcatatcagctcccaaaaggggcgtcgaggctgcacaaatgtttcgccttagcaagctgaatgacctgtcatctatttgtagctgagagcctggacgacgatgcgttcgagcgtatcacctatgaccaagatgggagcccctaattcggaattcgacgatttcgcaacttggactaaaaggaaataaagcgtcttgaattgcttt

SEQ ID NO: 59454 - DNA, 661 bp, Zea mays
  misc_feature: Ceres CLONE 1515866
  misc_feature (661)..(661): n is a, c, t, g, unknown, or other
tggcggccgctctagaactagtggatcccccgggctgcaggaattcgtctcacccctagaaaaaaacttcctgcttgcacgcgagccactccgaggccaagtctagggtttgggaatctgtaggaggggagaggggagcgcgctcagggtcagggaggcgaagatgatcgaggtggtgctgaacgaccgcctggggaagaaggtgcgggtgaagtgcaacgaggacgacaccatcggcgacctctagaagctggtggcggcgcagacggggacgcgccccgagaagatccgcatccagaagtggtacaacatctacaaggaccacatcacgctcaaggactacgagatccacgacgggatggggctcgagctctactacaactaggcgccctgaccccaaccgtgccctgatgttaatccgaaattctgaagtcatgggtgcgcttccagtctcagcgtctttagctaacaagctcgcatacgtatagggcaacttgagtgagctatgtagtacggatatggttgtgtggcaaactgcccatgactatttgaatcccttgcatattttgaccttgtgaaaagggatcaaccctggcaaacatggtggcctggctacttcggcaaacccttatttacctttaaaaaaacccagggggggggn

SEQ ID NO: 59455 - DNA, 651 bp, Zea mays
  misc_feature: Ceres CLONE 1515868
  misc_feature: Encodes the peptide sequence at SEQ ID NO. 59456
  misc_feature (429)..(429): n is a, c, t, g, unknown, or other
ccgcggtggcggccgctctagaactagtggatcccccgggctgcaggaattcgtctcacccctagaaaaagagggcatcagggcagcgaggcttcttgtcgcgtgaatcccctcgagagccgccggcggagccatggcgcggtccccagctgcctcctcctcctcctacacggatagcacgggatcctcctccgactcaggctccagctcatcgggaatcgaccgccgccgccgccgccaccgccatcggagcagccgccgcaaggagggcacgtcctcgtccgcgctgaaggcgcgcaaggaccggaggtcccgccacaagcgccgccgccacgagcgggagcggcggcggtccgcgtccgacgacgacagctacagcagcacaagctcttatgacagtgaccgtgaggtgtctggcagatctcgganacataagaagagcagcagatcaagaaagtttagggagagggagcggagcaaagatagacatcatagacgagacaagagtaaacacaaagagaagaaagagagtgagcatgctgatggccctgtccagctttccaagtttcttggacggggacaagaaaaaaaaaaaaaaaacgagacgctcgaggtacccaattcgccctatagtgagtcgtattacgcgcg

SEQ ID NO: 59456 - protein, 172 aa, Zea mays
  misc_feature: Ceres CLONE 1515868
  misc_feature (99)..(99): Xaa is any aa, unknown, or other
MARSPAASSSSYTDSTGSSSDSGSSSSGIDRRRRRHRHRSSRRKEGTSSSALKARKDRRSRHKRRRHERERRRSASDDDSYSSTSSYDSDREVSGRSRXHKKSSRSRKFRERERSKDRHHRRDKSKHKEKKESEHADGPVQLSKFLGRGQEKKKKNETLEVPNSPYSESYYA

SEQ ID NO: 59457 - DNA, 646 bp, Zea mays
  misc_feature: Ceres CLONE 1515869
  misc_feature: Encodes the peptide sequence at SEQ ID NO. 59458
aaagctggagctccccgcggtggcggccgctctagaactagtggatcccccgggctgcaggaattcgtctcacccctagaaaaaactgccaaatcccccagaaaatcaactcctccccaattccacgctgccaccaactcgccgtcctccgcgccaagcaccaaagctccgatggcccgcacgaagcagacggcgcgcaagtcgacgggcggcaaggcgccccgcaagcagctggcgaccaaggcggcgcgcaagtctgcgccggccaccggcggcgtgaagaagccccaccgcttccgccccggcaccgtcgcgctccgggagatccgcaagtaccagaagagcacggagctgctcatccgcaagttgcccttccagcgcctcgtccgtgagatcgcgcaggacttcaagaccgatctccgcttccagtcctccgccgtcgccgcgctgcaggaggccgccgaggcctaccttgtggggctctttgaggacactaacctctgtgccatccacggcaagcgcgtcaccatcatgcccaaggacatccagctcgcgcgccgtatcaggggcgagaagggcctgaccgaagctggctccctcccacgcaagcgggcgccttggtttgctccggccctgctgaaggaat

SEQ ID NO: 59458 - protein, 158 aa, Zea mays
  misc_feature: Ceres CLONE 1515869
  misc_feature (58)..(132): Pfam Name: Histone Pfam Description: Core histone H2A/H2B/H3/H4
MARTKQTARKSTGGKAPRKQLATKAARKSAPATGGVKKPHRFRPGTVALREIRKYQKSTELLIRKLPFQRLVREIAQDFKTDLRFQSSAVAALQEAAEAYLVGLFEDTNLCAIHGKRVTIMPKDIQLARRIRGEKGLTEAGSLPRKRAPWFAPALLKE

SEQ ID NO: 59459 - DNA, 577 bp, Zea mays
  misc_feature: Ceres CLONE 1515875
  misc_feature: Encodes the peptide sequence at SEQ ID NO. 59460
tggagctccaccgcggtggcggccgctctagaactagtggatcccccgggctgcaggaattcgtctcacccctagaaaaagcctccgctcgccaccatcgtctaggttaggctagggttcgaccagctagcggaaatggtggccttcaggttccatcagtaccaggtggtggggcgcgcgctgccgacgcccggcgatgagcaccccaagatctaccgcatgaagctctgggccaccaacgaggtccgcgccaagagcaagttctggtacttcttgaggaagttgaagaaggttaagaagagcaacggccaggtcctggccatcaacgagatctttgagcgtaacccgacgacaatcaagaactacggcatctggctgcgctaccagagcagaaccggataccacaacatgtacaaggagtaccgcgacacgaccctgaatggcgctgtggagcagatgtacaacgagatggcctctcgccaccgcgtgaggtccccctgcctcccgaacatccagactgcgacggggcaccttcaagctctgccagagggaacaaccctaagcagttcccccaccg

SEQ ID NO: 59460 - protein, 147 aa, Zea mays
  misc_feature: Ceres CLONE 1515875
  misc_feature (5)..(145): Pfam Name: Ribosomal_L18ae Pfam Description: Ribosomal L18ae protein family
MVAFRFHQYQVVGRALPTPGDEHPKIYRMKLWATNEVRAKSKFWYFLRKLKKVKKSNGQVLAINEIFERNPTTIKNYGIWLRYQSRTGYHNMYKEYRDTTLNGAVEQMYNEMASRHRVRSPCLPNIQTATGHLQALPEGTTLSSSPT

SEQ ID NO: 59461 - DNA, 645 bp, Zea mays
  misc_feature: Ceres CLONE 1515880
  misc_feature: Encodes the peptide sequence at SEQ ID NO. 59462
ccccgcggtggcggccgctctagaactagtggatcccccgggctgcaggaattcgtctcacccctagaaaaaagcagtgacgaactcgaagcttgcgttcttgtagtagaggtcggcagcaagcggtggtagagcgagaggtcgagaagatgaagagcagcactctgttggcgatcctagttctccaggcccttctggtctctgcggccgtggccaaaggacctgcagggccgacgacgaagaagcagtgctggtgcggcgagtgcaccagctggtcgggcgtgtggacctgcgacgacctcctcaccaagtgcgccgccacctgcaagaactgcgtccccgtgtccacggacaagggggccatcaagtacaggtgccgcgacttcctccccgaaaactgcggctgcaagatccactagagactcatccaattccaccatggccgcgcgccacagcggcacagccgatggatccttccatgttcctccgtccgtccgccttgctacaagcagggcgccacaccaataagctagctctttgttgttgttttggatgtttgattgggggtcccttcccagtccagatggaataaaaattaatcatccggcgcccattaccaaaaaaaaccaaaaaaaccaaaccgtg

SEQ ID NO: 59462 - protein, 89 aa, Zea mays; identical to SEQ ID NO: 58327
  misc_feature: Ceres CLONE 1515880

SEQ ID NO: 59463 - DNA, 708 bp, Zea mays
  misc_feature: Ceres CLONE 1515885
  misc_feature: Encodes the peptide sequence at SEQ ID NO. 59464
  misc_feature (312)..(312): n is a, c, t, g, unknown, or other
  misc_feature (403)..(403): n is a, c, t, g, unknown, or other
  misc_feature (411)..(411): n is a, c, t, g, unknown, or other
  misc_feature (416)..(416): n is a, c, t, g, unknown, or other
  misc_feature (420)..(420): n is a, c, t, g, unknown, or other
  misc_feature (609)..(609): n is a, c, t, g, unknown, or other
  misc_feature (612)..(612): n is a, c, t, g, unknown, or other
  misc_feature (653)..(653): n is a, c, t, g, unknown, or other
  misc_feature (660)..(660): n is a, c, t, g, unknown, or other
  misc_feature (682)..(682): n is a, c, t, g, unknown, or other
  misc_feature (706)..(706): n is a, c, t, g, unknown, or other
aaagctggagctccccgcggtggcggccgctctagaactagtggatcccccgggctgcaggaattcgtctcacccctagaaaaaagcacgccctttccccacctcgatctcgcgctaggttttcgccacaccgctctcgtcctccgcgaagatgccgaagaacaagggtaagggaggcaagaaccggaagcgtggaaagaacgaggctgacgacgacaagcgcgagctcgtcttcaaggaagacgggcaggagtatgcgcaggtgacccggatgctcggcaaccggcggtgcgaggccacctagagtggacngcacccttctcctctgccatatccggggcaagatgcccaaaaagtgttttttttccccccccccaagaggggggggggggggggcctcccnaattcccnttacnaccnggccccaccaaatacaaaaaaaacattaacccgcggaggggggggcgggcccaaagcccacggaggaacattcccccaaagaccctcaccgccccgacaaagcgcgccccaccgtccaatgaggcgacctaacacacgcgccacgaaaacaccgacgaaccaaacctccaccccccgctcccgagagancanaaacccgctgccccacgacccctgcccccatcctatgccangcgcccncgccgccccccaagcaagcatnagatacataccctccgccaacacncc

SEQ ID NO: 59464 - protein, 50 aa, Zea mays
  misc_feature: Ceres CLONE 1515885
MPKNKGKGGKNRKRGKNEADDDKRELVFKEDGQEYAQVTRMLGNRRCEAT

SEQ ID NO: 59465 - DNA, 696 bp, Zea mays
  misc_feature: Ceres CLONE 1515886
  misc_feature: Encodes the peptide sequence at SEQ ID NO. 59466
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (19)..(19): n is a, c, t, g, unknown, or other
  misc_feature (20)..(20): n is a, c, t, g, unknown, or other
  misc_feature (39)..(39): n is a, c, t, g, unknown, or other
  misc_feature (40)..(40): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
tttttttttttnnnnnttnntttttctaaattgtacaannaaaacggggtgannnnttaaaagctgggactccccgcggtggcggccgctctagaactagtggatcccccgggctgcaggaattcgtctcacccctagaaaaactatcctctccccgtgcgcccgtgcggccgccgcggcttcccttcctctcccgagccgagatgaatgttgaaaagctcatgaagatggcaggtgctgtgcgcaccggggggaatggtagcgtgcgcaggaagaagacggcagtccgcaagactaccaccactgatgacaaacgggttcaaagcaccttgaaaagaatacgaatgaacagcattcctggtattgaagacgtcaacatctttaaggatgacgttgttattcaacttgtaaatcctacagtgcaagcgtcaattggtgctaatacatgggtggtcagtggaactccacagacaaagaagctgcaagatctgcttccgtcgattatgaaccagcttggtcctgcacacctggacaatctgcggaggctcgcagagcaattccagaagcaagcctctggtgcttctggtgcacaggatggtgcccgcgctggggctgttcatgacgatgatgatgacgttcctgaccttgtccctggagagacatttgaggaggccgcggaagaaaaaaaggagtcct

SEQ ID NO: 59466 - protein, 164 aa, Zea mays
  misc_feature: Ceres CLONE 1515886
  misc_feature (34)..(92): Pfam Name: NAC Pfam Description: NAC domain
MNVEKLMKMAGAVRTGGNGSVRRKKTAVRKTTTTDDKRVQSTLKRIRMNSIPGIEDVNIFKDDVVIQLVNPTVQASIGANTWVVSGTPQTKKLQDLLPSIMNQLGPAHLDNLRRLAEQFQKQASGASGAQDGARAGAVHDDDDDVPDLVPGETFEEAAEEKKES

SEQ ID NO: 59467 - DNA, 541 bp, Zea mays
  misc_feature: Ceres CLONE 1515888
  misc_feature: Encodes the peptide sequence at SEQ ID NO. 59468
  misc_feature (217)..(217): n is a, c, t, g, unknown, or other
  misc_feature (226)..(226): n is a, c, t, g, unknown, or other
  misc_feature (237)..(237): n is a, c, t, g, unknown, or other
atagctggagctccccgcggtggcggccgctctagaactagtggatcccccgggctgcaggaattcgtctcacccctagaaaaagagacaccgcgtgcgaaccaagcagaccacagcaagaagcgtagtcgtcgccggaaggaaaggcgcggagcaagatgtcgtggcaggcgtacgtcgatgagcacctgatgtgcgagatcgaaggacaacatcntcagcgccngccgccatcgntcggtcacgacggcagcgcttgggcgcagtccgagagcttccccgagttaaagcctgaggaggttgctggtatcataaaggactttgatgaacctggtactcttgcaccaactggtcttttcgttggaggtacaaagtacatggtgatccaaggtgaaacctggagttgtcatccgaggaaagaaaggcactggggggcattactatcaagaaaaaccgggcatgtcccttggattaattggtgggcctacgaaccgaacccattgacccccccgggcaaatggcaccctggggggggggggaa

SEQ ID NO: 59468 - protein, 127 aa, Zea mays
  misc_feature: Ceres CLONE 1515888
  misc_feature (2)..(102): Pfam Name: Profilin Pfam Description: Profilin
  misc_feature (20)..(20): Xaa is any aa, unknown, or other
  misc_feature (23)..(23): Xaa is any aa, unknown, or other
  misc_feature (27)..(27): Xaa is any aa, unknown, or other
MSWQAYVDEHLMCEIEGQHXQRXPPSXGHDGSAWAQSESFPELKPEEVAGIIKDFDEPGTLAPTGLFVGGTKYMVIQGETWSCHPRKERHWGALLSRKTGHVPWINWWAYEPNPLTPPGKWHPGGGG

SEQ ID NO: 59469 - DNA, 752 bp, Zea mays
  misc_feature: Ceres CLONE 1515890
  misc_feature: Encodes the peptide sequence at SEQ ID NO. 59470
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (15)..(15): n is a, c, t, g, unknown, or other
  misc_feature (16)..(16): n is a, c, t, g, unknown, or other
  misc_feature (18)..(18): n is a, c, t, g, unknown, or other
  misc_feature (19)..(19): n is a, c, t, g, unknown, or other
  misc_feature (21)..(21): n is a, c, t, g, unknown, or other
  misc_feature (22)..(22): n is a, c, t, g, unknown, or other
  misc_feature (39)..(39): n is a, c, t, g, unknown, or other
tttttttttnnnntnntnntnnttttttttttttttttntttttgctgtttgtccaaagctggtactccccgcggtggcggccgctctagaactagtggatcccccgggctgcaggaattcgtctcacccctagaaaaagcctcgcatcaaaccaactctttcccaaatccaccgccggctcggctcgcccatcttcgcgccaagcaccgaatctccgatggcccgcacgaagcagacggcgcgcaagtcgacgggcggcaaggcgccccgcaagcagctggccaccaaggcggcgcgcaagtcggcgccggcaaccggtggcgtgaagaagcctcaccgcttccgccccggcaccgtcgcgctccgggagattcgcaagtaccagaagagcacggagctgctcatccgcaagctgcccttccagcgcctcgtccgtgagatcgcgcaggatttcaagaccgacctccgcttccagtcctccgctgtcgccgcgctgcacgaggccgccgaggcctacctcgtggggctcttcgaggacaccaacctctgcgccatcccacgccaagcgcgtccaccatcattgcccccaggaacatccagctccgcgcgcccgcaatcagggggcaaaaaggggcttgaatctcccccgttggtccttccccccaacgtttggttggtggccctttccccccctggggaccacctggccttggtagaaaaacaccatggcactctagtgggtacccgggtc

SEQ ID NO: 59470 - protein, 178 aa, Zea mays
  misc_feature: Ceres CLONE 1515890
  misc_feature (58)..(133): Pfam Name: Histone Pfam Description: Core histone H2A/H2B/H3/H4
MARTKQTARKSTGGKAPRKQLATKAARKSAPATGGVKKPHRFRPGTVALREIRKYQKSTELLIRKLPFQRLVREIAQDFKTDLRFQSSAVAALHEAAEAYLVGLFEDTNLCAIPRQARPPSLPPGTSSSARPQSGGKKGLESPPLVLPPNVWLVALSPPGDHLALVEKHHGTLVGTRV

SEQ ID NO: 59471 - DNA, 682 bp, Zea mays
  misc_feature: Ceres CLONE 1515891
  misc_feature: Pfam Name: NDUF_B7 Pfam Description: NADH-ubiquinone oxidoreductase B18 subunit (NDUFB7)
  misc_feature (335)..(335): n is a, c, t, g, unknown, or other
  misc_feature (345)..(345): n is a, c, t, g, unknown, or other
  misc_feature (348)..(348): n is a, c, t, g, unknown, or other
  misc_feature (365)..(365): n is a, c, t, g, unknown, or other
  misc_feature (381)..(381): n is a, c, t, g, unknown, or other
  misc_feature (413)..(413): n is a, c, t, g, unknown, or other
  misc_feature (514)..(514): n is a, c, t, g, unknown, or other
  misc_feature (662)..(662): n is a, c, t, g, unknown, or other
atagctggagctccccgcggtggcggccgctctagaactagtggatcccccgggctgcaggaattcgtctcacccctagaaaaaaaccaaacccgcgttcatcgacggacgagctcgcccgcgagagagcgactgagatggaggtggcggcctcggcggccggcgtggagctgggctcctctaaaccccccatcccacacatgcggagatggcggacgcccgggcggcgctcgcctaccccgatccatgggcggacctcctcctccccctcaagaagtgtgcccggcccccccaattctacctcccccctggacactgctaggccccaaatgagnattccccctntcnagaaactggtctgagcnaaactctttcgcggcncccgtatggtctcggggtgggcggcgcctggngagggagggtgggtgggagaccacacgccccccaggcaggcgggccttctttggggtttctctttttccgggggccacgcccccccacctcctcccccagntcccctccgccggcgatccctcgtccagctcttgatttacctaccccacccccctatgccgcgttctttgctccccggctccaaggacccggcctagctccccctaccgaagagaacaccccccccctaccttgcttaccgtcgcacngcccacaacaaatataccta

SEQ ID NO: 59472 - DNA, 735 bp, Zea mays
  misc_feature: Ceres CLONE 1515892
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (79)..(79): n is a, c, t, g, unknown, or other
  misc_feature (80)..(80): n is a, c, t, g, unknown, or other
  misc_feature (96)..(96): n is a, c, t, g, unknown, or other
  misc_feature (98)..(98): n is a, c, t, g, unknown, or other
  misc_feature (159)..(159): n is a, c, t, g, unknown, or other
  misc_feature (178)..(178): n is a, c, t, g, unknown, or other
  misc_feature (179)..(179): n is a, c, t, g, unknown, or other
  misc_feature (183)..(183): n is a, c, t, g, unknown, or other
  misc_feature (188)..(188): n is a, c, t, g, unknown, or other
  misc_feature (196)..(196): n is a, c, t, g, unknown, or other
  misc_feature (198)..(198): n is a, c, t, g, unknown, or other
  misc_feature (199)..(199): n is a, c, t, g, unknown, or other
  misc_feature (223)..(223): n is a, c, t, g, unknown, or other
  misc_feature (442)..(442): n is a, c, t, g, unknown, or other
nnnnnnnnnnnnnnnnnnnnnnnnnnnnnnnnnnnnnnnnnnnnnnnnnnnnnnnnnnnccccccccccnnnnnnnccnncccccctcattttttntntaaaaaaataagggggacctccaccgacggatggacgggccgtcttcctagaaaactaagntggggaatcccccccgggnnctgncaggnaaattcgntnnctcacccctagaaaaaaccccacngtctcctcgcctcgttccccatttgctgcgtctccttgcccgcgccgccgctcgccgtttgcccctcgtctccgcaccgcgcgctgttgtccatccttgtgcagcaaaaatgaacgctggctaattgttggctcactggtcggatccttttgccattggaataaccttgtgtgaaaaaaatttttaccttctgaacaaaaaaaggcattttgttgagtnaaaaaagggttaaaggctcctacaaaaaactacaccctccctcccctttcaaaaaaaaagaaaaaaaaaaacgaccggtggaggggatgttatttttcccccccttttctaaaaaaaaaaaaaagtgggtggggaaaaaaccccccaaaaaaaacccccaaagttttttcccaagggcccttggggacctccccccaaattttgttttggggggccacacaccggggttttgttctttgaaaaaaccccctctattatagacccccccacaaaaaaaatatttttttttttgg

SEQ ID NO: 59473 - DNA, 638 bp, Zea mays
  misc_feature: Ceres CLONE 1515893
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (288)..(288): n is a, c, t, g, unknown, or other
nnnnnnnnnnnnnnnnnnnnnnnnnnnnnnnnnnnnnnnnnnnnnnnnnnnnnnnnnnnnnnnnnnnaaaataaaatannnaaaactggagctccccgcggtggcggccgctctagaactagtggatcccccgggctgcaggaattcgtctcacccctagaaaaagataaccaagaacaaaccattgttggacgcgttcccctcctgcacgcaacctcatctcgtcctccagatcctgggatggcccgtccctcctttggaaaactttggccccgcgaggtgggtccnttccggggcctactttgtttaattttccggaatcctttgctcttgtttggggtccaaacgaaagcggatttcgatccttcaggtttaaaaaaacttggacgggtgaaaaaaaacaaaaacccccggtggaaaccccgtatcacgaaaaacccttcgccccaaaggagggaaaggggggtgtttttttttggtggggaaaaaaaaaaaaaaaatttttatcctcccctgggggcccccacgtggggggaaaaattttttttatggggttctacaatctttccttttttttatttcttcggaggccttttttgagggggcaataaaagtaggggggggggggggggtgattt

SEQ ID NO: 59474 - DNA, 639 bp, Zea mays
  misc_feature: Ceres CLONE 1515896
  misc_feature: Translation starting site: 209
atagctggagctccccgcggtggcggccgctctagaactagtggatcccccgggctgcaggaattcgtctcacccctagaaaaagcaccagcaccgaggcaggagcggcgatccattccacacaaccaccactgctcttgccccagcccgccgcaggagttgccagatctgccccggtcacaggaactccgactccgagccctctccaatggcggttaaggtctacgtcgtgtactattccatgtatggacatgttggcaaactagctgaagagatccagaaaggtgcctcgtctgttgaaggtgttgaagctaaaacatggctggtccctgaaaccctccctgaggaagtgcttggaaagatgggcgcaccccctaagcctgacgtgccagtcatcacgccgcaagaactcgcagaggccgacggaatcctcttcgggttcccacgaggttcggaatgatggcagcgcagatgaaggcgttcttcgatgccactggtgggctctggagggagcaaagccttgccggcaagcctgccggcgtcttcttctgcactggatcccagggtggtggccaggagacgaccgcgttgacagcgatcaccccgttgaccccccaccgcttggtgttcttgcctggg

SEQ ID NO: 59475 - DNA, 645 bp, Zea mays
  misc_feature: Ceres CLONE 1515900
  misc_feature: Encodes the peptide sequence at SEQ ID NO. 59476
  misc_feature (563)..(563): n is a, c, t, g, unknown, or other
  misc_feature (631)..(631): n is a, c, t, g, unknown, or other
  misc_feature (639)..(639): n is a, c, t, g, unknown, or other
  misc_feature (645)..(645): n is a, c, t, g, unknown, or other
cgcggtggcggccgctctagaactagtggatcccccgggctgcaggaattcgtctcacccctagaaaaagccactccctctcacgagtgacgacgaaaccctaggccatggcttggcgcggcgccgcctcccgctccattatcgccgccgtccgtgctcgcgccgcatccccatcttccaccgccgcctcgcgcctccgctcgacggctccacttcccgccccctcgcgccggtccgtccccgccttcgctttcgcgaccgcgaggccgttggcggcgatgtcggggtccccggcggcggccgtggtgaagctcaccgggcactcggcgacgagcgtgcgggcgtgctgtgagctctcccagggtaccctcttctgccgcacttgtcaggatcgctagcaagcacttaatgcgcacttttgtccttaaatgcaagggttggattctttggaggttgcatcccttggaaattcgtcgggcttgcatccttttccatgcattttgcagagtacttagcacctcgtgtgttggcaatcggacagtatatctgctgtaacttacatnaataatcatatggtagcctgctgctactcactgccccgcatcgattggaactaagttgatgtttgggntatacgtnaaatcn

SEQ ID NO: 59476 - protein, 39 aa, Zea mays
  misc_feature: Ceres CLONE 1515900
MSGSPAAAVVKLTGHSATSVRACCELSQGTLFCRTCQDR

SEQ ID NO: 59477 - DNA, 613 bp, Zea mays
  misc_feature: Ceres CLONE 1515902
  misc_feature: Encodes the peptide sequence at SEQ ID NO. 59478
  misc_feature (274)..(274): n is a, c, t, g, unknown, or other
ggatcccccgggctgcaggaattcgtctcacccctagaaaaaaccacaccacaccacaccggccggctcacacgcgccgcaaagcagagcacggggggctgagaccagagcagagcggagcgccaccagccaatcctttgcctgcccaagcagcagcagcagctggcccgatggctctgtctctctccggtacctccgcccgcttcgccctcgcgtcgctggtcccccgggccagggcctacgcggcgtcggcggcgtccggggccatgaggcngcgcggcggagggcgcggccgccgccgtcgaccccgccgacctccgcgccgcgcacctcgcccgcacctacgcccgggcctgagcggccccggctcccttcaccctgctccgcctcgtctcgtatgacatacgcgcaccgtaccagggtgagacgaggtgggggctgggggttcgtgtggcgaacggcgtgttgagccacgcgcgcgtgcggccgcgctctgcgacgcccggaacgttcttgggagagcgcgagcgaagtcttctgtcttctcggtgcgggtcgctgtgccatgagatgtgacgctgggtcgttttgggtccgacaacgggagaagagg

SEQ ID NO: 59478 - protein, 76 aa, Zea mays
  misc_feature: Ceres CLONE 1515902
  misc_feature (35)..(35): Xaa is any aa, unknown, or other
MALSLSGTSARFALASLVPRARAYAASAASGAMRXRGGGRGRRRRPRRPPRRAPRPHLRPGLSGPGSLHPAPPRLV

SEQ ID NO: 59479 - DNA, 793 bp, Zea mays
  misc_feature: Ceres CLONE 1515905
  misc_feature: Encodes the peptide sequence at SEQ ID NO. 59480
  misc_feature (5)..(5): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (36)..(36): n is a, c, t, g, unknown, or other
  misc_feature (37)..(37): n is a, c, t, g, unknown, or other
  misc_feature (793)..(793): n is a, c, t, g, unknown, or other
ggggnaannnnnttttttggtaggtccggggttccnnacccctctccccccgtgtttggggctttccgcggtggcggccgctctagactagtggatcccccgggctgcaggaattcgtctcacccctagaaaaaaaaaaaaagtcttgagtcccccctctccttccccttcccaacgctctcgctgcagaggaaaggcgaagatggcgatgaccgtcgaagtgcttgctgcactcgcgttcatgttttcgacgagtattctactgcagatactggcatgcgctttgtaccacaactggtggcccatgttagcagctctcatgtacgtctttgtaccaatgccatgcctgttttttggtggtggatccacacacttcttgaccaactgacaaggtggagggtggattaatgctgcaaaattcttgactggggcggcgggcatgggaagccttgctattcccgcagttctgaggcacgctgggcttaatcgagactggggccgtgttccaccgagttcacgtcccttcttaaacccttgtatggaaccgggcttgtggcttccataagggcgaactctggaaggaggcactggggaaaatgcgaaattttcagccggccccccctgaaaacccctaaacgggttcctttgggctggcgtttcgtgccccaatggcctaaaaaaaaaaaattcccctcggtggggaaaggtttacacataggggattccttgtataaaaagaacaaggcccttatatttttccgagggggcgtgagacccggttaacccttggaan

SEQ ID NO: 59480 - protein, 61 aa, Zea mays
  misc_feature: Ceres CLONE 1515905
  misc_feature (8)..(62): Pfam Name: Vps55 Pfam Description: Vacuolar protein sorting 55
MAMTVEVLAALAFMFSTSILLQILACALYHNWWPMLAALMYVFVPMPCLFFGGGSTHFLTN

SEQ ID NO: 59481 - DNA, 652 bp, Zea mays
  misc_feature: Ceres CLONE 1515911
  misc_feature: Encodes the peptide sequence at SEQ ID NO. 59482
  misc_feature (625)..(625): n is a, c, t, g, unknown, or other
tggcggccgctctagaactagtggatcccccgggctgcaggaattcgtctcacccctagaaaaaaaaaactctctctccccatccgcgccagtccaaccaagtcagcacccgcgcgcggcaaggagttcacgcccatggcgagcaccaacatggcgtcggccacctcgcggttcatgctggccgcgggcgtgcccactgccagtagcggcagcggccgcgtcagcttcgccttggcgcccaaccggcttggcaggaggcttgtggtccgggccgatgaggagttcccggcagagccggcgcccacggcggaaggggagggcgccgtggccaccaagcccaaggccgagaagccgccgccgatcgggcccaagaggggcgccaaggtgaatatcctgaggcgggagtcctactggtacaacgggatcggcaacgtcgtcaccgtcgatcaggatcctaacacccgttacccggtggtggtgcggttcaacaaggtgaactacgccggcgtgtctaccaacaactacgctttggacgacatcctcgaggtgaaatgagtgatgccagtctgctaaagaccccatgctcctgtgtgatttgtacttgtgaagtgaggctgctgcctanctgctagcgtcacacatcgatcttgta

SEQ ID NO: 59482 - protein, 139 aa, Zea mays
  misc_feature: Ceres CLONE 1515911
  misc_feature (78)..(139): Pfam Name: PSI_PsaE Pfam Description: Photosystem I reaction centre subunit IV / PsaE
MASTNMASATSRFMLAAGVPTASSGSGRVSFALAPNRLGRRLVVRADEEFPAEPAPTAEGEGAVATKPKAEKPPPIGPKRGAKVNILRRESYWYNGIGNVVTVDQDPNTRYPVVVRFNKVNYAGVSTNNYALDDILEVK

SEQ ID NO: 59483 - DNA, 615 bp, Zea mays
  misc_feature: Ceres CLONE 1515912
  misc_feature: Encodes the peptide sequence at SEQ ID NO. 59484
cgcggtggcggccgctctagaactagtggatcccccgggctgcaggaattcgtctcacccctagaaaaagctctgatagcttgctccaggacgtacgtacgtacgtagatcgatccatcgatcgctagctagctgacgaccatggcgtccctctcctctgccgccatcaccgccccttccttcacggccgcgcccgctcgcgcagtggtcagcaggaggtccttcaccgtgcgtgcctctctccgcaaggccactgccaccgccgccgtggccgttgccgccagcgtcctgcttgccggcggcggcgccatggcccaggaggtgctgctgggcgcaggcgacggcgggctcgtcttcgagcccagccagttcaccgtcaaggccggcgacaccatcacctttcagaaacacgccgggctcccgcacaacgtcgtgttcaaccaagaacaaagtggcgaagcggcgtcgacgccctccagatctcccagggaggagtacctccaccgcgcccgggggaagaacttaattcccgtcccccctttaccgcgggggccgggggaaccctaaggggtttctaactggggaaagccgcccccccaggggaggcagggaagg

SEQ ID NO: 59484 - protein, 141 aa, Zea mays
  misc_feature: Ceres CLONE 1515912
  misc_feature (59)..(132): Pfam Name: Copper-bind Pfam Description: Copper binding proteins, plastocyanin/azurin family
MASLSSAAITAPSFTAAPARAVVSRRSFTVRASLRKATATAAVAVAASVLLAGGGAMAQEVLLGAGDGGLVFEPSQFTVKAGDTITFQKHAGLPHNVVFNQEQSGEAASTPSRSPREEYLHRARGKNLIPVPPLPRGPGEP

SEQ ID NO: 59485 - DNA, 656 bp, Zea mays
  misc_feature: Ceres CLONE 1515918
  misc_feature: Encodes the peptide sequence at SEQ ID NO. 59486
  misc_feature (1)..(1): n is a, c, t, g, unknown, or other
  misc_feature (395)..(395): n is a, c, t, g, unknown, or other
  misc_feature (460)..(460): n is a, c, t, g, unknown, or other
  misc_feature (556)..(556): n is a, c, t, g, unknown, or other
natagctggagctccccgcggtggcggccgctctagaactagtggatcccccgggctgcaggaattcgtctcacccctagaaaaatcttctgctgggtagcagctagcagtatacaagagcttgcttgctgtcctagtcctacctactgacgagctcgccatggcctccctctcctctgccgccgtcaccgccccttccttcgccgcaccagcgccagcccgcgccgtggtcagaaggaggtccttcaccgtgcgcgcctctctccgcaaggccaccggcaccgccgccgtggcaatggctgccagcgccctgcttgccggcggtgccatggcccaagaggtgctgctgggcgcatgttactcccccccccctcttggaggggggggagggtacntcaaaggccgcaacaccctcacatttaaaaaacaacaccggcttcccgcacaacggcgggcttcnacgaaaacaaggtgcccaacgggcgtccaccccaccaaaatttcgcaggaaagattactcaacgcgcccggcggaaaccatatcccgtgacccctnaccggtggcggggaacctacggggttctacggggaaccccgatctaaggaaacccggaatgggcccgcaaaatcccccgcccaaccccattaaaccttcc

SEQ ID NO: 59486 - protein, 129 aa, Zea mays
  misc_feature: Ceres CLONE 1515918
  misc_feature (79)..(79): Xaa is any aa, unknown, or other
MASLSSAAVTAPSFAAPAPARAVVRRRSFTVRASLRKATGTAAVAMAASALLAGGAMAQEVLLGACYSPPPLGGGGGYXKGRNTLTFKKQHRLPAQRRASTKTRCPTGVHPTKISQERLLNAPGGNHIP

SEQ ID NO: 59487 - DNA, 842 bp, Zea mays
  misc_feature: Ceres CLONE 1515920
  misc_feature (1)..(1): n is a, c, t, g, unknown, or other
  misc_feature (2)..(2): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
nnaaaaaatttaacccccattaaaattaaaaccccnnnnnnnnnnnnnnnncccccctgcactctccgcggtggcggccgctctagaactagtggatcccccgggctgcaggaattcctctcacccctagaaaaatacccacagccaccgccgccgccgccgctccctgacccctagtgtccggatttaacttccaacatggcggacgtcgatgttgagccggaggtccccccccgtgctcccaaaaacaggaccttcccccagtacacctcccgcggccgccaaacctccaagcccctgctatgacttgcccccacgaccacctccatacggccttttctttttccccccccctggcggagcgtttctccacacccctttccaccgccgcaaccccccgggcgcctccatcctcacgcctgtgcgatagtttttgttttcccccccccccccaggcgggggggggcgcgcttaacaccccacccccccaccacatccccactgcattcctccaacaatattcctaacccatcggatttactcccacctgtcccactacgtcagagtatgagccacccgatatcttctctaacatcacccccccaccgcgctctccagacatcccccccctccatttcccgtgcgcctcccctccccccaccgaaaatcaaccctcttacaaagcattcactctcccccctccttgagtctctgttcgcccactcccccctcctaggctctcttagtcttagttccacaacacctccctctcctctcgctatagccccactgctccgcccgttcactactcctatcctccctctttctcccccccgcttata

SEQ ID NO: 59488 - DNA, 647 bp, Zea mays
  misc_feature: Ceres CLONE 1515923
tggcggccgctctagaactagtggatcccccgggctgcaggaattcgtctcacccctagaaaaacatctactagcagtgacaagaaacttccaagttactcagggaagaagggcaaaagatcgaagaggaagcgcatggtgcagtaatcgttgcagcataattggatgcgatttttgtcacaactggttaattcagctgaccagttaggtgccgtagtaatcatggagacagttttggtgggggccttttggaggcataaatctgaggtgcagacaattagacagtttccggggacacaagtatttgctgctaagctatccaatgaactagctcagtctcagtatatatgctttagacctgagggtaatggacaggagaacaggagtgcggtaaatgcacaagcagagagacaggatctgtagaggtaggcgagagatactccggtgtactctgtacatggttctaaaaaattgggcagaaactggaatggtccagacctttcatatacctttgtactagcccagttgtttgtacctaccccatttgccgctaccgggttggttgggtaaaaaattaaaaccaagggggggggggcccggggccgtttgccaaccggaaatccttattgaacaaaacctggatcccc

SEQ ID NO: 59489 - DNA, 665 bp, Zea mays
  misc_feature: Ceres CLONE 1515928
  misc_feature: Translation starting site: 141
  misc_feature (501)..(501): n is a, c, t, g, unknown, or other
  misc_feature (623)..(623): n is a, c, t, g, unknown, or other
aaagctggagctccccgcggtggcggccgcctctagaactagtggatcccccgggcctgcaggaattcgtctcacccctagaaaaaaaacaaaatccggcccggcccaacacctagtagcgtagctgaaaacctgagacgatggccgaatactaccacggcggcagggccatgtactccaacactgacgagtgctatgaccccggcaggcacggcggcagcgtgagggcgtactccgcgcaccgaccagtactacgacaaccgtggaacaccgcatgaggaggcccgcgtacggcgccgacgactgcggctgcggcggcaggcagaccgccgtgtacgccgacgaatactcccgcggcggccgctacgaaggctacggcgtcgagcacagccacccttcaagagggaggagaaggagcataagcacaaggagcgcctcggcgaggtgggcgccctcgcgggcggcgcctttgctctgtacgaggggcaccgtgcgaagaangacccggcgaacgcgcagaggcacaagatcgaggcccgcgtggcaacggcggcggcgctgggcgccggcggctacgcgtaccacgagcaccgcgagcagaaagaagcccactacaagaacangcagcagaagcacaggttgccgcaccggcacgggcacgggcc

SEQ ID NO: 59490 - DNA, 660 bp, Zea mays
  misc_feature: Ceres CLONE 1515934
  misc_feature: Encodes the peptide sequence at SEQ ID NO. 59491
  misc_feature (423)..(423): n is a, c, t, g, unknown, or other
  misc_feature (424)..(424): n is a, c, t, g, unknown, or other
  misc_feature (458)..(458): n is a, c, t, g, unknown, or other
  misc_feature (459)..(459): n is a, c, t, g, unknown, or other
  misc_feature (460)..(460): n is a, c, t, g, unknown, or other
  misc_feature (481)..(481): n is a, c, t, g, unknown, or other
  misc_feature (562)..(562): n is a, c, t, g, unknown, or other
  misc_feature (589)..(589): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (627)..(627): n is a, c, t, g, unknown, or other
  misc_feature (634)..(634): n is a, c, t, g, unknown, or other
  misc_feature (650)..(650): n is a, c, t, g, unknown, or other
aagctggagctccccgcggtggcggccgctctagaactagtggatcccccgggctgcaggaattcgtctcacccctagaaaaaatattatccacaacactcgtcgatctacacacatacatagtttcttctactacacgacgacaaacatggggaagcctgcgaagatcggagagtggggtggatacgccggcgatcgtcgggatctgagggctactccggaccggctgaccgaggtgaatgtcacggcggacaacagcagctgcatccgctccatctccttcatctacatcggagccgatggcaagccgtacgaggaggggccatggggtttccgccatgctggcgcggagtacaaaaaggatctgtgcaggttcgacgagagcttgacggaaatatccggaaccacgggcccagcccttcnnattgacaatcctggtccagtctctcaaatttgtnnnctaacaacgtccttacggaangttaatgcaagggacgaatgtgcaccccgtttccgggtcctatctaaggaacatacggccacctcccctgactttctttgncccctctgggaaatggcctggaatgtnannnggtgttttttttccttcccccacttaaggacccnaacccgngggatcacgcacctcntgcaatccct

SEQ ID NO: 59491 - protein, 170 aa, Zea mays
  misc_feature: Ceres CLONE 1515934
  misc_feature (92)..(92): Xaa is any aa, unknown, or other
  misc_feature (104)..(104): Xaa is any aa, unknown, or other
  misc_feature (111)..(111): Xaa is any aa, unknown, or other
  misc_feature (138)..(138): Xaa is any aa, unknown, or other
  misc_feature (148)..(148): Xaa is any aa, unknown, or other
  misc_feature (149)..(149): Xaa is any aa, unknown, or other
  misc_feature (160)..(160): Xaa is any aa, unknown, or other
  misc_feature (168)..(168): Xaa is any aa, unknown, or other
MGKPAKIGEWGGYAGDRRDLRATPDRLTEVNVTADNSSCIRSISFIYIGADGKPYEEGPWGFRHAGAEYKKDLCRFDESLTEISGTTGPALXIDNPGPVSQICXLTTSLRXVNARDECAPRFRVLSKEHTATSPDFLXPLWEMAWNVXXCFFSFPHLRTXTRGITHLXQS

SEQ ID NO: 59492 - DNA, 663 bp, Zea mays
  misc_feature: Ceres CLONE 1515935
  misc_feature: Translation starting site: 445
aaagctggagctcaccgcggtggcggccgctctagaactagtggatcccccgggctgcaggaattcgtctcacccctagaaaaaaacgcttcacacttcacagcccacatcaacaaatggccaggaaagaagtgacgctcctgctcttcctcgtgctgcttttcgcagccgtcgaggcacagctgcacgacgagcctacggcggccgctgtcggccacgccggcgggcggcggcggggcgcgaaggccgccacggcgccgacgcacctccacttcttcttccacgacacggtgagcggcaagtcgccgacggcggtgcgcgtggtgagcccgccggcgtcgtcgccgtcgcccgtgttcgggatggtgaacgtgatggacgacccgctgacggaagagccagagcaagggtcggccccccgtcggccgcgcccagggcctgtacatggggtccgaccaggccaagatcggcttcctgcaagccatgaacctcgtgttcaccgcagaggactacaacgggaggccgctcgcgctgctcggccgcaactggccgctcgacgccgtccgcgagctccccgtcgccggggggcacgggggctgttccgctttcccccgcggctacccgctgcttgccaacccacatgggtcgaacttcgcaacgggg

SEQ ID NO: 59493 - DNA, 659 bp, Zea mays
  misc_feature: Ceres CLONE 1515941
  misc_feature: Encodes the peptide sequence at SEQ ID NO. 59494
  misc_feature (392)..(392): n is a, c, t, g, unknown, or other
  misc_feature (394)..(394): n is a, c, t, g, unknown, or other
  misc_feature (395)..(395): n is a, c, t, g, unknown, or other
  misc_feature (400)..(400): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (584)..(584): n is a, c, t, g, unknown, or other
aaaagctggagctccccgcggtggcggccgctctagaactagtggatcccccgggctgcaggaattcgtctcacccctagaaaaaatccaccatcacacagcaatccacacaagcacttcgacgtcacacgggcgctgcgcacagacacaccaagcgtcggcaccaatggcttactaccaggaggtggactactgctcggaggaggtgaggtcggtggccccggccggcttcggccgccacggcggcggcgtccagcagcacgtcgtcaaggagaagttcgaggaggtcgacacggtctcacgcgccggcgccaaccaccatcaccaccatggtcaccacggcggccacggcttcgtggtgttccccccccccggtcgaaggaggggggggncnncctgnaccgnnntaattcccaccagcgcaggggaaaagcttcctcgcccggggctaactgagccggcccgggcgggccggcatccccccccgtttcctgcttgccctgcgtgccctaatgtatgtctgggggttgaacgggttgggcaggggccatcgaaattggttcgatcgacgggcacccactcanctgcgggtaaaaattacgacataaagcccgggggcctgaataaaaactcctccgaaaaaaaaaaaaaaaaaaaca

SEQ ID NO: 59494 - protein, 164 aa, Zea mays
  misc_feature: Ceres CLONE 1515941
  misc_feature (76)..(76): Xaa is any aa, unknown, or other
  misc_feature (77)..(77): Xaa is any aa, unknown, or other
  misc_feature (78)..(78): Xaa is any aa, unknown, or other
  misc_feature (80)..(80): Xaa is any aa, unknown, or other
  misc_feature (81)..(81): Xaa is any aa, unknown, or other
  misc_feature (140)..(140): Xaa is any aa, unknown, or other
MAYYQEVDYCSEEVRSVAPAGFGRHGGGVQQHVVKEKFEEVDTVSRAGANHHHHHGHHGGHGFVVFPPPGRRRGGXXXTXXIPTSAGEKLPRPGLTEPARAGRHPPPFPACPACPNVCLGVERVGQGPSKLVRSTGTHSXAGKNYDIKPGGLNKNSSEKKKKKN

SEQ ID NO: 59495 - DNA, 643 bp, Zea mays
  misc_feature: Ceres CLONE 1515944
  misc_feature: Encodes the peptide sequence at SEQ ID NO. 59496
ccgcggtggcggccgctctagaactagtggatcccccgggctgcaggaattcgtctcacccctagaaaaaacgcacctgctccattacccgtctgccgtcggcataacataatcgtcgtcgcgtgcagtccccattcccttttccagtggtctgttgctcgcgcttcgtccagcttccccggaagaggtagcacggcaagggcagaggatgagtgaccccaagtacgcctacccctaccccgcgcaaggttactaccaggggccgtaccagggcccgccggtgatggcgccgccgcagtacgccgcgccgccgcccagaagggagccgagcttcctggaaggctggtacgtattcccggccggccaactctctgaccctctctctattattcctctgccgcaagtttactgtgcaggctctgtcgtctctgtactgtgtggttaattccaagtgatggctctcgcttcatctgttacgttcttgcgccatcataatctaatcggttattctgcagcctggccgcgctgtgctgctgctgcttgatcgacgagtgctgctgcgacccgtccatcatcttcgtcagctagactagacgaggaagaacctattggtatatataatatgtatgtatccagttgtact

SEQ ID NO: 59496 - protein, 78 aa, Zea mays
  misc_feature: Ceres CLONE 1515944
MSDPKYAYPYPAQGYYQGPYQGPPVMAPPQYAAPPPRREPSFLEGWYVFPAGQLSDPLSIIPLPQVYCAGSVVSVLCG

SEQ ID NO: 59497 - DNA, 615 bp, Zea mays
  misc_feature: Ceres CLONE 1515945
  misc_feature: Encodes the peptide sequence at SEQ ID NO. 59498
  misc_feature (596)..(596): n is a, c, t, g, unknown, or other
  misc_feature (601)..(601): n is a, c, t, g, unknown, or other
caaagctggagctccccgcggtggcggccgctctagaactagtggatcccccgggctgcaggaattccgtctcacccctagaaaaactcacggcagctctgaagcgagaaagaagatcgatcgtattcgtatccgcggaacaagcagcgaaggatcggagcctatccaatggccgagggcaagagcagctccggcggcgacctgttctccagcggcaagctggtggcgggggccgccgtgtcggtgttccagcagaagagcgtggagaacgtcgacaagcaggaggtcgccggcgcggcggccgagctcctgcacgcggcgtccgcgtacggtaagctcgacgacaagccggccgggcagtacgtcgagaaggccgaggggtacctgaaggagttcagcgcgggacacgccaccgagcaggagcagcctgcggcggcagcaggcgacgacgcggcgcccaagtcaccggcgccggaggcgcccaaggagccggcggcggtgcctgcgccggccgcggaagaaggcagcaagtcgtccggaggggttcggccctcggcgacgtcatgaagggcgccgagcagctggtgggaggatanccccngggcggcgggggaa

SEQ ID NO: 59498 - protein, 132 aa, Zea mays
  misc_feature: Ceres CLONE 1515945
MAEGKSSSGGDLFSSGKLVAGAAVSVFQQKSVENVDKQEVAGAAAELLHAASAYGKLDDKPAGQYVEKAEGYLKEFSAGHATEQEQPAAAAGDDAAPKSPAPEAPKEPAAVPAPAAEEGSKSSGGVRPSATS

SEQ ID NO: 59499 - DNA, 659 bp, Zea mays
  misc_feature: Ceres CLONE 1515950
  misc_feature: Translation starting site: 342
atagctggagctccccgcggtggcggccgctctagaactagtggatcccccgggctgcaggaattcgtctcacccctagaaaaaaacacacaaatactgctcaggagcaactcatacacaggctcctctcccccgttgagaaacgcgctttccccgacttgacccgcctcggcgccatggctaatgtcgcggtggtgctcctcctcctgctggccgtggcaggcgtcctcgatcagccagcagcgacaaccacctggatatagacctgggattcctctcctctgacgaaccccagagggagtgccacggcacagtggccgactgcctccccgacgactccgatgatgagggccttgacctgcacggatcacaccgccacgagctctacggcggcgggtacatcaactaaggcgcgctgcggcgagacaacgtgccctgctcccgacgcggagacagctactacaactgccgccagggaggtcaggtcaacccctaccaacgcggatgctcccacatcacccattgtcgcgggtgaagaggctccagatccgctcgactgcacgagaaacgtctggttgatcaaagaccccgtcctgtccccgacaatatttctttccacttgatggattaggcgttaacgtcaccggaaatggtggtta

SEQ ID NO: 59500 - DNA, 608 bp, Zea mays
  misc_feature: Ceres CLONE 1515951
  misc_feature: Encodes the peptide sequence at SEQ ID NO. 59501
ggtggcggccgctctagaactagtggatcccccgggctgcaggaattcgtctcacccctagaaaaactcgagcctgacccttacgccttcgctcgcgccgccgccgccgccgccgctacgccccgcacctcgcttcgtttcgtgtcggcaagatgacgaagcgcactaagaaggcaggaattgttggcaaatatggaaccaagtatggtgctagcttgcggtaagcaaatcaagaagatggaggtatctcagcattccaagtacttttgcgagttctgtggaaagtttgctgtgaagacgaaagcagctggaatttgggggtgcaaggactgtgggaaggtgaaagctggtggtgcttacaccatgaacactgctagtgcagtcaccgtcaggagcacgatacgccgcctgagggagcagactgaaccatgaaatagctctttatattattggggtttccgttaatttgcttcttgccccgggatgcttgggggggccctttttctgggggacaaatgtggaaatcccctgggaacgggggtgctttttggccaaaaacacaagggcccccttaaaatattcggaaaaaaagcctcccaaccgctcta

SEQ ID NO: 59501 - protein, 79 aa, Zea mays
  misc_feature: Ceres CLONE 1515951
  misc_feature (7)..(78): Pfam Name: Ribosomal_L37ae Pfam Description: Ribosomal L37ae protein family
MEPSMVLACGKQIKKMEVSQHSKYFCEFCGKFAVKTKAAGIWGCKDCGKVKAGGAYTMNTASAVTVRSTIRRLREQTEP

SEQ ID NO: 59502 - DNA, 467 bp, Zea mays
  misc_feature: Ceres CLONE 1515958
gctctagaactagtggatcccccgggctgcaggaattcgtctcacccctagaaaaaacactcaccgcaccaccgaccactgcctccgtacgcgtccctctggcggaaaatcggtcctagtgccgagctcgttttgtttggatcttctgtatatctattaaggaggcttctccatctcctcggagcagcaaggctgtgcagcaatggagaagtataacagcaacactcaatttgcaccattgaagaaaaactccgttttgcccctccgggggggctccttggtaagttaaagctctatatcttgacaaagccggggggtaacaatctttccctgggtaaaaaattttggccccccaaagatagttcctaccccccggggaaaaatccacaccccccggggaaataaaaaaaaagtttcccccccccccggggggaaaaaaccccggggggggggaaaaaataaaaaaa

SEQ ID NO: 59503 - DNA, 638 bp, Zea mays
  misc_feature: Ceres CLONE 1515962
  misc_feature: Encodes the peptide sequence at SEQ ID NO. 59504
aaagctggagctccccgcggtggcggccgctctagaactagtggatcccccgggctgcaggaattcgtctcacccctagaaaaaagcgggtacccattgccatctgtgccaggcgaaaaacgtagcctcgcactctcgcaggcggcggcgcatcgagaaacagggcggcggcggttgcttcttccacctctccggccatccggcggtccatcgttccgtgccggcggcctcccctcctacgcccctgccgattcttcaatcttcaccaacgtctgcgcgtagcaggctagcagtcagcacggcttcctcagatctgccggacgacttgctgttcgtcaccgactcaccagcaaccaacgtcagccatcagccagcagcaggggaagctgggcggagggtcattgcggcacggcgtccaggcgtacagcaggcaccagcaacagcccatggcaaacgccgcagatgaccctatggcagatgaagccggagtagaagatgccttcacacaggagatcaatcattcgtacgtccctagataccatgtgttgagttggatggaaactgtggaggggatggtggccagtgtggcctcgcttccgcgagttatttgagtttgtaacaatctcgtcgcgcggcct

SEQ ID NO: 59504 - protein, 54 aa, Zea mays
  misc_feature: Ceres CLONE 1515962
MANAADDPMADEAGVEDAFTQEINHSYVPRYHVLSWMETVEGMVASVASLPRVI

SEQ ID NO: 59505 - DNA, 658 bp, Zea mays
  misc_feature: Ceres CLONE 1515965
  misc_feature: Encodes the peptide sequence at SEQ ID NO. 59506
tacccgcggtggcggccgctctagaactagtggatcccccgggctgcaggaattcgtctcacccctagaaaaaagcctccacccctcacccgccgcagccaatccctccccagcagccgtcgtcgccaccgctgcagcgcggaggcgaccccccatcgccgccaagatgcagatcttcgtgaagaccctgacggggaaaacgatcacgttggaggtggagtcctcggacaccatcgacaacgtgaaggccaagatacaggacaaggagggcatcccgccggaccagcagcggctaatcttcgccggcaagcagctcgaggacggccgcaccctcgccgactacaacttccaaaacgactccacggtggggggggggtccccctcacatgtgcccccacatttgcttgaagaagacgtaacccatgcctaaaagatcgggcggaggcccaggaaggaaagctcgcactgctgcccctcctaaaggtggaacaagccacccgtaaggggacccccccccctagtgaagtgcccccaaaacgagtgccgtctgggattcacttcctttccaagcaatttttaagcgtgctctactgcgagcatatgagggccattgcttaagttctaccttttggggagtagtatataccattgttgtcag

SEQ ID NO: 59506 - protein, 87 aa, Zea mays
  misc_feature: Ceres CLONE 1515965
  misc_feature (6)..(74): Pfam Name: ubiquitin Pfam Description: Ubiquitin family
MQIFVKTLTGKTITLEVESSDTIDNVKAKIQDKEGIPPDQQRLIFAGKQLEDGRTLADYNFQNDSTVGGGSPSHVPPHLLEEDVTHA

SEQ ID NO: 59507 - DNA, 640 bp, Zea mays
  misc_feature: Ceres CLONE 1515966
  misc_feature: Encodes the peptide sequence at SEQ ID NO. 59508
  misc_feature (576)..(576): n is a, c, t, g, unknown, or other
  misc_feature (640)..(640): n is a, c, t, g, unknown, or other
cgcggtggcggccgctctagaactagtggatcccccgggctgcaggaattcgtctcacccctagaaaaagagctctctctagcattacccggcggcggaagcgtaagcgcaaaacgaagcaagcggccgccatggtgaagggacgcacgggacagcgcgtcaggctctacgtccggggcaccatccttggatacaagaggtccaagtcgaaccagtacgagaccacgtctctcgtgcagatcgagggggtgaacaccaaggaggatgtcgcgtggtacgctggcaagcgcatggcgtacatctacaaggccaagaccaagagcaatgagacccgctacaggtgcatctggggcaaggtcacccgtccgcacggaaactcgggcgtcgtccgtgccaagttcaagtccaacctcccgcctgagtccatggggcgcaaggtcagagtgttcatgtacccgagcagcatctaaagttttgttggagtaaagatggactagaaatggccatgtgtttatttctcacttttctctgaacttaaaatgcccttgtgtgggtacttagattgggtcagtgctngaacctgtggaagtgtgccaaaatttgttgtcgaaacgatgaactattgtcgtaatggtatgcn

SEQ ID NO: 59508 - protein, 112 aa, Zea mays
  misc_feature: Ceres CLONE 1515966
  misc_feature (12)..(106): Pfam Name: Ribosomal_L35Ae Pfam Description: Ribosomal protein L35Ae
MVKGRTGQRVRLYVRGTILGYKRSKSNQYETTSLVQIEGVNTKEDVAWYAGKRMAYIYKAKTKSNETRYRCIWGKVTRPHGNSGVVRAKFKSNLPPESMGRKVRVFMYPSSI

SEQ ID NO: 59509 - DNA, 643 bp, Zea mays
  misc_feature: Ceres CLONE 1515984
  misc_feature: Encodes the peptide sequence at SEQ ID NO. 59510
  misc_feature (278)..(278): n is a, c, t, g, unknown, or other
  misc_feature (376)..(376): n is a, c, t, g, unknown, or other
  misc_feature (377)..(377): n is a, c, t, g, unknown, or other
ctagaactagtggatcccccgggctgcaggaattcgtctcacccctagaaaaaacaacgcaccgtcgtctactcgtctcccacaacacggtccactaaccctagcgacagcctcggctcgtttgatccccgcggggagctctagttccgccaagcgtgcgtaccggcgtccggatccgggaccgaagatgacggagtccctggtgcggaacaagccggggatggccagcatcaaggagatgccggtggtgcaggacgggccgccgccgggcggtttcncgcccgtgcgcttcgctcgccggatcccccactcgggggccagcgccatcgtcatcttcccccccccctgggggggggggggatatggcatgtaccanntccggcctggggaacaaggtccgcccggcgctccaagaagagagaggtgctggctcccatgctatactggccaaggctccaaaccaaaaaaggatgaaagattttgtccaaaatgggaaaaagggctcttggggaggaaggggaggagtcttcaaaaacgttccccgggtggaaaggctcccaaaaagggtgaacacctccgggggaaatgtaagccgcccgggtacggggggggcttcccccccgagggttagggtgaggcccgg

SEQ ID NO: 59510 - protein, 147 aa, Zea mays
  misc_feature: Ceres CLONE 1515984
  misc_feature (31)..(31): Xaa is any aa, unknown, or other
  misc_feature (63)..(63): Xaa is any aa, unknown, or other
  misc_feature (64)..(64): Xaa is any aa, unknown, or other
MTESLVRNKPGMASIKEMPVVQDGPPPGGFXPVRFARRIPHSGASAIVIFPPPWGGGGYGMYXXRPGEQGPPGAPRRERCWLPCYTGQGSKPKKDERFCPKWEKGLLGRKGRSLQKRSPGGKAPKKGEHLRGKCKPPGYGGGFPPEG

SEQ ID NO: 59511 - DNA, 588 bp, Zea mays
  misc_feature: Ceres CLONE 1515988
  misc_feature: Encodes the peptide sequence at SEQ ID NO. 59512
atagctggagctccccgcggtggcggccgctctagaactagtggatcccccgggctgcaggaattcgtctcacccctagaaaaagcacatccggacatcgatccccactagccagggcgtgtaagcgggcgagcgagcgagaggaaaagccaaggcggctgcagcaggcagccaccatcaatatagaatgtccgaaccaagcatgtcgggggtgtgggtgttccggaacggcgtggtgaggctggtggagaaccccacctcggggaacgcggcggcggctccaggcaagcgcaaggcgctgctgcacacgccgtccggggaggtggtctcgtcctacgcctcgctggagcgcaagctggcggcgctcggctgggagcgctactacgccgagctcggagaccgcggctgcgccggcctgctgcagtaccacaagcgcacctccgtcgacctcatctcgctgcccaaggacttcgcccacttcggctccgtccacatgtacgacatcatcatcaaaaaccgcgacgccttcctcgtcatcgacgcctaattataagctagcggatgcaccagatgacagatactcacctc

SEQ ID NO: 59512 - protein, 114 aa, Zea mays
  misc_feature: Ceres CLONE 1515988
MSGVWVFRNGVVRLVENPTSGNAAAAPGKRKALLHTPSGEVVSSYASLERKLAALGWERYYAELGDRGCAGLLQYHKRTSVDLISLPKDFAHFGSVHMYDIIIKNRDAFLVIDA

SEQ ID NO: 59513 - DNA, 792 bp, Zea mays
  misc_feature: Ceres CLONE 1515990
  misc_feature: Encodes the peptide sequence at SEQ ID NO. 59514
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
nnnnnnnnnnnnnnnnnnnnnnnnnnnnnnnnnnnnnnttgcctttgtggccaaagctggagctccccgcggtggcggccgctctagaactagtggatcccccgggctgcaggaattcgtctcacccctagaaaaaagtcagccgccatcaccgctgttaggttctaccccgagaccttcggcgtccctccggccacacgagctcgccgaaatggtcgcccacaggttccatcggtacctggtggtgggtcgcgcgctgcctaccccaaccgatgagcacccaaagatctgccgcatgatggtctgggccaccaaagaggttcgcgccaagtccaagttctggtactttcctgaaaaagctcacgaaggtgaataagagcaatggccagatgcttgccatacaacgagattctttgagcgccaaacccgaccaccatcaagaactatggcatcctggctgcgctacctgagcaaggactggttaccacaacattgttacaagggaggtacccttgaccaccacccctgaaacggcggcaagtggtaccagatgctacaaaccgaaaatggaccttcccgccaaccggtgtgaaggttccctccctgcatactttatttgtccaaaaacaggctgaccggttcccaatttccaaagctggtggccaaacaggagcacaaactcctcgaagttgtgtttccaccaaacttccccaaaaatacaaaatttcccccccctatgttgtaccccccaaagggttaccacgccccccccttacccagcggaaggcttcc

SEQ ID NO: 59514 - protein, 54 aa, Zea mays
  misc_feature: Ceres CLONE 1515990
MVAHRFHRYLVVGRALPTPTDEHPKICRMMVWATKEVRAKSKFWYFPEKAHEGE

SEQ ID NO: 59515 - DNA, 564 bp, Zea mays
  misc_feature: Ceres CLONE 1515991
  misc_feature: Encodes the peptide sequence at SEQ ID NO. 59516
  misc_feature (382)..(382): n is a, c, t, g, unknown, or other
tggagctccccgcggtggcggccgctctagaactagtggatcccccgggctgcaggaattcgtctcacccctagaaaaaatcagaggaagcacaaaacaccaccatcgccatgagatgagagccaagcagagtagtagagggagagaagttgtggccgccgcgttgaaactgagcgaggaggagaggacggctcctgcagccggggtgcccgtggtgcggacttcgctgggtgaccggggttcaccggtggagctcgtgggatttgtcatcagggcttgaagcacgctgcgtttccgccctacgccgcgctggttgaggacgacaccaatcaccgcgatgttacgagtcacctgaagagcaagttggtacctagaatctcangtcccaggtcaaagacagggtacccagggatgaggcccattggaggatgctgcaatgtggttctgaaaagtctagggtcgttgtcctcccaatccaacttttgggtttgctggaacccgtttcccccccttaaaaagggaaatttttttttttttttttaagaaaacccccggggtttggga

SEQ ID NO: 59516 - protein, 54 aa, Zea mays
  misc_feature: Ceres CLONE 1515991
MRAKQSSRGREVVAAALKLSEEERTAPAAGVPVVRTSLGDRGSPVELVGFVIRA

SEQ ID NO: 59517 - DNA, 633 bp, Zea mays
  misc_feature: Ceres CLONE 1515993
  misc_feature: Encodes the peptide sequence at SEQ ID NO. 59518
aaagctggagctccccgcggtggcggccgctctagaactagtggatcccccgggctgcaggaattcgtctcacccctagaaaaaagaaaattctctcttctccttctcctcctcctcctcctcctcctcttttttcccctaacaaacaagatgccggagctcacaagcaaaatctcatgggcctgcctgacctacctgcccggacctgacatgatccaccgtgcgaaatttccaggggctactaccgctgcacgcacaagagctctcagggatgtgcggcgacgaagcaagtgcagcgcaccgacgaggacccggccttcttcgacgtcgtctacctcggcgaccacacctgcgttcagagccagagggcggcagcgacggcgggtcgtcaggctgccgcggacgcgcaggcgccggagtacgacgccaacctcatggtgaagaccgaggggccggccctggagccagagcagcagcggcggggctgggaggacgcgcccacgccctttctcttctcctccacgccggcgtgccttgtgccggagcgcagccccttctccgcaccgtccacgtccgagaactggggcgtgtccccggcgacctcggactcccaccacgtcgtctctttcccgc

SEQ ID NO: 59518 - protein, 66 aa, Zea mays
  misc_feature: Ceres CLONE 1515993
MVKTEGPALEPEQQRRGWEDAPTPFLFSSTPACLVPERSPFSAPSTSENWGVSPATSDSHHVVSFP

SEQ ID NO: 59519 - DNA, 652 bp, Zea mays
  misc_feature: Ceres CLONE 1515994
  misc_feature: Encodes the peptide sequence at SEQ ID NO. 59520
  misc_feature (652)..(652): n is a, c, t, g, unknown, or other
ccccgcggtggcggccgctctagaactagtggatcccccgggctgcaggaattcgtctcacccctagaaaaagtccacagatcggaggagagcactggcttgtcttcctctctcgtctccagcgacggctgcgggcgagggttacgcgaaggcgaagcggagtattggaagcagaggcggcagccatggccgtgatggataagctcatgatctttgtcggtaaggagcccgtagtcgcggcctcctgcctcatcgctggattcggtctctttcttccagcatttgtccggccaatcctggattcatggccgaccgcggaacaagttcctccgcctcttctaaatgatgtggttgcaggtgtcaccggcaagaagaagtagtgaacttgcattgttttctcatgccaatgttgccccacattatcttccccgtgttttttctggcgaccagattgcaacgcttttcccaagagtcgcggtcttgaactctagatggcatccgcggaataatcattgtacctgaatcatatactgcaatgtggcagttttgaaaatgtttcccctcctacgaaggttgatagaacgccctaccctttgacctgggttctagacaggtcatgacctgactgttgctgacaatttggagaacccan

SEQ ID NO: 59520 - protein, 64 aa, Zea mays
  misc_feature: Ceres CLONE 1515994
MAVMDKLMIFVGKEPVVAASCLIAGFGLFLPAFVRPILDSWPTAEQVPPPLLNDVVAGVTGKKK

SEQ ID NO: 59521 - DNA, 663 bp, Zea mays
  misc_feature: Ceres CLONE 1515997
  misc_feature: Encodes the peptide sequence at SEQ ID NO. 59522
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (606)..(606): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (647)..(647): n is a, c, t, g, unknown, or other
  misc_feature (659)..(659): n is a, c, t, g, unknown, or other
aaagctggagctccccgcggtggcggccgctctagaactagtggatcccccgggctgcaggaattcgtctcacccctagaaaaattgacccgccgcctctacgcccctccagtctcctctgtcatggccggcggcaaactattcggtcgagcgctgagctacgttgtcaaccagttcctcgtcgagggcctcgccaacaaccgtgcagtccagaggtttgctgtgaagaccaacaagactcttgagagcctatcgtctaaagccaaggaaatgagggaggagttatcggaacaattcaaggatgctcgtggccagaaagatcacttcaagcagtgaagccgatccccaaagttgattcaacgacacgaatctagctatgagttttttctagttctcgtccgggtcctatttatgaatggcatttgaagggatttcttggtgtcgttcaatggacggatccgttgtataaagtttatctgcacttagattagtagatatattggtagacacatcactttctgctgcccctttttcataaatacatatatctcgatctctactgtattagcaaaaannnnnnnnnnnnnnnnnnnnnaaaaaaaaaanaaaaannnnnnnaaaaaaaaaaaaaannnnnnnnaaaaaanaaaaaaaaaaanggga

SEQ ID NO: 59522 - protein, 70 aa, Zea mays; identical to SEQ ID NO: 51958
  misc_feature: Ceres CLONE 1515997

SEQ ID NO: 59523 - DNA, 820 bp, Zea mays
  misc_feature: Ceres CLONE 1516000
  misc_feature: Encodes the peptide sequence at SEQ ID NO. 59524
  misc_feature (16)..(16): n is a, c, t, g, unknown, or other
  misc_feature (35)..(35): n is a, c, t, g, unknown, or other
  misc_feature (36)..(36): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
tttttttttttttttnttttttttctgccccgccnntttttnnnnnnnnnnntcaaactgggactccccgcggtggcggccgctctagaactagtggatcccccgggctgcaggaattcgtctcacccctagaaaaaatttgcagctagcttagctttggtttcctctgcttctcattctcccgtgcacttccagttcctgcccagctgcagggctgctccaatggccaccttgtccgccatctctgccaacgtcggctactgcaaggcaccaaccctgagctggaagggaagcggagtaccatgccggattgtggtctccatgtccaccacccgaataggcctcgtctccctaagacaactaacccctcggtttcccgtctacccggacaaagggggtaaaggtggaccaatttgtagccccctcggtggaggggggggggggggcgctggaggcctaaacttatgcccccaactcccgcagccccgccccccaccggaacccacaacaacccacacaccgttgggacaactatgtggaagattacgtaaataatctccttggatgtcagggacatcctctcaaaccaacacaaataccaacaacaaccaaattctaaacaaagaggtggcccgcctgaccaaggaattgaatggaaacacgggagaatccggtagcaaaaaaccatataggggagtaaaaaaagaaaaacccatcaaggtaaccctcgcacagaccccgtttgcccataatggtcccccaccgctcccccacccccacccacccccccccacctataacgtggcttcctctccccaag

SEQ ID NO: 59524 - protein, 110 aa, Zea mays
  misc_feature: Ceres CLONE 1516000
MATLSAISANVGYCKAPTLSWKGSGVPCRIVVSMSTTRIGLVSLRQLTPRFPVYPDKGGKGGPICSPLGGGGGGGAGGLNLCPQLPQPRPPPEPTTTHTPLGQLCGRLRK

SEQ ID NO: 59525 - DNA, 662 bp, Zea mays
  misc_feature: Ceres CLONE 1516001
  misc_feature: Encodes the peptide sequence at SEQ ID NO. 59526
tggcggccgctctagaactagtggatcccccgggctgcaggaattcgtctcacccctagaaaaagctattcgtgtcctggcatccgcagagagtttgttccgtccaggcaaccaaaaagcgttgccccgccgcgcagaggaagaagagagcagaggaggatggctcgtacgaagcagaccgcccgcaagtccacgggaggcaaggccccccgcaagcagctcgccaccaaggcggcgaggaagtcggcgccgacgaccggcggcgtgaagaagccccacaggtacaggcccggaaccgtggcgctgcgcgagatccgcaagtaccagaagagcacggagctgctgatccgccagctgcccttccggcgcctggtgcgcgagatcgcgcaagacttcaagacagacctccggttcccgagccacgccgtgctggcgctccaggaggccgccaagggctacctcgtccgcctcttcgaggaacccaacctctgcgcgattccacgccaagtggcgttaccattcatgcccaagggaattccgtgttcgccgcagcggaattcgttggacgaatatccccgtaattccattcgctctcccaagggaacccgaatgaaattggcttgggatgccggtgaagctatttggggtcgggaagttatatg

SEQ ID NO: 59526 - protein, 167 aa, Zea mays
  misc_feature: Ceres CLONE 1516001
  misc_feature (58)..(133): Pfam Name: Histone Pfam Description: Core histone H2A/H2B/H3/H4
MARTKQTARKSTGGKAPRKQLATKAARKSAPTTGGVKKPHRYRPGTVALREIRKYQKSTELLIRQLPFRRLVREIAQDFKTDLRFPSHAVLALQEAAKGYLVRLFEEPNLCAIPRQVALPFMPKGIPCSPQRNSLDEYPRNSIRSPKGTRMKLAWDAGEAIWGREVI

SEQ ID NO: 59527 - DNA, 521 bp, Zea mays
  misc_feature: Ceres CLONE 1516007
  misc_feature (110)..(110): n is a, c, t, g, unknown, or other
ccgctctgaactagtggatcccccgggctgcaggaattcgtctcacccctagaaaaactctctctccccatccgcgccagtccaaccaagtcagcaccccgcggcgcggnaaaggaagttccacgcccatggcgagcaccacatggcgtcggccacctcgcggttcatgcttgcccgcggggcgttgcccaccccccaagtaacggggcaaaggggggccccgtttaaatttttcccctcggggccccaaacgggttttggaaagagaagcttttgtttccccgggcccaaaaaaaaaaccccccggaaaaacccgggcccccaaagggcaaaagggagggggcccccggggcccccaaacccaagggggaaaaaaacccccccccaaattgggcccaaaaaaaacgcccccggggagaaaaatttctgggggggggggtcccttttggttttaaaagggggttgtggaaaatttttccccccccttatatatggtttttttaccccgcgtatttcggggg

SEQ ID NO: 59528 - DNA, 582 bp, Zea mays
  misc_feature: Ceres CLONE 1516011
caccgcggtggcggccgctctagaactagtggatcccccgggctgcaggaattcgtctcacccctagaaaaactcaccactcatcaccagctagtagctctagcaaagcacttgccatctaccgaccgccgcattcaaacagcccgacgagctagcagagcggcaggcactcctcaggaaatgcccgacgagcattggcatatggcgacagcgtgtggccttggggctgctgggggcggaaactcggaggcggccttcatctggggcagggggggtcggccaacccgcccctgtatttccttagggcggggcagggggtacaaggccccccccccagtttttttccccccccctctttagggggggggggggagagagacttcctccgaaacgacaggggaaaaaaggggtgggcccctgtgagaaatatttccctaaaaaaaaaccgcgcccccccgaggggggccaacacgtgaccaataaagatggggcgagaaaaaaaccactaaaaaaaaattaactttctccccaagggggggtggggggaaggataaggcaaccccagccaaagaaaaaaagagt

SEQ ID NO: 59529 - DNA, 630 bp, Zea mays
  misc_feature: Ceres CLONE 1516019
  misc_feature: Translation starting site: 419
  misc_feature (617)..(617): n is a, c, t, g, unknown, or other
aaagctggagctccccgcggtggcggccgctctagaactagtggatcccccgggctgcaggaattcgtctcacccctagaaaaaaagacctgcctccattcccgagtctccttccaaccgcgtctcgtccgccccatccccctcggcccctgctacctctattcccgacccggtggcgccctccgccgagaagattcctgcggacaagaagcccgcggccgaggattgggcggagaatacgacctcacgttacaagccccatgccgagaagcgcctgccctcctcgaagtcctccggcactgacggctgcgatgagaaggggaagaacatcgcctgctagatcgtggagacctacaaaatcctcctcttcaaggtcccgaaactagtggaccgctacctcggcatctcctccttggacatgtccatcatgaactccttcctcaagacatcttctataagctcgtcgggcatgcagctaatctctcccggtacgagtttactcccaccatcacgtcgcgggagatgcatagctacgtgcatcctcgtcctcgcaggtagagctcgccaactccgccctctccgatggaaccaacgtcgtctccccagttcacctgcanatggatcggcctc

SEQ ID NO: 59530 - DNA, 651 bp, Zea mays
  misc_feature: Ceres CLONE 1516028
ccccgcggtggcggccgctctagaactagtggatcccccgggctgcaggaattcgtctcacccctagaaaaatcttctcccctgcgacaaacaccagtcaagcgcttgcctctccctagtccagaccctcgccgagtcatatcctgcttcctcgctccgtcgacccgatgccgttcacgccatgccccctgactctggctcccccaacctaacccttgtggcgacggcgcctccctctgctgcctctgtcagccacgggcagcactccgctctcacccctcacggtcacaaaaccttcaacggagaaagtcgcatgaatcctcacatacacgatgacacggctgctaactcgtcaattcctgaaatatgcctcgacgtaataaccttggcagatgcaccccttacccaacttcgcgtttcctttctcatttaaggactgctccgtcaacatacctgctgctgtgtggcgcgtcgtacaggttctcatacgctgactgactgacctgaacctcctgactgtaaaaagcggacctcatgagccgccgcagccgggcccgcgcggctagatctaagctcagcttctccatttgcatggtctagtagcttgctttgtactgctagcgaaggtcgatccgtcgcaatcgtcttggg

SEQ ID NO: 59531 - DNA, 643 bp, Zea mays
  misc_feature: Ceres CLONE 1516029
  misc_feature: Encodes the peptide sequence at SEQ ID NO. 59532
  misc_feature (547)..(547): n is a, c, t, g, unknown, or other
aaaacctggagctccccgcggtggcggccgctctataactagtggatcccccgggctgcaggaattcgtctcacccctagaaaaactacccaaacccaacaggcggcgcagcagcatcgccaccaccgtccaaagagcaaagatggtgaagttcctcaagcccggcaaggccgttatcctcctccagggccggttcgccggccggaaggccgtgatcgtgcgcgttttcgaggagggcacccgtgatcgtccctacgggcactgcctcgtcgcgggcctcgctaagtaccccaagaaggtgatccgcaaggactccgccaagaagacggccaagaagtcccgcgtcaagtgcttcatcttgctcgccaacttcacgcacctgatggccacccgctacaccctccacatcgactttaaggacgtcgcatcgggcgggcccgacacgctctccacccgggacaagaaggtcaaagccttgcaacgcccgccaggcgcccctcgaagaaagggtcaagaccggcaagaacaggtgggttctttaccaaantcctcttctagaaatcgggagtccctcaaaagggcctaaaacaagctgccaaattccttagaccggacacccctttaaagaaatccccgagatttg

SEQ ID NO: 59532 - protein, 147 aa, Zea mays
  misc_feature: Ceres CLONE 1516029
  misc_feature (52)..(112): Pfam Name: Ribosomal_L27e Pfam Description: Ribosomal L27e protein family
  misc_feature (7)..(40): Pfam Name: KOW Pfam Description: KOW motif
  misc_feature (135)..(135): Xaa is any aa, unknown, or other
MVKFLKPGKAVILLQGRFAGRKAVIVRVFEEGTRDRPYGHCLVAGLAKYPKKVIRKDSAKKTAKKSRVKCFILLANFTHLMATRYTLHIDFKDVASGGPDTLSTRDKKVKALQRPPGAPRRKGQDRQEQVGSLPXSSSRNRESLKRA

SEQ ID NO: 59533 - DNA, 824 bp, Zea mays
  misc_feature: Ceres CLONE 1516032
  misc_feature: Encodes the peptide sequence at SEQ ID NO. 59534
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (40)..(40): n is a, c, t, g, unknown, or other
  misc_feature (41)..(41): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (714)..(714): n is a, c, t, g, unknown, or other
  misc_feature (794)..(794): n is a, c, t, g, unknown, or other
nnnnnnnnnnnnnnnnnnnnnnnnnnnnnnnnnnnccccnnccttannnnaaaacggtggagctccccgcggtggcggccgctctagaactagtggatcccccgggctgcaggaattcgtctcacccctagaaaaagagccacggagagcaaaggcagcacactcagctatccagcaaaagagatcgagaggcaggagtcatggccaccgtcagcgccgccgtggtgaccaccatcgttgcccgcgccgcgatcgccaggcccaatgctctagggctgcctgcgctgagggcgaggagcgagagggtgcggtgcaactacgccaaggacgcggccccagtcagcaccaagggcgcaggcgcgtcgctgctcgccgcagcgggcgcggggaccagcatcggcgggggcccgcgctgggcgctcccgcacaagcggaggggggcgggaggggacccgggcttgagcctcggggctcaagcaacaaccatggctggggggggatcctcctgggggggtcttccgggcgccatcctgggtacccgccgagagccatcctgacccctcttgggcctgccggcggagggccaaaaaaactccccgggggggccttctgggaatcagagagaacccccccgacccgtggcgatgggagaaaggggagggggagggggtacgaggcgggggggcgtgggtgggcggccggcggcatagtggngccccccagtgggcgcggcgttggcgggcgcgctaaggagaggggggggtcgttctggggggaagagagggagaaaaganagaagtagagaaaaaagaccagtggaagag

SEQ ID NO: 59534 - protein, 118 aa, Zea mays
  misc_feature: Ceres CLONE 1516032
MATVSAAVVTTIVARAAIARPNALGLPALRARSERVRCNYAKDAAPVSTKGAGASLLAAAGAGTSIGGGPRWALPHKRRGAGGDPGLSLGAQATTMAGGGSSWGGLPGAILGTRREPS

SEQ ID NO: 59535 - DNA, 544 bp, Zea mays
  misc_feature: Ceres CLONE 1516034
  misc_feature: Encodes the peptide sequence at SEQ ID NO. 59536
  misc_feature (96)..(96): n is a, c, t, g, unknown, or other
  misc_feature (97)..(97): n is a, c, t, g, unknown, or other
ggtctccccgcggtggcggccgctctagaactagtggatcccccgggctgcaggaattcgtctcacccctagaaaaaaagccagacataagacagnncccgtcagcccctctcgtttttcatccgccttcgcctccaccgcgtgcgctccacgcctcctccaggaaagcgagagcttctgcataagaacaacaaatcaaaagcttgatcagctcggtgccaacaaaaccctcacaaccaagtttcatgtctgatctcgacgtccagctttcatctgcctttgatccgtttgctgaggcaaatgctgaggactctggtgctgggcctggaaccaaagaatatgggcatgtgcggcatccgcaacgcaacggcgaaaagagtctgaactacagttccagggtctgaaaaaaaggatttccacctttaaaaaaaaacccccccaggggatctttaaaaaaaaaggaatttccccgccccgccacagggggggcccccgtgtggttttttcccggggggccccccccaaaaatcttttttgggccccg

SEQ ID NO: 59536 - protein, 52 aa, Zea mays
  misc_feature: Ceres CLONE 1516034
MSDLDVQLSSAFDPFAEANAEDSGAGPGTKEYGHVRHPQRNGEKSLNYSSRV

SEQ ID NO: 59537 - DNA, 654 bp, Zea mays
  misc_feature: Ceres CLONE 1516035
  misc_feature: Translation starting site: 128
gcggtggcggccgctctagaactagtggatcccccgggctgcaggaattcgtctcacccctagaaaaaacggagagcaaaggcagcacactcagctatccagcaaaagagatcgagaggcaggagtcatggccaccgtcagcgccgccgtggtgaccaccatcgttgcccgcgccgcgatcgccaggcccaatgctctagggctgcctgcgctgagggcgaggagcgagagggtgcggtgcagctacgccaaggacgcggccccagtcagcaccaagggcgcaggcgcgtcgctgctcgccgcagcgggcgcggtgaccgcgtcggcggggcccgcgctggcgctcgtggacgagcgcatgtccccgggagggcaccgggctgagcctcgggctcaccaacaacctgctggggtggatcctcctgggggtcttcggcctcatctgggccctctacaccatctaaaccttctaacctccaacaagaacgaggagtccgggtggccctctcccctctaaatcccccctcctctcctgttaaatgatctggaatggtaaacctgggtgggggggccctccgggggtaaaattttaaaaacttgggtttttttgcctcctaaaaaacccctccccccccccgggtaaaaaaaaggggt

SEQ ID NO: 59538 - DNA, 693 bp, Zea mays
  misc_feature: Ceres CLONE 1516040
  misc_feature: Encodes the peptide sequence at SEQ ID NO. 59539
  misc_feature (458)..(458): n is a, c, t, g, unknown, or other
  misc_feature (459)..(459): n is a, c, t, g, unknown, or other
  misc_feature (483)..(483): n is a, c, t, g, unknown, or other
  misc_feature (604)..(604): n is a, c, t, g, unknown, or other
aagctggagctccccgcggtggcggccgctctagaactagtggatcccccgggctgcaggaattcgtctcacccctagaaaaaatccatctccgttgagtcgaggcggctccaactccggctcgtggcctcgcggaccaacatggccgccccttcgccctcgccggtggaggctaccctaccgcctgaggccgcggctgccgccgaggaagaccagtgggatgctgacggatatgtcattcctaatttgcccactcaagataatgatgtggctgagcctagtgtccccaaagaaaaagatcctgagcctctacaggcaaacgatgagaaaatatacttgggacctcatggagctccaccatctcaagcaaagcagcaggagctgaacaccgttggccgcaagcagcggttccggaaacagctgaaagaagcagataggaaattccccggcatgctcanngagaacaggtggagaaccctaggnagctgatgggtgctagaggtggtaccagccctgcaaagagctctcctcgtgattggctcgacccgcactgccatgaatctgaattcgacggaaaactactagatgacgggcaacgatgcancgtgcgttaacctgaaaggtgataccctgaacccctgggcgcaggggtattccgccaataacgaaacttagggttaactcgaacctctc

SEQ ID NO: 59539 - protein, 115 aa, Zea mays
  misc_feature: Ceres CLONE 1516040
  misc_feature (106)..(106): Xaa is any aa, unknown, or other
MAAPSPSPVEATLPPEAAAAAEEDQWDADGYVIPNLPTQDNDVAEPSVPKEKDPEPLQANDEKIYLGPHGAPPSQAKQQELNTVGRKQRFRKQLKEADRKFPGMLXENRWRTLGS

SEQ ID NO: 59540 - DNA, 697 bp, Zea mays
  misc_feature: Ceres CLONE 1516042
  misc_feature: Encodes the peptide sequence at SEQ ID NO. 59541
aaagctggagctccccgcggtggcggccgctctagaactagtggatcccccgggctgcaggaattcgtctcacccctagaaaaaagatgcgcaaacatcgaatcgtctcgctagtggctgccctactcgtgctgcttgccctcgccgccgtttcctccacgcgcagcgcacaaaaggagtccgcggctgacaacgccgggatgttggcaggcggcatcaaggacgtgccggcgaacgagaacgacctccagctccaggagctcgcgcgcttcgccgtcaatgagcacaaccaaaaggccaatgctcttctggggttcgagaagcttgtgaaggccaagacacaagtggttgctggcacgatgtactatctcactattgaagtgaaggatggcgaagtcaataagctctaccaccctaaggtctgggagaagccatgggagaacttcaagcagctgcaggaattcaagcctgttgaagagggtgctagcgcctaaggatctgtcgtctccctgtgcaatttgctgcctgaagcgcaaaactaagttgcagaataaggagctgcttccgaacatgccagagcaggcaccctcgcgtattttcataaaatcagggctcttcagggaatatcctgaaattgccgggccctggggaataagtaaaattaatgaataacacgttgccttttgtgggttctaaa

SEQ ID NO: 59541 - protein, 135 aa, Zea mays
  misc_feature: Ceres CLONE 1516042
  misc_feature (42)..(130): Pfam Name: Cystatin Pfam Description: Cystatin domain
MRKHRIVSLVAALLVLLALAAVSSTRSAQKESAADNAGMLAGGIKDVPANENDLQLQELARFAVNEHNQKANALLGFEKLVKAKTQVVAGTMYYLTIEVKDGEVNKLYHPKVWEKPWENFKQLQEFKPVEEGASA

SEQ ID NO: 59542 - DNA, 879 bp, Zea mays
  misc_feature: Ceres CLONE 1516044-R2
  misc_feature: SWISSPROT Homolog: EC 1.11.1.6 Catalase
  misc_feature (624)..(624): n is a, c, t, g, unknown, or other
  misc_feature (809)..(809): n is a, c, t, g, unknown, or other
ttatatttaactcgcataaggtttctacaagcaagctaataacacacttatctgcacctcaacctgaatgacatccatgagatcaaatatacagagggctacacaaatgatgatgagttcttcgtttccaccaggttcttttggacactatattttattcaaaataagaaaggaaagaaaaaaagaccaatttggaacagggacccaacacttcactccccccaactaatccggcacccttctgtctcaccaacacaagaaccatccaataaaaaccttatgctgaacctatccttggatgatgcatgcttgttttgatcccagtgcaaatgcacggttgcctaatagcaacatcttcaccctttgccgcggattcatgtaacatgcggtagcaacgataatgataagtatttttctaggggtgagacgaattcctgcagcccgggggatccactagttctagagcggccgccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctgnggtgcctaatgagtgagctaactcacattaattgcgttgcgctcactgcccgctttccagtcggggaaactgtcgtgccagctgcattaatgaaatcggcaacgcgcggggagaggcggtttgcgtattgggcgctcttccgcttcctcgctcactgactcgctgcgctcggtcgttctgctgcngcgagcggtatcagcttactcaagggcgggaatactgtttatcacagaatcaggggattacgccgggaaa

SEQ ID NO: 59543 - DNA, 972 bp, Zea mays
  misc_feature: Ceres CLONE 1516044-R
cctcgagcgccccgcaagtcgacggtatcgataagcttttttttttttttttttcgagacaaacattctcgcctatataccatgcatgtagattgctgcatgacgggatctatctcatattcacatgtccacgttgtagctcaggtcaccaagaagcggcgccacgggcacaaagccggaggcgccgccgttcccgatcccgatcttgcggactccgattaggaggtcacatcgggcgtagaccgagcgccacccccggtggaacagttcatgcacgaaccggacgcggcctagcagcaccacccggagcggcagcacggcgttgagaacgtccgcagccagcgccaccgcggcgtcgggcgacacgggtgcacgggcgccgcgacatcccgcccccaggatgggcgccatcgccacggcggtgaccggcgtctctgcgccagcgggggaatgggacgttgagaccccttacgggctccccacctgttcgccacgtaattctccatgactgaacatacctgatcacgcttgacccactcgctcgggctagcctaacaaccaactttcaacctgggaacgcacacatgccaaatttcaggtgaaccggtgggccggggacaggctcaattaataccttttgagcaaatatgtggatgggggagcagtttctccttaccccacttatccaccaaaaatttgtgtggagtacctcctcccaccgttaggtgagggcaacccacccagccagttatccggtatactcacaggcttattacttatagagtctactatggagagagtcgctcttctgtggcgcgaggatatttatgataccccgtacacagcccgttttatcctaggtttgcccttgtggcacgttaaattatgtggaatagatgtgtctgtcgcgacgttttattacttactatgatgcacctgaagtatatgccaccgctccgtctatgagaccgg

SEQ ID NO: 59544 - DNA, 687 bp, Zea mays
  misc_feature: Ceres CLONE 1516046
  misc_feature: Encodes the peptide sequence at SEQ ID NO. 59545
tggagctccccgcggtggcggccgctctagaactagtggatcccccgggctgcaggaattcgtctcacccctaaaaaaaaaaaaaaaaaaaaaaaaaaaaaaaaaaaaaccggggagcgctacatccaggccagcagtttccatttgcaatccgaccccatcttcatcccgttgtcgcagcagcagccatccaagcagcgatggacggcggcaagaaaagccggaacccgcacaaggcctccgcggactaccgcagcgaccgcaagtcagcctccgggatgagcggcgaccccaagaagggcggccgcggcggcaagttcacctgggagggcgccgacaactacggctacggctacgccgacaaggacctcggcctcatctccaagaaaggcaacatcaacagcggacgcgctagccaggtccagggaggcgccgccgctaagaaggacgacaacaagtaggcctcgccgcctcggctcgcccgcccggtcccgtcgatcgccagcaagaaccaacaagcccttctgtctgtttaattccagtatcagttcgattctcatgttgaataatcatgatcatgtgggtttaggtgtaaaaaaaaaaaaaaaacgagacgctcgaggtacccaattcgccctatagtgagtcgtattacgcgcgctcactggccgtcgttttacacgtcgg

SEQ ID NO: 59545 - protein, 86 aa, Zea mays
  misc_feature: Ceres CLONE 1516046
MDGGKKSRNPHKASADYRSDRKSASGMSGDPKKGGRGGKFTWEGADNYGYGYADKDLGLISKKGNINSGRASQVQGGAAAKKDDNK

SEQ ID NO: 59546 - DNA, 685 bp, Zea mays
  misc_feature: Ceres CLONE 1516047
  misc_feature: Encodes the peptide sequence at SEQ ID NO. 59547
aagctggagctccccgcggtggcggccgctctagaactagtggatcccccgggctgcaggaattcgtctcacccctagaaaaagagaccgacgagcgacgaagcgcgcacaaagagaagaacctcggagctgagatggcacaagccatggcgtcgatgacaggcctctcgcagggcgtcctgcccagcatgcgcgccgacagcagaaccaggacggccgtcgtcgtcgtcagggcgtccgcggagggcgacgccgttgcgcaggcgggccgccgcgccgtgatcgggcttgtggccactggcatcgtcggcggcgccttgtcgcaggcggcgcgcgccgagaccgtcaagaccatcaagattggagccccgccgccgccctccggtggactccccgggactctcaactctgaccaggcgagggacttcgacctccccttgaaggagcggttctacctgcagccgctgccgccggcggaggcagcagcaagggtaaagacgtcggcgcatgacatcatcaacctcaagccgctcatcgacaaagaagcgtggccgtacgtccagaacgacctccgcctccgggcctcctacctgcgctacgacctcaggaccgtcatcgcttccaagcccagggaggagaagaagagcctcaaagagctcaccgggaagctcctcgcaccatcgac

SEQ ID NO: 59547 - protein, 183 aa, Zea mays
  misc_feature: Ceres CLONE 1516047
  misc_feature (15)..(181): Pfam Name: PsbQ Pfam Description: Oxygen evolving enhancer protein 3 (PsbQ)
MAQAMASMTGLSQGVLPSMRADSRTRTAVVVVRASAEGDAVAQAGRRAVIGLVATGIVGGALSQAARAETVKTIKIGAPPPPSGGLPGTLNSDQARDFDLPLKERFYLQPLPPAEAAARVKTSAHDIINLKPLIDKEAWPYVQNDLRLRASYLRYDLRTVIASKPREEKKSLKELTGKLLAPS

SEQ ID NO: 59548 - DNA, 742 bp, Zea mays
  misc_feature: Ceres CLONE 1516051
  misc_feature (381)..(381): n is a, c, t, g, unknown, or other
  misc_feature (386)..(386): n is a, c, t, g, unknown, or other
  misc_feature (389)..(389): n is a, c, t, g, unknown, or other
  misc_feature (493)..(493): n is a, c, t, g, unknown, or other
tccccgcggtggcggccgctctagaactagtggatcccccgggctgcaggaattcgtctcacccctagaaaaaattcccaatctcgtcttgtgtcgttcggagcgggcagcagcacacagccccatcccaatcctagtcgatcttcttcccctcctcaagctggttccttcgtccacacgaccgcgcgctcggaaaactccgcggagggcgaaggaggcgaaccaagggcgacgtatccgccgccggagaaggtagccctcgatccgccgtctcccacgattcgtttgtcttgcgacagctgggcgaccgtcgtccccgccgcccttctccaggagcccaggttctttgccggcccctttgcgggcggagggagggggcanccatnaanaaaatatcccccaccctggggaagaagaaagtcagctgctaagccacctcccatgaaggcgaatcgacacgcttgacccctgtctttttccggcccattccacncccgccgggtagtaggggttgagtgcccgaaattgtccattaaaaaacctgacctggtgaccccaccctttgtccaatccttttttggaaaaccttcattataccccgcggtttatggcctttgtgcggcccccgagtggacgccccctctaatgccaccgcgatcgaaaagcatgacccaaggctcatctgacgtaagcggaacaccccgccccccacgaatgcattggcccccgggacactttcgcc

SEQ ID NO: 59549 - DNA, 662 bp, Zea mays
  misc_feature: Ceres CLONE 1516053
  misc_feature: Encodes the peptide sequence at SEQ ID NO. 59550
  misc_feature (618)..(618): n is a, c, t, g, unknown, or other
ggagctccccgcggtggcggccgctctagaactagtggatcccccgggctgcaggaattcgtctcacccctagaaaaaacctccatccagcttgagccagcccgtcgcctgcgcgcatctctctacactactactgcttcatactctcgtagagagatccccgcggcccaataaaaacccgactcgctagctgcactacacactcgcagatggccggcctcatgatgaagttcgtcgccgtcgccgccgtggccgccgcgctcgtggcgtccgccgcatccgccgaggcccccgccccggcccccgcctccgacgccgcggccgccgtgcccctcgtcgcggcctccctcgccgccggcaccttcggctacctcttctgctagatccacgctggacacgcggtttgtgcttgatttgtgatacatctggcgcgagtggagtccgtgtcctgcgcgtgtctgtgtgagttgtttcggctggcgtgtgtctgtatgtatggagtctgcggctgcagatgtgtgcgcgtggtggtacgtgcgtcgacgctccattgtttgtggcggcgatcatgtgcctggcccgttttctggttatcaatgagatgatttatttgatttnaggccggggaggacccacaggccccctataaaggggtcaattta

SEQ ID NO: 59550 - protein, 57 aa, Zea mays
  misc_feature: Ceres CLONE 1516053
MAGLMMKFVAVAAVAAALVASAASAEAPAPAPASDAAAAVPLVAASLAAGTFGYLFC

SEQ ID NO: 59551 - DNA, 671 bp, Zea mays
  misc_feature: Ceres CLONE 1516057
  misc_feature: Encodes the peptide sequence at SEQ ID NO. 59552
  misc_feature (604)..(604): n is a, c, t, g, unknown, or other
  misc_feature (605)..(605): n is a, c, t, g, unknown, or other
  misc_feature (671)..(671): n is a, c, t, g, unknown, or other
aagctggagctccccgcggtggcggccgctctagaactagtggatcccccgggctgcaggaattcgtctcacccctagaaaaactctctctctctctctctctcaagcaacgcccgcctgcccgcccgccatggcgaccatagccacgatggccctgctgaagcccgccaggatcgtggcgcggtcggcgccgccgtccaccagcggcagcgtctcgctgcgcgtcccggcgcgggccaagaaggccgcggtgtccgcgtccgtgtcgtccgcgctggcgggcgccttcttctcggcgctggcgtcgtcggacgcggcgctggcggcgcagcgcgtggcggacgtcgcggcggcggccgacgccgggagcgacaaccgcgggcagctgctgctcttcgtggtggcgcccgcccatcgggtgggtgctctacaacatcctgcagccggcgctgaaccagctcaaccgcatgcgcagcccaggccgtggtcgccggcctgggcctcggcgccgccgcccgccgggatggcggccgcgcccgaggcctccgccgccgccgcggcgcaggacctcgccgctctcgccgctgctgcggctgcggccgcnncccgccgacgacaccggggggctcctgctgctcatcgtcgtcacgcccgccatcggctgggtgctn

SEQ ID NO: 59552 - protein, 180 aa, Zea mays
  misc_feature: Ceres CLONE 1516057
  misc_feature (159)..(159): Xaa is any aa, unknown, or other
MATIATMALLKPARIVARSAPPSTSGSVSLRVPARAKKAAVSASVSSALAGAFFSALASSDAALAAQRVADVAAAADAGSDNRGQLLLFVVAPAHRVGALQHPAAGAEPAQPHAQPRPWSPAWASAPPPAGMAAAPEASAAAAAQDLAALAAAAAAAAXRRRHRGAPAAHRRHARHRLGA

SEQ ID NO: 59553 - DNA, 664 bp, Zea mays
  misc_feature: Ceres CLONE 1516059
  misc_feature: SWISSPROT Homolog: EC 3.1.2.15 Ubiquitin thiolesterase
gagctccccgcggtggcggccgctctagaactagtggatcccccgggctgcaggaattcgtctcacccctagaaaaaattttcgccccgaatctgccgaggggattcgcctatccaaacgtcatcggcagctgtccgcaatcggtgcgctggtcgctgcggtgcggcgactgcggcgcgcacctggtcactgtggaagacgcgcaggcgcacgctgactccaccaaccacccccacttcatcgagtccactgacgccgtcctcgaccttgtctgctccaactgcgaccagccgtgcccctcccctaccgaggtggacctgcacaccaagcccaccggccataccgacttcgcggacaagaccgcctaggcggacttcacccatcgacctcgaagcgccccttaagccggactcccatgatgccacggacgtcgatacgtcggcctcagccactgaggacacacaggcacatggttgtgccgcaggtgaacctgcacctgctcacggaccttgaaggcatgcgtttcacgacttcgcgcgccactacggcgcttcacttctctagtaatagcaccattgaatgtgctattaactggctttctgaacacccagaggacgcagatattgatgagatgcctctggctccctctaactcataaagtgag

SEQ ID NO: 59554 - DNA, 702 bp, Zea mays
  misc_feature: Ceres CLONE 1516060
  misc_feature: Encodes the peptide sequence at SEQ ID NO. 59555
ggagctccccgcggtggcggccgctctagaactagtggatcccccgggctgcaggaattcgtctcacccctagaaaaaagactccagtctcctctagccgtctcgcgcgcttcaccttccccaccccgccgccgccatcgcacgcccgcagaccgcatccgctatgggtgcgtacaagtacgtctcggagctatggcggacgaagcagtccgatgtgatgcggttcgtgcaacgcgtgcgctgctgggagtacaggcaacagccggccatcgtccgcctcacaaggcccactcgccctgacaaggcgcgccgcctcgggtacaaggccaaccacggttatgttgtttaccgtgtcctcgttaggcgtggtggcaggaagaggcctgtgcctagaggtattgtctatggcaagccaaagcagcagagtatcacccagctcacgttccacaggaacaacaggtctgttgctgacgagagggctggacgagaacttggtggactcacggttctcaactcctactgtgtgaatgaggatagcacctacaagtactttgacatcattcatgttgatgaggcccacactaccatccgcgatgatcgaaggatcgactggctatgcaatcctgtgcacaagcaccgggagctccgtggtctcacctccgaacgcaagaagtaccgtggcctgcatggcaagggccacac

SEQ ID NO: 59555 - protein, 179 aa, Zea mays
  misc_feature: Ceres CLONE 1516060
  misc_feature (2)..(179): Pfam Name: Ribosomal_L15e Pfam Description: Ribosomal L15
MGAYKYVSELWRTKQSDVMRFVQRVRCWEYRQQPAIVRLTRPTRPDKARRLGYKANHGYVVYRVLVRRGGRKRPVPRGIVYGKPKQQSITQLTFHRNNRSVADERAGRELGGLTVLNSYCVNEDSTYKYFDIIHVDEAHTTIRDDRRIDWLCNPVHKHRELRGLTSERKKYRGLHGKGH

SEQ ID NO: 59556 - DNA, 650 bp, Zea mays
  misc_feature: Ceres CLONE 1516066
  misc_feature: Encodes the peptide sequence at SEQ ID NO. 59557
acccgcggtggcggccgctctagaactagtggatcccccgggctgcaggaattcgtctcacccctagaaaaaggtgcatcctcagtgcgtactgtctgtgcgaaggcgaccattccttcttcgctccttcgccgccgctatggttaagtactcgcaggagccgggcaaccctaccaaatcggccaaggccatgggaagggacctgagggtccacttcaagaacacaagggagacagcttttgcgcttcgcaagctgcctttgaccaaggctaagcgataccttgaggatgttattgctcacaagcaggcaattcccttccggagatactgtggaggtgttggtcgcaccgcacaagcaaagtctcgccactccaatgggcagggtcgctggcctgttaagtcagccaggttcatattggatttgctgaagaatgctgagagtaacgctgatgtgaaaggcttggacgtggacaacctctatgtttcacacatccaggtgaaccaagcccagaagcagaggcgccgcacctaccgtgctcacggacgcattaacccttacatgtcctccccttgcccacatgagctgattctgtcagagaaggagaagcctgtgagaaagagctgacacattgtccccggcaggagcaatg

SEQ ID NO: 59557 - protein, 161 aa, Zea mays
  misc_feature: Ceres CLONE 1516066
  misc_feature (17)..(153): Pfam Name: Ribosomal_L22 Pfam Description: Ribosomal protein L22p/L17e
MVKYSQEPGNPTKSAKAMGRDLRVHFKNTRETAFALRKLPLTKAKRYLEDVIAHKQAIPFRRYCGGVGRTAQAKSRHSNGQGRWPVKSARFILDLLKNAESNADVKGLDVDNLYVSHIQVNQAQKQRRRTYRAHGRINPYMSSPCPHELILSEKEKPVRKS

SEQ ID NO: 59558 - DNA, 612 bp, Zea mays
  misc_feature: Ceres CLONE 1516068
  misc_feature: Encodes the peptide sequence at SEQ ID NO. 59559
aagctggagctccccgcggtggcggccgctctagaactagtggatcccccgggctgcaggaattcgtctcacccctagaaaaaccagatagatctttcccccgtcctccctcgccttcgccttcgccggcaggagatttccaccaccaccgccgaaccgccccgaccctcctcccctctcgcgctatggcccagactgttgtgctcaaggttggcatgtcctgtgagggctgtgttggagctgtcaagcgggtcctcggcaagatggaaggcgtcgagtcctacgacgtagacatcatggaacagaaggtcaccgtgaagggcaatgtgacacctgacgccgtcctgcaaactgtttccaagactggcaagaagacttcgttctgggaggctgaggccgtgacaagtgaatccgccacacctgccggtgccaccgcctgacaggttcgatgatctggaagtgcccggcaaggcggcaaagaaaaaaaatgtgaatggtattagcttgggatctgtacaaataattgcaaactgctaactcggtcctggactttttacagttggcaattccggggacggggggggggtccccccaaaaatttgggggggaaaa

SEQ ID NO: 59559 - protein, 84 aa, Zea mays
  misc_feature: Ceres CLONE 1516068
  misc_feature (5)..(66): Pfam Name: HMA Pfam Description: Heavy-metal-associated domain
  misc_feature: SWISSPROT Homolog: EC 3.6.3.4 Copper-exporting ATPase
MAQTVVLKVGMSCEGCVGAVKRVLGKMEGVESYDVDIMEQKVTVKGNVTPDAVLQTVSKTGKKTSFWEAEAVTSESATPAGATA

SEQ ID NO: 59560 - DNA, 697 bp, Zea mays
  misc_feature: Ceres CLONE 1516069
  misc_feature: Encodes the peptide sequence at SEQ ID NO. 59561
  misc_feature (251)..(251): n is a, c, t, g, unknown, or other
aaagctggagctccccgcggtggcggccgctctagaactagtggatcccccgggctgcaggaattcgtctcacccctagaaaaagcctgccgtctctcttccaccttccaccacaagcgccgccgcagccggtgcctgctccttcccgatccccgaggcaaagctgcgactccgcaaccgccgccatggcgttcgagaagatcaaggtctccaacccaatcgtcgagatggacggtgatgagatgaccagngtattctggcagtctatcaaggacaagcttatcctcccatttctggacctggacatcaagtactatgatttggggatactgcaccgtgaagcaactgatgacaaggtcacagtggaggctgcagaggctactctcaagtacaacgtggctattaagtgtgcgaccattactccagatgaaactcgggtttaggagttcaatctgaaacacatgtggaaagagccaaaatggcacaaatagggaacattttaaaatgggccctgtgttccgaagagcctaataatatgccaaaaccgtttccaagaacttgttcccaggatgggactaaacccccatctgtcaatttggaaaggccaggccctttccgggggaatcatatacccgagctcccccgaatcgcccttctcctgaagaggggcccttggggaaaacacctaaaagcctta

SEQ ID NO: 59561 - protein, 85 aa, Zea mays
  misc_feature: Ceres CLONE 1516069
  misc_feature: SWISSPROT Homolog: EC 1.1.1.42 Isocitrate dehydrogenase (NADP(+))
  misc_feature (22)..(22): Xaa is any aa, unknown, or other
MAFEKIKVSNPIVEMDGDEMTXVFWQSIKDKLILPFLDLDIKYYDLGILHREATDDKVTVEAAEATLKYNVAIKCATITPDETRV

SEQ ID NO: 59562 - DNA, 555 bp, Zea mays
  misc_feature: Ceres CLONE 1516070
  misc_feature (285)..(285): n is a, c, t, g, unknown, or other
  misc_feature (292)..(292): n is a, c, t, g, unknown, or other
ggagctccccgcggtggcggccgctctagaactagtggatcccccgggctgcaggaattcgtctcacccctagaaaaaatcgatctcctcgcacctcgtggcggcacctctccccttcgatccaccaagggtttaagatcggcggcgatggcggcgaggctggcacagctgcgcgctcaagcggtgcatgcggcggagttcgcctcgaagcacggcggctcctactagcaggagctcatggagaggaacaggcagtacgtcgtgcaggcgcccatcatcgagaantgccagnagctctcaagcagctcttctacacccggctcgcaagcctaccagggtcggtattgagtcatttctgaaaggagcttttgatggggtccaaacccgggtttggaaaaaaaaaaaaagggaccctccagggggtgaaaggacccttgggaattgccaccttttttttgggggttgactttttggccagggtccctcccaagccaaaaattttttgccaaaaggtttcccctcttcaccgggttttaagggccttttttaattttc

SEQ ID NO: 59563 - DNA, 683 bp, Zea mays
  misc_feature: Ceres CLONE 1516071
  misc_feature: Encodes the peptide sequence at SEQ ID NO. 59564
  misc_feature (558)..(558): n is a, c, t, g, unknown, or other
  misc_feature (615)..(615): n is a, c, t, g, unknown, or other
  misc_feature (616)..(616): n is a, c, t, g, unknown, or other
  misc_feature (663)..(663): n is a, c, t, g, unknown, or other
  misc_feature (683)..(683): n is a, c, t, g, unknown, or other
ctccccgcggtggcggccgctctagaactagtggatcccccgggctgcaggaattcgtctcacccctagaaaaacccaacaacagcgaacacatctcctcgcatttcttcccatccgatccccccttcgcaaccaaaaccccaactcgccccgcatcgatggcgcccaaggccgagaagaaacccgcggcgaagaagccggcggaggaggagcccgcggccgagaaggcgcccgccgggaagaagccgaaggcggagaagcgggtccccgctggcaagtccgctgccaaggaaggcggcgagggcaagaggggcaagaagaagggcaagaagagcgtggagacctacaagatctacatcttcaaggtgctgaagcaggtgcacccggacattggcatctcctccaaggccatgtccatcatgaactccttcattaacgatatcttcgagaagctcgctgctgaggcccgcaagctcgcgcgctataacaagaagcctaccatcacctcccgtgagatccagacctccgtgcgcctcgtccttcccggggagctcgccnagcacgccgtctccgaggccacaaggccgtcaccagtttcactcgggctaggctgcnncgcccgcgcttgcaggattctctccggggtcccggcccctgctgaanttagtgctgctgctgctggn

SEQ ID NO: 59564 - protein, 175 aa, Zea mays
  misc_feature: Ceres CLONE 1516071
  misc_feature (57)..(127): Pfam Name: Histone Pfam Description: Core histone H2A/H2B/H3/H4
  misc_feature (134)..(134): Xaa is any aa, unknown, or other
  misc_feature (153)..(153): Xaa is any aa, unknown, or other
  misc_feature (169)..(169): Xaa is any aa, unknown, or other
MAPKAEKKPAAKKPAEEEPAAEKAPAGKKPKAEKRVPAGKSAAKEGGEGKRGKKKGKKSVETYKIYIFKVLKQVHPDIGISSKAMSIMNSFINDIFEKLAAEARKLARYNKKPTITSREIQTSVRLVLPGELAXHAVSEATRPSPVSLGLGCXARACRILSGVPAPAEXSAAAAG

SEQ ID NO: 59565 - DNA, 685 bp, Zea mays
  misc_feature: Ceres CLONE 1516073
  misc_feature: Translation starting site: 137
  misc_feature (603)..(603): n is a, c, t, g, unknown, or other
  misc_feature (646)..(646): n is a, c, t, g, unknown, or other
tccccgcggtggcggccgctctagaactagtggatcccccgggctgcaggaattcgtctcacccctagaaaaagttcgtgcgaaggcgaccctccctccttcgctccttccccgccgcctcccggccgtcgccgccatggagaagtactcgcatgagccgggcaaccctaccgagtcagctaaagccatgggcagggatctgagggtccacttcaagaacacaagggagacagcctttgctcttcgcaagttgtctttgaccaaggctagagcgataccttgaggatgttattgctcacaaccaggcaattcccttccggagatactgtggcgctgttggtcgcaccgagcatgctaagtctcgccactccaatagacatggccgctggtctgttaaatcacacggactcatcctgaatttgctgaatagtgctgatactaccgctgatgtgaaatgcttgtatgtggacaacctctatgtttcacacgtccgggagatccaagcacataagcagatgcttctgcactatcgtgctcgactacgcatcagtcccaacatgtactcaccctgaccacattgagctgatcttgtcatacaacggncagcctgattatgacagacgtctgacaacattgtcgcaaccangacgctctggagttctaccatcatgcctgatcggaggcc

SEQ ID NO: 59566 - DNA, 718 bp, Zea mays
  misc_feature: Ceres CLONE 1516074
  misc_feature: Encodes the peptide sequence at SEQ ID NO. 59567
aaagctggagctccccgcggtggcggccgctctagaactagtggatcccccgggctgcaggaattcgtctcacccctagaaaaagtgctttcttagaggtgggttggcttctcctccccctccggttcgggttcgggttcgtgaggttctccggggttcggtttcgtgggtgagcggatcgagatggcggcgtctgatgttgagtaccgctgcttcgtcggcggcctcgcctgggccacggacgaccactctctccacaacgccttcggcacctaccgcgaggtcctcgagtccaagatcgtcctcaatctggagacgcagaggtcccgcggcttcagtttcgtcaccttctcctttgatgaggtgatgcggagcggcggcgggggtctgaaccgtcaagaccccccccccccccaacatcttcttccacgagtcccaacccctccggttgccgtgaacacccttgcccgtggcccggagggggcccgggagccgggcggttccctcgatgactgctactttgagttttttggcggctcctattttggcggcttcctccccatatttttggttaccggtttaattcgcccgcggtatctctgtatccctgttttgatacccctgggagcccccccgcgcccactctcttttggtcaaccgtgcacggaatgggaatgtgagggggcgggtgaagatactctcctctctcctgtatccg

SEQ ID NO: 59567 - protein, 178 aa, Zea mays
  misc_feature: Ceres CLONE 1516074
  misc_feature: SWISSPROT Homolog: EC 5.2.1.8 Peptidylprolyl isomerase
MAASDVEYRCFVGGLAWATDDHSLHNAFGTYREVLESKIVLNLETQRSRGFSFVTFSFDEVMRSGGGGLNRQDPPPPQHLLPRVPTPPVAVNTLARGPEGAREPGGSLDDCYFEFFGGSYFGGFLPIFLVTGLIRPRYLCIPVLIPLGAPPRPLSFGQPCTEWECEGAGEDTLLSPVS

SEQ ID NO: 59568 - DNA, 685 bp, Zea mays
  misc_feature: Ceres CLONE 1516076
  misc_feature: Encodes the peptide sequence at SEQ ID NO. 59569
ggagctccccgcggtggcggccgctctagaactagtggatcccccgggctgcaggaattcgtctcacccctagaaaaaaaaaaaacccaccgaggccaaaggccaccaccattccttccccaactctgcaggctgctcgtcgccctccctccacgccggacgcgccccgatccagatccaggggcgtaacatggcatcaaaacgtatcctcaaggaattaaaggacctgcaaaaggaccctccaacgtcatgcagtgcaggtcctgctggtgaggatatgttccactggcaggcaaccatcatgggtcctcctgatagtccatatgctggaggtgttttcttagtgaacattcatttccccccggactaccctttcaagcctccaaaggtatcttttaagacgaaggtcttccatccaaacatcaatagtaatggaagcatatgtctcgacattcttaaggagcagtggagccctgctttgacaatctctaaggttttgctttctatctgctcgctgcttactgatcccaacccagacgatcctcttgtccctgagattgctcacatgtacaagacggatcggcctaagtacgaggcaacagcccgcagctggacccagaaatatgccatgggatgaaaatgaaatgaagtcgaaactccatattcggcaatactgcttaaatgc

SEQ ID NO: 59569 - protein, 148 aa, Zea mays
  misc_feature: Ceres CLONE 1516076
  misc_feature (5)..(142): Pfam Name: UQ_con Pfam Description: Ubiquitin-conjugating enzyme
  misc_feature: SWISSPROT Homolog: EC 6.3.2.19 Ubiquitin--protein ligase
MASKRILKELKDLQKDPPTSCSAGPAGEDMFHWQATIMGPPDSPYAGGVFLVNIHFPPDYPFKPPKVSFKTKVFHPNINSNGSICLDILKEQWSPALTISKVLLSICSLLTDPNPDDPLVPEIAHMYKTDRPKYEATARSWTQKYAMG

SEQ ID NO: 59570 - DNA, 675 bp, Zea mays
  misc_feature: Ceres CLONE 1516080
  misc_feature: Encodes the peptide sequence at SEQ ID NO. 59571
  misc_feature (479)..(479): n is a, c, t, g, unknown, or other
  misc_feature (486)..(486): n is a, c, t, g, unknown, or other
  misc_feature (537)..(537): n is a, c, t, g, unknown, or other
  misc_feature (541)..(541): n is a, c, t, g, unknown, or other
  misc_feature (542)..(542): n is a, c, t, g, unknown, or other
  misc_feature (569)..(569): n is a, c, t, g, unknown, or other
  misc_feature (575)..(575): n is a, c, t, g, unknown, or other
ctccccgcggtggcggccgctctagaactagtggatcccccgggctgcaggaattcgtctcacccctagaaaaaagctagctggctagcatggccgggaaagagcttacgctgctggggttatgggcgagcccgttcgtgctccgggcgcgcatcgcgctcagcctcaaaggcctcacctacgcttactccgaggagaacctcgacgacaagagcgagcttctcctcagctccaaccccgtgctcaagaaggtgcccgtgctcatccaccacggcaagcccgtctgcgagtcccagatcatcgtgcagtacgtcgacgaggctttcccggccgccacacctaatttccttccatccgacccctacgaccgcgccattgctcgcttctgggcctcctacgtcgacgacaagttctacagcgcgtggatacccgtgttcaggggcaggacggcggaagagatggcggaagcggcaaggcangccgtcncggcgctggagacgctggagcaggcgttcagggagtgctccaggggaaggncttnnctcgaggggacagcgtggggctcgtcnacgtcntgcttcgcgccttgttgggtggctgtacgccaccgaggccatctgcggggtgaacgcctttaccccggcaggacgcccttctggcggcttgggccgaccg

SEQ ID NO: 59571 - protein, 195 aa, Zea mays
  misc_feature: Ceres CLONE 1516080
  misc_feature (4)..(77): Pfam Name: GST_N Pfam Description: Glutathione S-transferase, N-terminal domain
  misc_feature: SWISSPROT Homolog: EC 4.4.1.5 Lactoylglutathione lyase
  misc_feature (130)..(130): Xaa is any aa, unknown, or other
  misc_feature (133)..(133): Xaa is any aa, unknown, or other
  misc_feature (150)..(150): Xaa is any aa, unknown, or other
  misc_feature (151)..(151): Xaa is any aa, unknown, or other
MAGKELTLLGLWASPFVLRARIALSLKGLTYAYSEENLDDKSELLLSSNPVLKKVPVLIHHGKPVCESQIIVQYVDEAFPAATPNFLPSDPYDRAIARFWASYVDDKFYSAWIPVFRGRTAEEMAEAARXAVXALETLEQAFRECSRGRXXLEGTAWGSSTSCFAPCWVAVRHRGHLRGERLYPGRTPFWRLGPT

SEQ ID NO: 59572 - DNA, 684 bp, Zea mays
  misc_feature: Ceres CLONE 1516081
  misc_feature: Encodes the peptide sequence at SEQ ID NO. 59573
  misc_feature (542)..(542): n is a, c, t, g, unknown, or other
  misc_feature (578)..(578): n is a, c, t, g, unknown, or other
aaagctggagctccccgcggtggcggccgctctagaactagtggatcccccgggctgcaggaattcgtctcacccctagaaaaaaaacaaaacaagctcaaacaacgtgtcctggtacagctatagcttcctcgctccgatcccttgcaacaaatcgaacgccatggctcctcgcgctaagaactctctagtggcggagggtgacgtgagcgtgcagaaggtgaagaagatcgagcctgtctacgactacgacctagtcaccagaccctgggtgttcggcaacccgagagtggtgacggtgctggcaaggccgccgccgggtgccggggtttctgtcgcctcaggccagaagaagctgttccagagggcgctgtcagagcaagagatcatcaacgactacatcgccagaaagaagaagcagtttgccggggagatcccatatagtacctagggtgtttacgtatatagtttgagaagagataaaaaaactacacattagccctctctatatatatctatatatgtactcagagagtacatcngtcaatatatgtggtgtcgtatggaattcatacctnatttcctatttctgaaggtttaagccgtctaaacaaaaaaaaaaacgagacgctcgaggtacccattcgccctaaaatgagtcgtaatacgcgcgctccctgcccc

SEQ ID NO: 59573 - protein, 95 aa, Zea mays
  misc_feature: Ceres CLONE 1516081
MAPRAKNSLVAEGDVSVQKVKKIEPVYDYDLVTRPWVFGNPRVVTVLARPPPGAGVSVASGQKKLFQRALSEQEIINDYIARKKKQFAGEIPYST

SEQ ID NO: 59574 - DNA, 661 bp, Zea mays
  misc_feature: Ceres CLONE 1516107
  misc_feature: Encodes the peptide sequence at SEQ ID NO. 59575
agagctggagctccccgcggtggcggccgctctagaactagtggatcccccgggctgcaggaattcgtctcacccctagaaaaaaggggccagggactagcagcggcggcgtatccctaatcccacctccagtctctgggcaccaaatttccggcggcgatggcggcggctgtggcgaggtcagggttccggcgcatgttctccgtctctgccttcgcgccgccaaaggagcccgccacgcgccccaaggtcgacgcatcccccaacctcttcgtctccggtttaagcaagcgtaccacaagtgaaggacttacagcatcctttgccgaagtttcctgaagttatgcatgctccagtttgtgaccgatcgtgtcagtggggtttttctaagggattttggctttttttaagggaatgctcccaccccaacaggccagcccaggggaataaaaggaaaaggatgggaaacgtccttgaatgaaaggggtttttttttggcggaatacccctaaaacccaaaaacccccccccggaaggaaaacggggatggaatttcccacccccccaaaaattttgggggagattccccctcgggttcccctggggcgccccccttataaaaaaggggatttttgtgaaaacccccccccctgtgccccgg

SEQ ID NO: 59575 - protein, 59 aa, Zea mays
  misc_feature: Ceres CLONE 1516107
MAAAVARSGFRRMFSVSAFAPPKEPATRPKVDASPNLFVSGLSKRTTSEGLTASFAEVS

SEQ ID NO: 59576 - DNA, 691 bp, Zea mays
  misc_feature: Ceres CLONE 1516120
  misc_feature: Encodes the peptide sequence at SEQ ID NO. 59577
ggagctccccgcggtggcggccgctctagaactagtggatcccccgggctgcaggaattcgtctcacccctagaaaaattttttccgtgccgccacccagccccttaaccctcgttcctctagccgtctcgcgcagccacagcctccatttctcctccgacggcggtgcggctagctcaaccatggcggactccaaggccacctcggcggtcaccctccgcactcgcaagttcatgaccaaccgcctgctggcccgcaaacaatttgtgcttgaggttatccaccccggccgcgccaacgtctccaaggcggagttgaaggagaggcttgccaagatgtacgaggtgaaggaccccaacaccatcttcgtcttcaagttccgcacccacttcggtggaggcaagtccactggcttcggcctcatctacgataacctcgagtctgccaagaagttcgagcccaaataccgcctcatcaggaatggtcttgctactaaggttgagaagtcccgcaagcaaatgaaagagcggaggaacagggccaagaagatccgtggggtcaagaagaccaaggcctggtgatgccaaaaaaaagtaaacagtcctttaatatttctgggataaccggccctgaacccgggttggctctccaatttgcaatggcctaaaatatgggccgggttaaggttttg

SEQ ID NO: 59577 - protein, 132 aa, Zea mays
  misc_feature: Ceres CLONE 1516120
  misc_feature (28)..(111): Pfam Name: Ribosomal_S24e Pfam Description: Ribosomal protein S24e
MADSKATSAVTLRTRKFMTNRLLARKQFVLEVIHPGRANVSKAELKERLAKMYEVKDPNTIFVFKFRTHFGGGKSTGFGLIYDNLESAKKFEPKYRLIRNGLATKVEKSRKQMKERRNRAKKIRGVKKTKAW

SEQ ID NO: 59578 - DNA, 671 bp, Zea mays
  misc_feature: Ceres CLONE 1516343
  misc_feature: Encodes the peptide sequence at SEQ ID NO. 59579
  misc_feature (390)..(390): n is a, c, t, g, unknown, or other
aagctggagctccccgcggtggcggccgctctagaactagtggatcccccgggctgcaggaattcgtctcacccctagaaaaaatgcgcaaacatcgaatcgactcagtcgggactgccctgttcatactgcttgtcctcgccgtataggccacctgcaacgcacaggaggattccatggccaacaacaccgggacgttggtgggtggcatccaggacgtgccggggagcgagaacaaccttcacctccaggagctcgcccgcttcaccgtcgatgagcacaacaagaaggccaatgctcttctggggttcgagaagcttgtgaaggccaagacacaagtggttgctggcacgatgtactatctcactattgaagtgaaggatggcaaantcaaaaaactctactaagctaacgtatgggagaagccatgggagaagttcaaggagctgcacgaattcaaacctgttgaagaaggtgctagcgcctacggatgtctccttctccatgtgcgagcctgaagctcaaagcaaagttgcagaataaggagccatgctccctttgtgtaatttcataagactacgaccctattagggctttgtttggttgtgtctgtatcgaaagggattgaaggtgataaattttccctttctatcctaataaagggggtttaa

SEQ ID NO: 59579 - protein, 76 aa, Zea mays
  misc_feature: Ceres CLONE 1516343
  misc_feature (10)..(76): Pfam Name: Cystatin Pfam Description: Cystatin domain
  misc_feature (72)..(72): Xaa is any aa, unknown, or other
MANNTGTLVGGIQDVPGSENNLHLQELARFTVDEHNKKANALLGFEKLVKAKTQVVAGTMYYLTIEVKDGKXKKLY

SEQ ID NO: 59580 - DNA, 733 bp, Zea mays
  misc_feature: Ceres CLONE 1516353
  misc_feature: Encodes the peptide sequence at SEQ ID NO. 59581
  misc_feature (331)..(331): n is a, c, t, g, unknown, or other
  misc_feature (426)..(426): n is a, c, t, g, unknown, or other
acccgcggtggcggccgctctagaactagtggatcccccgggctgcaggaattcgtctcacccctagaaaaagtgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcntcaccttctccacggaggaggcgatgcggaacgccatcgagggcatgaacggcaaggagctggaccgccgcaacatcaccgtcaacgaggcccantcccgcggcggccgtggaggcggcggcggtgggtacggtggtggccgtggaagcggcggctaccgcggtggcgggcgccctgaatggcgccgcggcctacgcggtggcgggcgcggctacagtggcggcggcggctacggtggtggtggcggcggctaccgagggggcaaaccggggcggcggttacggcaactccgaaggggaactgggaggaactggacgggggggggcccccgccgggccaaattttcccgggttccctacccggggtggttaccacctaatgcccgaaaggttttatccttcg

SEQ ID NO: 59581 - protein, 187 aa, Zea mays
  misc_feature: Ceres CLONE 1516353
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (54)..(54): Xaa is any aa, unknown, or other
  misc_feature (85)..(85): Xaa is any aa, unknown, or other
MAASDVEYRCFVGGLAWATDDHSLHNAFSTYGEVLESKIILDRETQRSRGFGFXTFSTEEAMRNAIEGMNGKELDRRNITVNEAXSRGGRGGGGGGYGGGRGSGGYRGGGRPEWRRGLRGGGRGYSGGGGYGGGGGGYRGGKPGRRLRQLRRGTGRNWTGGGPRRAKFSRVPYPGWLPPNARKVLSF

SEQ ID NO: 59582 - DNA, 694 bp, Zea mays
  misc_feature: Ceres CLONE 1516355
  misc_feature: Encodes the peptide sequence at SEQ ID NO. 59583
caaagctggagctccccgcggtggcggccgctctagaactagtggatcccccgggctgcaggaattcgtctcacccctagaaaaaacactagcagtaataagaaacacgtcgaagtcgtcgtagttttacgtgctcaaccgtccgtcccgtgcgccatgtcacgcagcaacgccttgatgtggttgttgcttctcgcgctctcgtgctggtcgtggtgcggcgccgtcacggcgcggccgaccccgagcgccagcaccagcaccagcacagccggcggcggcttcatcaggtcgtggtgcgcggggacggactacccggccctgtgcaacgcgacgctggccccgtacgcggcggaggtcggggccagcccggcgcgcctgtcgctggcggcgctgacggtcacgctggacggcgcgcggagggcgacggccgcgatgaaggcaatggcggcgggcggcgcgagcagccaccacctcgtgcccgtggcggccgaggcggcggcagactgcgtgggcatgctcgaggacgccgtggacctgctgcggcagtcggtggaggcaatggagcgcctcggcaaggagccggccagcgccagtgccagcgccagcgggcaggccgggcggagcgtcaggttccaggtgaacagcgtgcagacgtgggcgagcgttgcgctgacgaacgacggcatgtgca

SEQ ID NO: 59583 - protein, 179 aa, Zea mays
  misc_feature: Ceres CLONE 1516355
  misc_feature (38)..(178): Pfam Name: PMEI Pfam Description: Plant invertase/pectin methylesterase inhibitor
MSRSNALMWLLLLALSCWSWCGAVTARPTPSASTSTSTAGGGFIRSWCAGTDYPALCNATLAPYAAEVGASPARLSLAALTVTLDGARRATAAMKAMAAGGASSHHLVPVAAEAAADCVGMLEDAVDLLRQSVEAMERLGKEPASASASASGQAGRSVRFQVNSVQTWASVALTNDGMC

SEQ ID NO: 59584 - DNA, 695 bp, Zea mays
  misc_feature: Ceres CLONE 1516364
  misc_feature: Encodes the peptide sequence at SEQ ID NO. 59585
  misc_feature (607)..(607): n is a, c, t, g, unknown, or other
cagagctggagctccccgcggtggcggccgctctagaactagtggatcccccgggctgcaggaattcgtctcacccctagaaaaagctgagctgagtccccttcccttctctcgtcgcctccgcctccgccttcagtttagcctccaagcaggggcgccgcgcggggtattctgtccgtcgttgaggatagagagtcacttgcaccgggggagcggagatgaagccggttgtggggatcgtggtgtcgaacaagatgcagaagtcggtggtggttgcagtggaccgcctcttccacaacaaggtatacaaccgctacgtcaagcgcacctccaagttcatggcacacgacgatgacaacacctgcaacattggcgaccgggttaggctggatccttctaggcccttgagcagacacaagcactgggttgttgctgagattctccgcagagctaaggtgtacgttccaccagctgcaacagcgtccagtgaacgtggtagcaaatctcaacaagctggtggtgctaccaaatgatccatctgaagttactcagaacaagatgcagtcacgggcttgtttttctttcgctggatgtttgttttctttgnggaatgtggttgccatgtttagcatggggagaaaaatagcaagccacccgccatcttggctaaatactgttgttcttctggggggtcc

SEQ ID NO: 59585 - protein, 104 aa, Zea mays; identical to SEQ ID NO: 48899
  misc_feature: Ceres CLONE 1516364
  misc_feature (6)..(74): Pfam Name: Ribosomal_S17 Pfam Description: Ribosomal protein S17

SEQ ID NO: 59586 - DNA, 689 bp, Zea mays
  misc_feature: Ceres CLONE 1516371
  misc_feature: Encodes the peptide sequence at SEQ ID NO. 59587
tctgaactagtggatcccccgggctgcaggaattcgtctcacccctagaaaaacttttggggaatggtcttcatacttgcatccacaaatctcctcactacaagaattgcagcgggttgtttcatacttgcattgtttattgttctttttgtagcagaaaattggtttcttcgctggctctgccttggattcattgtgttcattgctgttgttaggggcatacaataatttacatctttccatgttctgaaatatgtgatcttattcataggtgtgatgaacagcttattttcaattgacaatatttatgatggcttgctatcccgaagagttaacactactgatgctgaagagtttgctgaaatctgcccttgcccctgcaatggttttgcatgcggtgttatatggggattcatctcgattatctttctctgcacttcatataccttggactggtcatattgtcttgcaggtcccccattttgatctgacaatcgactctagatggctttttcagaacctgcatcgctcgaggttatggtcccagctcacaagggtctggaggtttgaacgtgatacatgggcaaggtaaaacagtacttccgtgataaattaatttggggggggataattccgggattcttccatgttagagggtccataaataccattttcctaaccataccagt

SEQ ID NO: 59587 - protein, 54 aa, Zea mays
  misc_feature: Ceres CLONE 1516371
MVFILASTNLLTTRIAAGCFILALFIVLFVAENWFLRWLCLGFIVFIAVVRGIQ

SEQ ID NO: 59588 - DNA, 740 bp, Zea mays
  misc_feature: Ceres CLONE 1516392
  misc_feature: SWISSPROT Homolog: EC 5.5.1.9 Cycloeucalenol cycloisomerase
tccccgcggtggcggccgctctagaactagtggatcccccgggctgcaggaattcgtctcacccctagaaaaagtataatttttagctgtgttgctaactacttctggacacattacttcttcacagttcttggcgcgtcatatacttttccatcatggaggatgaataatgtacctcatacgacatttctcctgacccatgcttgtttcctgttctatcatatggcatcaaatatgacacttcgtagattgcgccattctacagctcatttaccacagtctatttcgtggtcatctgaaactacatggattttatcactgtcatacttcatagcgtacctgtataccctagccattgcaaattcccccgaccataaattcgttgacccgggatatcaccccccaaactcgggttccttgttctactcaagaaaacttcatccgcaactttcccaatgtttttcaacgattcgagcaagaaataccagaaattgcaagcctggtcccgtggcatagccttccgacttcttccgggttccagccatgctcggcttaccaaaaaataacgcgaacctaatggaagcataagtcccaggcggccccaataatgtccccgcccccccagataccgaaaccaagtgtgggcacaactcctggctctgatcctgggtttccctaaccgcaccaaagcggatatttccccgcatcctagggtaaaacctgtcaagtttatctcgttt

SEQ ID NO: 59589 - DNA, 705 bp, Zea mays
  misc_feature: Ceres CLONE 1516393
  misc_feature (414)..(414): n is a, c, t, g, unknown, or other
  misc_feature (420)..(420): n is a, c, t, g, unknown, or other
  misc_feature (441)..(441): n is a, c, t, g, unknown, or other
  misc_feature (442)..(442): n is a, c, t, g, unknown, or other
  misc_feature (497)..(497): n is a, c, t, g, unknown, or other
  misc_feature (558)..(558): n is a, c, t, g, unknown, or other
  misc_feature (611)..(611): n is a, c, t, g, unknown, or other
caaagctggagctccccgcggtggcggccgctctagaactagtggatcccccgggctgcaggaattcgtctcacccctagaaaaaagccaagcaaataagacgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgaagcaccgccgcgcaggccaccgtctgtcctcggcgtggccccggagaagaaggccgcgcccgagttcgtcgaggccgcggcggagtccggcgaggccgcccacggctgcagctgcggtggcaactgcaagtgcgacccctgcaactgctgatcacatcgatcgacgaccatgnatatgnaatatatctatctagcttgtnngtggtggttgaacaataataaagcgagccgaagctgctgccatacataggtattngtgtgtgtgtgtgaaaagagaagaaaacgaaagtcttcagtttgctatctctctctgcatngttgggcgtcagtctttgtgctcatgtacgtacgtgtgtctacctgcatggtngttggaatccaattgcatctgctgaaacaatataataaatgggccccccaaggatttgaatttgaaccttaattattaccaaaaaaaaaaaaaa

SEQ ID NO: 59590 - DNA, 786 bp, Zea mays
  misc_feature: Ceres CLONE 1516417
  misc_feature: Encodes the peptide sequence at SEQ ID NO. 59591
  misc_feature (786)..(786): n is a, c, t, g, unknown, or other
tccccgcggtggcggccgctctagaactagtggatcccccgggctgcaggaattcgtctcacccctagaaaaaagccgcgtggacgcacaccagcacctgccctcctcgccgtcgccgcctccctccgcgcgaccgatctaccctccgccgccaccatgtcgctgatcgccggggaggacttccagcatatcctgcgtttgctgaacaccaacgtggatgggaagcagaagatcatgttcgccatgacctcaatcaaaggtgtcgggcgccgccttctccaacatcgtctgcaaaaaggccgacatcgacatgaaaaaaaagggccggcaaactagacccctgaatgaacctggaacccctggatgaggggtcgttgggccacccctagggcagtttcagggtcccccccaactggttccttcattggggaaaaaaggatttaacaagggacggccggggttctccccagggtcgttcttccaacagcccccttggatattgaaagtctccagggaagaaacctctggaaagggttttttaaaaaaaatccgggaaccccccccgggggctctgcggttacttatttggggggcccccccggggcccgtggggccgagccacaccctgaatatcctggtgagaggccggaaaaaaaaaccactttggtggcctctcccaaaaaggggtgaagctcccttattctccccccgggaaaaaacttggttgtccccctatccgcgtgtgtggtttgtttgccctcaaattcactctatgaaaaggggttn

SEQ ID NO: 59591 - protein, 59 aa, Zea mays
  misc_feature: Ceres CLONE 1516417
MSLIAGEDFQHILRLLNTNVDGKQKIMFAMTSIKGVGRRLLQHRLQKGRHRHEKKGPAN

SEQ ID NO: 59592 - DNA, 740 bp, Zea mays
  misc_feature: Ceres CLONE 1516422
  misc_feature: Encodes the peptide sequence at SEQ ID NO. 59593
caagctggagctccccgcggtggcggccgctctagaactagtggatcccccgggctgcaggaattcgtctcaccctagaaaaaaccgttgtaacaagttctcccatctagcaacaccataatcgcaggagaatcgctgctccaccagaatccgtttcctcttgcttcaacgtcaaaatcatggccgcagctggcaagtcgtcgtcggccatggaggacacggttgcggcgacggccgcctcgcgggggcggcgcgcgattgaccggcaggccgtcgacaggggcatcaactacctgctcatggtgggcgccctcgtcgccacctacgtgcttcactgaattttgatctgctccggcgcgggtagatttcacaccaaggaaggttttttgtgcgcttttgtcttaccccccaacctcaggcttctttcaaagttcccctggcgaccaacatgccgttcgtttcgatctacccccccagggaatggctatggaccaaatgacaaaagggaaattgtaatgcggtctcccgggactaccttcttcccacccgccccccccacttagattttcttaaaaatacatttctcttgtacattaactcgtgtctacgcactaggccctttggttcccccaaaccaaatccggggagatcaaacgcggggcggcagagacaaataaaaaaacagggagggacgccccgagcgtacccaaaatcccccccggtggagaggcgccctaaac

SEQ ID NO: 59593 - protein, 52 aa, Zea mays
  misc_feature: Ceres CLONE 1516422
MAAAGKSSSAMEDTVAATAASRGRRAIDRQAVDRGINYLLMVGALVATYVLH

SEQ ID NO: 59594 - DNA, 692 bp, Zea mays
  misc_feature: Ceres CLONE 1516424
  misc_feature: Encodes the peptide sequence at SEQ ID NO. 59595
  misc_feature (384)..(384): n is a, c, t, g, unknown, or other
  misc_feature (387)..(387): n is a, c, t, g, unknown, or other
  misc_feature (389)..(389): n is a, c, t, g, unknown, or other
  misc_feature (403)..(403): n is a, c, t, g, unknown, or other
  misc_feature (413)..(413): n is a, c, t, g, unknown, or other
caccgcggtggcggccgctctagaactagtggatcccccgggctgcaggaattcgtctcacccctagaaaaaccaccatctcacttcatataccactccctaggaggacccagcaacacaacagccgagctttgcttaggcaagatgaacaggaagccaggagactgggactgcagggcgtgccagcacctcaacttcagccgccgagacatatgccagcgctgtagcgagccacgtggagttgctgatcgtggcagtggcggcggcggaggaggaggaggaggcgactacgccagcttcggtggccgcggtggctcctccttcggcggcggctttggcgctgctggctctgacgtccgccctggtgactggtactgctcctgnggngngtatcaccccccanccgctcaagntgcttcaagtgctccgcctacaaggaggaggccgctgtgaacagtggcgctggcggctttgacggcaacttgtcacgctcccggggcttacggctttcggcaacgggtgcttgcttgggggctggggctgggggcttccccgtaataccaaaccgcccccgggtgggaaaatcccggaaaacgggggacctggcccccaaaaacccgggatgcgaacggaagaccaaacttttccccccaacaaggaagggaagtgggttctccggggggcaaaccccc

SEQ ID NO: 59595 - protein, 102 aa, Zea mays
  misc_feature: Ceres CLONE 1516424
  misc_feature (80)..(80): Xaa is any aa, unknown, or other
  misc_feature (82)..(82): Xaa is any aa, unknown, or other
  misc_feature (87)..(87): Xaa is any aa, unknown, or other
  misc_feature (90)..(90): Xaa is any aa, unknown, or other
MNRKPGDWDCRACQHLNFSRRDICQRCSEPRGVADRGSGGGGGGGGGDYASFGGRGGSSFGGGFGAAGSDVRPGDWYCSXGXYHPPXAQXASSAPPTRRRPL

SEQ ID NO: 59596 - DNA, 697 bp, Zea mays
  misc_feature: Ceres CLONE 1516441
  misc_feature: Encodes the peptide sequence at SEQ ID NO. 59597
  misc_feature (143)..(143): n is a, c, t, g, unknown, or other
  misc_feature (235)..(235): n is a, c, t, g, unknown, or other
ccgctctagaactagtggatcccccgggctgcaggaattcgtctcacccctagaaaaatgggcaaaaaccctaatcgcatctgcttccagagccccccgccgccgctgcgccctcctctcggtcctgccgtccgtcgaggtanaaggacagcatggtgagggtcagcgtgctcaatgatgctctcaagtccatgtacaatgctgaacagatagggaaacgtcaggtcatgatcangccgtcatccaaggtgatcatcaagtacctgacggtcatgcagacgcatggctacattggcgagttccagtacgtggatgaccacagagctggaaagatcgtgctgcaactaaatggaatactgaataaatggggtgttattaaccccccttttgaatgaagtgtttaagaaaatcgaggaatggaaggccaagttttcttccatccccgcaggtttgcctaatttgcccttacaaatttgtggtgaaattttggacccctaaggagccccccccaaaaaaatgtggggccaaggttctcaggtttcttttttgaaaaaatgttttttttagacccaaatggctccccaaaaacccccgaaattttttaaggttttttaaaaagggggttttaaaccttttcccttttttaaaaaccccaatttttttttttttttcaaaattggggtttttttagaaaagc

SEQ ID NO: 59597 - protein, 80 aa, Zea mays
  misc_feature: Ceres CLONE 1516441
  misc_feature (5)..(81): Pfam Name: Ribosomal_S8 Pfam Description: Ribosomal protein S8
  misc_feature (28)..(28): Xaa is any aa, unknown, or other
MVRVSVLNDALKSMYNAEQIGKRQVMIXPSSKVIIKYLTVMQTHGYIGEFQYVDDHRAGKIVLQLNGILNKWGVINPPFE

SEQ ID NO: 59598 - DNA, 705 bp, Zea mays
  misc_feature: Ceres CLONE 1516448
  misc_feature: Encodes the peptide sequence at SEQ ID NO. 59599
  misc_feature (539)..(539): n is a, c, t, g, unknown, or other
  misc_feature (550)..(550): n is a, c, t, g, unknown, or other
  misc_feature (633)..(633): n is a, c, t, g, unknown, or other
  misc_feature (634)..(634): n is a, c, t, g, unknown, or other
  misc_feature (679)..(679): n is a, c, t, g, unknown, or other
cgctctagaactagtggatcccccgggctgcaggaattcgtctcacccctagaaaaaatatattccctcggagcaaagtgttgcggaattcacatcagccagggagaagcccgctgacagctgcaactgcaagccgccacgggctgagctgaggctgtgtcgatccatccgtattcaggaaaacaacgccaatcaatccagtccagaggaagggcgatggccgccgctaggatcgccgcctgcaccacctccgcccgcaccgccctcgccttggcagacgaccccgcgccgccggacacgctggacgtggtgcgccggcagcgccagctcctacgccgcgccgcggccctctgcctcgaccccatcgccgaggagtccgacggtggcatcgactctgcctccgacgtccactccttgggccggagccggagccggggccagaccgccgccacctccgcactgccggcgcgtccctgaggatctgaaccgtcaaagacgagaccttttccttcttgccataggaaagtgtggggacttgntcttaaatgcntagagttaagaacaaggcaacataaaaagtgttaagtggtaaagtccttcgtccttcaaagcattatatcccttcgggaaatnnatgagttcggacgaaggtcataagagacataccttcgtaaacatnaacagtaatgacgaaggactcatata

SEQ ID NO: 59599 - protein, 86 aa, Zea mays; identical to SEQ ID NO: 44775
  misc_feature: Ceres CLONE 1516448

SEQ ID NO: 59600 - DNA, 649 bp, Zea mays
  misc_feature: Ceres CLONE 1516453
  misc_feature: Encodes the peptide sequence at SEQ ID NO. 59601
  misc_feature (52)..(52): n is a, c, t, g, unknown, or other
agagctggagctcaccgcggtggcggccgctctagaactagtgattcctggnctgcaggattcgtctcgtcttagggaggctagcttagctagccagccacctccgttcactccatctcttgccggcgagtgctccgtcgatcgacccgtagccaaccaccgacaactagctagcaacaatggctgccgtcctcaacgcgcgagtcgcaactgctcgttgctcggccgccggcgggccaccacgcggtgctgcgtcttcgtttgcgccgcccactaccacgacgaggaaaaggacgaccgcccgcggcttttctgccccccgccccgccttggtctgcttccccaccgccttttttttttctccccccccccccggggagggggggggggggggggggggcctttctattaccgccggcccggcgggtcgcggccaccccccccccccccccccccccctgaaggccagagcgcccccccccctattaatttgcgcgcgatgggctgcagcgcggccccccctcatctggccctgcgtatatccgcccgcccgcgccgcttatattcgcccgcgggggggtgttttttgttgccgcgtcgcgcctccgatcaaaccctcgcggtaacggacgagtacgcactcgcaacg

SEQ ID NO: 59601 - protein, 148 aa, Zea mays
  misc_feature: Ceres CLONE 1516453
MAAVLNARVATARCSAAGGPPRGAASSFAPPTTTTRKRTTARGFSAPRPALVCFPTAFFFSPPPPGEGGGGGGGLSITAGPAGRGHPPPPPPPLKARAPPPLLICARWAAARPPLIWPCVYPPARAAYIRPRGGVFCCRVAPPIKPSR

SEQ ID NO: 59602 - DNA, 683 bp, Zea mays
  misc_feature: Ceres CLONE 1516454
  misc_feature: Encodes the peptide sequence at SEQ ID NO. 59603
  misc_feature (390)..(390): n is a, c, t, g, unknown, or other
  misc_feature (391)..(391): n is a, c, t, g, unknown, or other
  misc_feature (393)..(393): n is a, c, t, g, unknown, or other
  misc_feature (401)..(401): n is a, c, t, g, unknown, or other
  misc_feature (408)..(408): n is a, c, t, g, unknown, or other
  misc_feature (410)..(410): n is a, c, t, g, unknown, or other
cagagctggagctcaccgcggtggcggccgctctagaactagtggatttcttgggctgcaggaattcgtctcacccctagaaaaagcagcagcagcacagtcatccacactaacgaacgaactcttgctccgatcacgagctagctgaggtcgacgatggcggctgtgctgaacagcaggaagacggcgcaggcggtggtggccgtgctggtggcggcggcgctgctggcttcgtccacttcggcggcgatcacctgcgggcaggtggggtcgtcgctggcgccgtgcatcccgtacgcgacggggagggccagcgcgctccccgcgtcgtgctgcagcggcgtcaagagcctcaacagcgcgccgcggaccagcggggaccgccaggcnncntgcccctncctcacnancctcgccaacagcgtcaagagcgtcaacatgcgcaccgtcgccaccatccccggcaagggcggcgtctccgtcggattccccctcaccatgtccaccgactgcaacaagatcagctaaattaccacgaccaaactaataaggccaccgaacgtccacgaaccgcccccccgctgccccaagggaggagcccggggaagaaataaaaaaagccccctggatggcccgggacccccaggcattattttcccccctatattcccccgccgcggggg

SEQ ID NO: 59603 - protein, 123 aa, Zea mays
  misc_feature: Ceres CLONE 1516454
  misc_feature (34)..(119): Pfam Name: Tryp_alpha_amyl Pfam Description: Protease inhibitor/seed storage/LTP family
  misc_feature (79)..(79): Xaa is any aa, unknown, or other
  misc_feature (82)..(82): Xaa is any aa, unknown, or other
  misc_feature (85)..(85): Xaa is any aa, unknown, or other
MAAVLNSRKTAQAVVAVLVAAALLASSTSAAITCGQVGSSLAPCIPYATGRASALPASCCSGVKSLNSAPRTSGDRQAXCPXLTXLANSVKSVNMRTVATIPGKGGVSVGFPLTMSTDCNKIS

SEQ ID NO: 59604 - DNA, 689 bp, Zea mays
  misc_feature: Ceres CLONE 1516456
  misc_feature: Encodes the peptide sequence at SEQ ID NO. 59605
  misc_feature (509)..(509): n is a, c, t, g, unknown, or other
caaagctggagctccccgcggtggcggccgctctagaactagtggatcccccgggctgcaggaattcgtctcacccctagaaaaatagattactttcttattggccagaaattacctgtagatgtcaaagggatgatgtccagcatcgttcaaatagttgttgctccaattgctgccggattgcttctgaatagattcctaccaaggctctgtgcagctattcagccatttctcccttcgatgtcggtgtttgtcactgccctgtgtgttggctcaccattggcaataaatatcaaggctgttttgtcgccgtttggattaaccatagtgctgctcctttttgcattccacacctcatcttttgtagctggttatcatcttgctggtacttggtttcgcaagtcagacgacgtaaaggcactacaaaggacaatatcttttgagacaggaatgcaaagcagccttcttgctcttgctttagcaaataagtttcttcccagatccactangtgggtgtgccctcagccatatcgggtggtgttgatgtccttaaatgggatttgctcctgtcatgggatgggcccaagaaaaggaaaaccctaattttccttaatcaattatgcgcctgccgcctggtgttttcctgctcttattttatggggagggagggaagaaatttttcctggcct

SEQ ID NO: 59605 - protein, 156 aa, Zea mays
  misc_feature: Ceres CLONE 1516456
  misc_feature (126)..(126): Xaa is any aa, unknown, or other
MMSSIVQIVVAPIAAGLLLNRFLPRLCAAIQPFLPSMSVFVTALCVGSPLAINIKAVLSPFGLTIVLLLFAFHTSSFVAGYHLAGTWFRKSDDVKALQRTISFETGMQSSLLALALANKFLPRSTXWVCPQPYRVVLMSLNGICSCHGMGPRKGKP

SEQ ID NO: 59606 - DNA, 713 bp, Zea mays
  misc_feature: Ceres CLONE 1516463
  misc_feature: Encodes the peptide sequence at SEQ ID NO. 59607
aaagctggagctccccgcggtggcggccgctctagactagtggatcccccgggctgcaggaattcgtctcacccctagaaaaaatttttcgcccgccgcccccagtcccgatccgaagctgtgcctcgtaccatttcgatccaatggcgccgacgtcgaagctgtcgacgggcatcaagcgcgcttcgcggtcgcacgcgtaccatcgccgtgggctgtgggccatcaaggccaagaacggcggcgccttccccaaggccgacaaggccgccgccgccgtggaacccaagttctaccctgccgacgacgtcaagccccgcgttcccagcacccgcaagcctaagcctaccaagctcaggtcgagcatcccccctgggacggtgctgatccccctcgcaaggcgccccacggggaaaagaggggggtttctcaagcagctcaagcccggcctggctcctaaccctggggcctttcagaacaaagggagtacccaaccccccggggaaaccagaccctattccttgcccccccccacccaaaggtgaacatcccctgggggttaaaggccccccagttttatagaccaaggccttttcccagggaaaaaaaaatccaaagggtgaaaaaaacccccagggcaactttttttttgacccgaaaaaagggggggttcccaaggcatgtgggcgtggagttttaagaaagggatgacc

SEQ ID NO: 59607 - protein, 133 aa, Zea mays
  misc_feature: Ceres CLONE 1516463
  misc_feature (1)..(49): Pfam Name: Ribosomal_L6e_N Pfam Description: Ribosomal protein L6, N-terminal domain
  misc_feature: SWISSPROT Homolog: EC 3.1.3.56 Inositol-polyphosphate 5-phosphatase
MAPTSKLSTGIKRASRSHAYHRRGLWAIKAKNGGAFPKADKAAAAVEPKFYPADDVKPRVPSTRKPKPTKLRSSIPPGTVLIPLARRPTGKRGGFLKQLKPGLAPNPGAFQNKGSTQPPGETRPYSLPPPTQR

SEQ ID NO: 59608 - DNA, 684 bp, Zea mays
  misc_feature: Ceres CLONE 1516467
  misc_feature (362)..(362): n is a, c, t, g, unknown, or other
aagctggagctccccgcggtggcggccgctctagaactagtggatcccccgggctgcaggaattcgtctcacccctagaaaaagccggtctcttgctctgatagcttgctccaggacgtacgtacgtacgtagatcgatccatcgatcgctagctagctgacgaccatggcgtccctctcctctgccgccatcaccgccccttccttcacggccgcgcccgctcgcgcagtggtcagcaggaggtccttcaccgtgcgtgcctctctccgcaaggccactgccaccgccgccgtggccgttgccgccagcgtcctgcttgccggcggcggcgccatggcccaggaggtgctgctgggcgcangcgacggcgggctcgtcttcgagcccagccagttcaccgtcaaggccggcgacaccatcccctttcagaacaacgccggcttccgcacaacgtcgtgttcgacgaaacgaagtgccgagcggcgtcaacgccttcaagatctcccaagaggagtacctcaacccgccaggggagacctactcccgtcccctcaccgggcccggcaccctacggtttctactggcaacccgccccaagggacagggaagggccgccaaaaaacccaccccaaaaaaacgtgggtttccatttcccggcccccccaatcgggaggacccccccc

SEQ ID NO: 59609 - DNA, 631 bp, Zea mays
  misc_feature: Ceres CLONE 1516474
  misc_feature: Encodes the peptide sequence at SEQ ID NO. 59610
  misc_feature (499)..(499): n is a, c, t, g, unknown, or other
caaagctggagctccccgcggtggcggccgctctagaactagtggatcccccgggctgcaggaattcgtctcacccctagaaaaactgcccaactgcccgctgaaaaacaaactcacccaacaaagtgacctgaaactgggagcaagcaaccgagggcgagagccatggcgaagcctcgcggcggcggcggcctcctggacttagaggggcactacgccttctacggcgcctaccacagcaaccccgtcaacgtgggcatccacgagctcttcgtctggcccatcttcctcaccgcgctcatgctcctccacctcaccgccccctccacgcacgccgccggcatcagcgccgcggtctacgcggcctactacttcctcctcgaccgccgcgcgggcgcgctcgccgccctcttctgctacctctgctgggccgccagcggcgccctctctgcccgcctcggtttctctgttggatggaaggttgtagtggtggcccagntgttctgttggattatgcaattcatgggtcatggagttttcgagaagcgagcgcctgcccccccttgaacatcttggcccagctttccctaaagggcccatttctttgggctgcctaaaatttcctccccct

SEQ ID NO: 59610 - protein, 133 aa, Zea mays
  misc_feature: Ceres CLONE 1516474
  misc_feature (10)..(132): Pfam Name: DUF962 Pfam Description: Protein of unknown function (DUF962)
  misc_feature (112)..(112): Xaa is any aa, unknown, or other
MAKPRGGGGLLDLEGHYAFYGAYHSNPVNVGIHELFVWPIFLTALMLLHLTAPSTHAAGISAAVYAAYYFLLDRRAGALAALFCYLCWAASGALSARLGFSVGWKVVVVAQXFCWIMQFMGHGVFEKRAPAPP

SEQ ID NO: 59611 - DNA, 690 bp, Zea mays
  misc_feature: Ceres CLONE 1516475
  misc_feature: Encodes the peptide sequence at SEQ ID NO. 59612
  misc_feature (389)..(389): n is a, c, t, g, unknown, or other
  misc_feature (460)..(460): n is a, c, t, g, unknown, or other
  misc_feature (469)..(469): n is a, c, t, g, unknown, or other
  misc_feature (684)..(684): n is a, c, t, g, unknown, or other
gcggtggcggccgctctagaactagtggatcccccgggctgcaggaattcgtctcacccctagaaaaaatttgctgcgtctccttgcccgcgccgccgctcgccgtttgcccctcgtctccgcaccgcgcgctgttgtccatccttgtgcagcaaaaatgacggctggctacattgttggctcactggtcggatcctttgccattgcatacctgtgtgacacatttatctctgacaagaaggcatttggaggtagcacccccaagactgtttctgagaaggagtggtggcaagccacagacaccaagttccaggcctggcctcgcactgctgggccaccggttgtcatgaaccccatcagccgccagaacttcatcgtcaagtccactngagtaggtttgggctggagaagctggttctgcgacttggtgccgccatgaagccagagttccttttctaangtcttaatncattgtaataaaacgaaatacagtcaggatttttttgtgatttttacttgatctgtgagcgaacactgggtctttcaccttgtcatccaatgggttcctgctccttggtgaaatctcccaccagcagtaaagaactggagtgtttcataatatatgcttttgctacgcagcctctgctgtttgtaaggattgcattttgtatctatatcactggnatggtg

SEQ ID NO: 59612 - protein, 93 aa, Zea mays
  misc_feature: Ceres CLONE 1516475
  misc_feature (3)..(75): Pfam Name: DUF1138 Pfam Description: Protein of unknown function (DUF1138)
  misc_feature (78)..(78): Xaa is any aa, unknown, or other
MTAGYIVGSLVGSFAIAYLCDTFISDKKAFGGSTPKTVSEKEWWQATDTKFQAWPRTAGPPVVMNPISRQNFIVKSTXVGLGWRSWFCDLVPP

SEQ ID NO: 59613 - DNA, 657 bp, Zea mays
  misc_feature: Ceres CLONE 1516489
  misc_feature: Encodes the peptide sequence at SEQ ID NO. 59614
  misc_feature (320)..(320): n is a, c, t, g, unknown, or other
ctcacccgcggtggcggccgctctagaactagtggatcccccgggctgcaggaattcgtctcacccctagaaaaacagtgccgcgctgccccgcagcctcagccgcatggctctcctcgcctcccccacgccgttcggcgctgcagccatccgccgccgcgtcgccccgcttcctctcatccctgcaggcggtcgcgccgccctgcacgtggccctcgcgcgccgcggcggggtctcgtcccgcacgcagcggcgcctcgaggagcgcggaggcaagaagcgccgcggcggggtcgcggcgcctgacgtggacgaagacntcgcggaggcggggacggcggcggagtgggaaggggagccgtctggggttcaagtgtcgaacgaagccatgccggagctgccgaatcccgagagcccgacttctgggaggggcttcatgggaaggccctcgctccttcgtggcaaacatgtgggcgttccggtgcattcttcggcctattgctttggggctcccctggggcccccctaaacgaccggggccacggaattttaaaaaaccccccctgttttaaagggaatccccaatccccgggaatttccccggggggaaccggaaaaattctcaggcctcttaaatgtgttttaaaaggcaaaccc

SEQ ID NO: 59614 - protein, 140 aa, Zea mays
  misc_feature: Ceres CLONE 1516489
  misc_feature (72)..(72): Xaa is any aa, unknown, or other
MALLASPTPFGAAAIRRRVAPLPLIPAGGRAALHVALARRGGVSSRTQRRLEERGGKKRRGGVAAPDVDEDXAEAGTAAEWEGEPSGVQVSNEAMPELPNPESPTSGRGFMGRPSLLRGKHVGVPVHSSAYCFGAPLGPP

SEQ ID NO: 59615 - DNA, 726 bp, Zea mays
  misc_feature: Ceres CLONE 1516494
  misc_feature: Encodes the peptide sequence at SEQ ID NO. 59616
  misc_feature (530)..(530): n is a, c, t, g, unknown, or other
  misc_feature (681)..(681): n is a, c, t, g, unknown, or other
  misc_feature (726)..(726): n is a, c, t, g, unknown, or other
ctccccgcggtggcggccgctctagaactagtggatcccccgggctgcaggaattcgtctcacccctagaaaaagtcaaaccaggacaacatgatacacatctgcattctgctgctgttcgcatacagaacaagtttcgcggatggaagggaagaaaggaatttatgatcattcgccagagaattgtcaagctacaggctcatgtacgaggacatcaagtgaggaagaactatcggaaggtagtctggtcagtcggtatcgtcgagaaggtcatactgagatggaggagaaagaggcctgggttacgcgggtttcggcccgagaaacaactagaaggtccatcgcaaatccaacctgcaaaggctgaagatgaatacgatttcttgcacgacggcagaaggcaggccgaagccaggctacagagagcacttgcccgggtgcactctatgtcacagtacccagaagcgagagagcagtaccacaggcttacaacctgcgttgctgaaatgaaacagtccaggatgatgcangatgagatgctaagccaggcggctggtggtgcggacgatttcatggctggactggaggacttgatctgcatagatgatgccccgccccgatgtctgccattcggtgaagctgagcctttttacatcagataggcaggggaggcggtttccnttgctccccctttgtcagactagccctgtaaatatccttcagctn

SEQ ID NO: 59616 - protein, 219 aa, Zea mays
  misc_feature: Ceres CLONE 1516494
  misc_feature (58)..(78): Pfam Name: IQ Pfam Description: IQ calmodulin-binding motif
  misc_feature: The sequence is a functional homolog of SEQ ID NO 1309 in the 10/666,642 US patent application
  misc_feature: The sequence is a functional homolog of SEQ ID NO 1308 in the 10/666,642 US patent application
  misc_feature (176)..(176): Xaa is any aa, unknown, or other
PRGGGRSRTSGSPGLQEFVSPLEKVKPGQHDTHLHSAAVRIQNKFRGWKGRKEFMIIRQRIVKLQAHVRGHQVRKNYRKVVWSVGIVEKVILRWRRKRPGLRGFRPEKQLEGPSQIQPAKAEDEYDFLHDGRRQAEARLQRALARVHSMSQYPEAREQYHRLTTCVAEMKQSRMMXDEMLSQAAGGADDFMAGLEDLICIDDAPPRCLPFGEAEPFYIR

SEQ ID NO: 59617 - DNA, 638 bp, Zea mays
  misc_feature: Ceres CLONE 1516496
  misc_feature: Pfam Name: LIM Pfam Description: LIM domain
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (534)..(534): n is a, c, t, g, unknown, or other
aagctggagctcaccgcggtggcggccgctctagaactagtggatcccccgggctgcaggaattcgtctcacccctagaaatgcaccgcctgcgacaagactgtgtaccttgtggacaagctcaccgccgacaaccgcatctaccacaaggcctgcttccgctgccaccactgcaagggcaccctcaagctcgccaactacaactccttcgagggagtgctctactgcaggcctcacttcgaccagctgttcaagaggacagggagcttggacaagagcttcgaaggaactcccaaggttgtcaagccagaaaagaaacgtttgggaatgaaaaaagcttactaaaagtccccaagccgccctttgccttgggccccccaaaaaaaaaaaaaacgtttcttctgtattttggttaaaaaaaaaaactcccccccccccccgcagggggggccccggttaaaaacaccctttttttttcccaaaaaaaacgtctccttaaactgtctccccccaggggggggggcgcannngganagcacgccccttcctaaaaaataattatcccccaaggaaagaaagaaataattttttttgggtaactacaccccccaccccccatcttataatcaaaaggagaa

SEQ ID NO: 59618 - DNA, 719 bp, Zea mays
  misc_feature: Ceres CLONE 1516508
  misc_feature: Encodes the peptide sequence at SEQ ID NO. 59619
cgcggtggcggccgctctagaactagtggatcccccgggctgcaggaattcgtctcacccctagaaaaagccatccatttttcatatcctcactcgccgccgccgccgctcgtccctcgccccatcgcgatggcccggatcaaggtgcacgagctgcgggggaagagcaaggcggatctgcaagcgcagcttaaggagtttaagtcggagctctccctgctacgcgtagccaaggtcaccggcggggctcccaacaagctctccaagatcaaggttgtgcgcacctccatcgcgcgcgtgctgaccgtcatctcgcaaaaacaaaaatcggcgctgcgtgaggcctacaaaaaaaagaagctgctcccgctcgacctccgcccccagaagacccccccccatccgcaggggccctcaccaagcacccagctctccttggaaaacccaaaagggaaaaagaaagcgtgggaaagtattttcccccttggagaaagtacccctatccagggcccaaaatcaggggaaagaaaactttttttccccggcccaggttttggccccagaaaggttcctttggattttgagaaaaaaatccttttcctccttccccagggaaccattgggggccctagaatccaagtggggttgggaggaaaaaatcccgggggtcccttttttttgggttgggttttaaaaaaaaaagcacacagtgcacgcgc

SEQ ID NO: 59619 - protein, 196 aa, Zea mays
  misc_feature: Ceres CLONE 1516508
  misc_feature (6)..(64): Pfam Name: Ribosomal_L29 Pfam Description: Ribosomal L29 protein
MARIKVHELRGKSKADLQAQLKEFKSELSLLRVAKVTGGAPNKLSKIKVVRTSIARVLTVISQKQKSALREAYKKKKLLPLDLRPQKTPPHPQGPSPSTQLSLENPKGKKKAWESIFPLGESTPIQGPKSGERKLFFPGPGFGPRKVPLDFEKKILFLLPQGTIGGPRIQVGLGGKNPGGPFFLGWVLKKKAHSAR

SEQ ID NO: 59620 - DNA, 787 bp, Zea mays
  misc_feature: Ceres CLONE 1516516
  misc_feature: Encodes the peptide sequence at SEQ ID NO. 59621
  misc_feature (318)..(318): n is a, c, t, g, unknown, or other
tccccgcggtggcggccgctctagaactagtggatcccccgggctgcaggaattcgtctcacccctagaaaaagtgtccagaagacgcctcagccaccgcaaaatccccaaatccgcggcggagaggagagagccggagagaggggcgcatccagagagatcggagaaggggaataagatggtgcgggtggctacctacttcccgatgaccttcggggcgttcctcttctggcagtccatggacagggtccacgtctggatcgcccttcaccagtacgagagaaggagggggtggaatcggacctgggattttaaganaatggaggccaagttcctggccccaacctaatttgtccccccccccggtgggggggggggggggggggcttccagtaaattcctttcaccccacttgcctgctggtgggtttttccctgtgccatttccctgggcggggggggcgcctccggccctccgtccgttcgaattagagccgggtgcttggctttccggcgtcttttggagccgcgctcgtggggtattcccacgtgggcgttgtgtgtttggggtgttttgattgtttgtacgactgtccccgcgaccttaccgaggtgtggtcctcctcccttgtcttgcgctggggacgcggttggagtcgttattttgctcgtggcctttatcttatgtcgctctgtaggcccgcttgttttgtgtgctttcccgctcgtcgctcctctggcttgttttcacctctcgtgtcgccgctcttcctgcctctcggctcttg

SEQ ID NO: 59621 - protein, 56 aa, Zea mays
  misc_feature: Ceres CLONE 1516516
  misc_feature (47)..(47): Xaa is any aa, unknown, or other
MVRVATYFPMTFGAFLFWQSMDRVHVWIALHQYERRRGWNRTWDFKXMEAKFLAPT

SEQ ID NO: 59622 - DNA, 718 bp, Zea mays
  misc_feature: Ceres CLONE 1516519
  misc_feature (484)..(484): n is a, c, t, g, unknown, or other
  misc_feature (493)..(493): n is a, c, t, g, unknown, or other
  misc_feature (497)..(497): n is a, c, t, g, unknown, or other
  misc_feature (498)..(498): n is a, c, t, g, unknown, or other
  misc_feature (509)..(509): n is a, c, t, g, unknown, or other
  misc_feature (526)..(526): n is a, c, t, g, unknown, or other
  misc_feature (612)..(612): n is a, c, t, g, unknown, or other
ctccccgcggtggcggccgctctagaactagtggatcccccgggctgcaggaattcgtctcacccctagaaaaaaattggaaaaggctgatgtatacaggttaccgtatctatccagtggcgctcctggattcgctttgcttgaagctgccaggaagatcaatttccaagatgtactaagtagaatttccgccggattttcgtccaacggttgggaaaaaccaatactgcttgcatggggaatatctgacaagtacttaccgctctcgatagctgaggaattcaagcaagctaatcctggcgttgtaaaactagaggcgatagaaggagctggtcacatgccgcaagaggactggccggagaaggttgtgaaggcgctgacatccttcctgtaacatgtgcaaagatcattatgtcatccgcacgggagctttcaaagatgcatgatgaatgtcgtggcttcattacgtcctcctgtctaattngatatgccntggnnatgctagattngtgactgtacgggtcangatgtatattagcaaacgctttgcatttgtaaattgcgacgtggacgatatcagcgacgttgttagctcacgtaagagatggatancatggtgggtttctgttctcttttaaaaagggaaaccaagtttcgggttttgtccccttaaaaaaaaaaaaaaacgaaacgccgagggaccaatttccccttaagg

SEQ ID NO: 59623 - DNA, 659 bp, Zea mays
  misc_feature: Ceres CLONE 1516521
  misc_feature: Encodes the peptide sequence at SEQ ID NO. 59624
  misc_feature (659)..(659): n is a, c, t, g, unknown, or other
acagctggagctccccgcggtggcggccgctctagactagtggatcccccgggctgcaggaattcgtctcacccctaggaaactcctcgaaaccctagcgccggcgcctccacttcgttttcctcactctctcctccagctcagggtccggcggcgaagggaaggcaagatgtacaccgcgaggaagaagatccagaaggagaagggtcttgagccctccgagttcgaggactccgttgcccaggctttctttgatctggagaacgggaaccaggagctcaagagcgacctcaaggacctgtacatcaacaatgctatccagatggatgttaccgggagtaggaaggctgttgtcattcacgtcccataccgccgggggaggggcttcaggaaaatccatgtcagacgccccaggaagctggaaaaaaattcagcggcaaggaggtggaatttgttgctccacgaagaattgggagcccacccaagaaggtccagctgttccgccccctcccaaccagaactcgaacggctgttccacagggccatctggaagaatgttcccaaccccgctggaaaatggggggaaagccctgccaaaaacccgcctcgatagggtccaaaaatatccaaaactgcccgggaacccaaaagaaaaagan

SEQ ID NO: 59624 - protein, 147 aa, Zea mays
  misc_feature: Ceres CLONE 1516521
  misc_feature (6)..(145): Pfam Name: Ribosomal_S7e Pfam Description: Ribosomal protein S7e
MYTARKKIQKEKGLEPSEFEDSVAQAFFDLENGNQELKSDLKDLYINNAIQMDVTGSRKAVVIHVPYRRGRGFRKIHVRRPRKLEKNSAARRWNLLLHEELGAHPRRSSCSAPSQPELERLFHRAIWKNVPNPAGKWGESPAKNPPR

SEQ ID NO: 59625 - DNA, 769 bp, Zea mays
  misc_feature: Ceres CLONE 1516522
  misc_feature: Encodes the peptide sequence at SEQ ID NO. 59626
  misc_feature (56)..(56): n is a, c, t, g, unknown, or other
  misc_feature (82)..(82): n is a, c, t, g, unknown, or other
  misc_feature (87)..(87): n is a, c, t, g, unknown, or other
  misc_feature (177)..(177): n is a, c, t, g, unknown, or other
  misc_feature (561)..(561): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (716)..(716): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (726)..(726): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (733)..(733): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (740)..(740): n is a, c, t, g, unknown, or other
  misc_feature (769)..(769): n is a, c, t, g, unknown, or other
catagctggagctctactgcggtggcggccgctctagaactagtggatttcttggnctgcaggaattcgtctcatccctagnggagngccccactctctccatctagagctccctaactgcaccggccgccacaccaccgtaccccgacccctcgacaacaatggccaccgtcctangcagcccccgcgcgccggccttcttcttctcgccgtcctccctccgtgccgcgtcggggcccaccgccgtggcgctgcctgcggccaaggtgggcatcatggtgccctagcggcaggagcaggggcaggtcttccctcgtctggccacctatcaacgtaaagttgatcaccccgtaattgggagggggtttgttccccccggcggggggcgggtggtgaatctcttggaccaccccccactaagggacggcttcttacccggcccttacttcctggtggcggggggggtgtcttgttttcttcccggcgtccgggatgggtgtgtctctcctacttccctctcaacctattcccgaccggcaatatatcctcttgcagcgggcncccgattttcatgttggtgtgtggtgttctcgcgtttttttagtggccccggccactagtccgcgttgggattttttcttcctcactcactgatttcgttttcttatatacgcccgcgtcccgccgcgttttattatttgggtctggnnnnnntntgnnnntgtnttnnncntnnntgngactcgttgctttggtccgcgttgttttn

SEQ ID NO: 59626 - protein, 41 aa, Zea mays
  misc_feature: Ceres CLONE 1516522
  misc_feature (6)..(6): Xaa is any aa, unknown, or other
MATVLXSPRAPAFFFSPSSLRAASGPTAVALPAAKVGIMVP

SEQ ID NO: 59627 - DNA, 701 bp, Zea mays
  misc_feature: Ceres CLONE 1516524
  misc_feature: Encodes the peptide sequence at SEQ ID NO. 59628
  misc_feature (313)..(313): n is a, c, t, g, unknown, or other
  misc_feature (436)..(436): n is a, c, t, g, unknown, or other
cagagctggagctccccgcggtggcggccgctctagaactagtggatcccccgggctgcaggaattcgtctcacccctagaaaaaaaaaggcaaaagctccccaacgaagtgcgagcgacccacgtccacacgacacgaaccaccaccaccaaccagcagccgcaccacgcacccagcgcaaagcgatggcgtcgctcaccatgatggcgtccttcgccgccgtggcggtggccgcgccctcgcgccgcggcaccttcgccgtggtcaggtccgccaaggtcgaccgctgccaggagcccgccacgctagcancaaccgaggccaggcccgccgccgacggacgccgcgccgtcatgctcgcggctgctgcggcggccggggcagccatcggcggcgccggcccccccatggcgggccccaagaacgggacccccnaggcgaagaagaagtacccggccatctgcgtcacctgcccaccgccaagggcggccacaactgagcacccccggtttgcagctgcaggggccggggggtgggtatataaataacggcccgcgcccccgtgttggttgtcccctaatggtgggttcgggcctttgaatagcgaggctgcaccgaggggccttttatattggcttcccgacgtccctctggagcgacaggagaacccagcgcctttgggagaagcggaagcttgtgg

SEQ ID NO: 59628 - protein, 120 aa, Zea mays
  misc_feature: Ceres CLONE 1516524
  misc_feature (43)..(43): Xaa is any aa, unknown, or other
  misc_feature (84)..(84): Xaa is any aa, unknown, or other
MASLTMMASFAAVAVAAPSRRGTFAVVRSAKVDRCQEPATLAXTEARPAADGRRAVMLAAAAAAGAAIGGAGPPMAGPKNGTPXAKKKYPAICVTCPPPRAATTEHPRFAAAGAGGWVYK

SEQ ID NO: 59629 - DNA, 609 bp, Zea mays
  misc_feature: Ceres CLONE 1516525
  misc_feature: Encodes the peptide sequence at SEQ ID NO. 59630
  misc_feature (412)..(412): n is a, c, t, g, unknown, or other
aaagctggagctccccgcggtggcggccgctctagaactagtggatcccccgggctgcaggaattcgtctcacccctagaaaaaaggagaagctatctattggccatctatccagcagccgctctccccagccccactctctccatctagagctccctaactgcaccggccgccacaccaccgtaccccgacccctcgacaacaatggccaccgtcctaggcagcccccgcgcgccggccttcttcttctcgccgtcctccctccgtgccgcgccggcgcccaccgccgtggcgctgcctgcggccaaggtgggcatcatggggccgtagcgccagcagcaggggcaggctgcgcgcgcaagccacctacaacgtgaagctgatcaccccggaaggggagggtgagctgcangtgcccaacgacgtgtacatcctgggaacaggcccagggatgaacggatcgacccggccctactcctggcgcgggggggtcctgctccctcctgcgcccggaaaggtcgtcctccggcttccgtggaaccaatcccaacccaaaacttcccccgaaaaaaggccaaaattcgccccccgggtggggggcccccccgg

SEQ ID NO: 59630 - protein, 41 aa, Zea mays
  misc_feature: Ceres CLONE 1516525
MATVLGSPRAPAFFFSPSSLRAAPAPTAVALPAAKVGIMGP

SEQ ID NO: 59631 - DNA, 680 bp, Zea mays
  misc_feature: Ceres CLONE 1516528
  misc_feature: Encodes the peptide sequence at SEQ ID NO. 59632
  misc_feature (680)..(680): n is a, c, t, g, unknown, or other
agagctggagctccccgcggtggcggccgctctagaactagtggatcccccgggctgcaggaattcgtctcacccctagaaaaagtcccacagtgcctgccaccacaaaccctcctccagtgctcttctcttctagccgccgccgcaaccgcttgctagcgctctgcgctctcatcctcacgtccgtggaaggtcgtgtcgccatggcctccgagacggagacgttcgccttccaggcggagatcaaccagctgctatcgctcatcatcaacaccttctactccaacaaggagatcttccttagggagctcatttcaaactcctccgatgccttggataagatcaggttcgagagtttgacggacaagagcaagctggatgcccagccggagctgttcatccacatcctccctgacaaggccaacaataccctgacaatcattgacagtggcattggtatgaccaactcggaccttgtgaacaaccttggtaccattgcacgatctggcacaaaagagttcatggaggcactgactgctggtgccaatgtgtccatgataggtcagtttggtgtccgtttctactcggcatacttagttgctgacagggttgtcctgacccccaactcaaccatgatgaccagtttgtatgggagtctcaggccgtggcttctttcctgn

SEQ ID NO: 59632 - protein, 158 aa, Zea mays
  misc_feature: Ceres CLONE 1516528
MASETETFAFQAEINQLLSLIINTFYSNKEIFLRELISNSSDALDKIRFESLTDKSKLDAQPELFIHILPDKANNTLTIIDSGIGMTNSDLVNNLGTIARSGTKEFMEALTAGANVSMIGQFGVRFYSAYLVADRVVLTPNSTMMTSLYGSLRPWLLS

SEQ ID NO: 59633 - DNA, 656 bp, Zea mays
  misc_feature: Ceres CLONE 1516532
  misc_feature: Encodes the peptide sequence at SEQ ID NO. 59634
  misc_feature (597)..(597): n is a, c, t, g, unknown, or other
aaagctggagctccccgcggtggcggccgctctagaactagtggatcccccgggctgcaggaattcgtctcacccctagaaaaaatccactgcggcacgcgtcccgcctctggtttgcttgcctcccagatcttgccaactaattggaggcagccgagctgatctcccatcccgcaacgcgccgtctcgacggcggatcgttttcttctgcttctactgcgtgatctttgggcaagaagataagacacgtccaagcgtcgccacagtcaagggcggcttggttgcagtcaagatggggaaggacagagaatctgccaagctgaaggaggagaaggggtccaaggatgagatccatatgaaggtcaagagcaagggcgagccgtccggcgaggaagacggcaaggaggaggtcgaggtagagattgaggccaagtttgttgagaaggaagaggtcacaggctcgggtgacggtgcgggaggaaagggtaccaagaagaatgatactaaggagaaagacaagaaaaagaaggaaggtggtgacgattcacggaaggcagaggaagacaataagggtaaagcgaaggattcggagggcangggcccagtgaagaaggaaaagaaggatggtgctggggacgacggatgcgaagagaagg

SEQ ID NO: 59634 - protein, 121 aa, Zea mays
  misc_feature: Ceres CLONE 1516532
  misc_feature (102)..(102): Xaa is any aa, unknown, or other
MGKDRESAKLKEEKGSKDEIHMKVKSKGEPSGEEDGKEEVEVEIEAKFVEKEEVTGSGDGAGGKGTKKNDTKEKDKKKKEGGDDSRKAEEDNKGKAKDSEGXGPVKKEKKDGAGDDGCEEK

SEQ ID NO: 59635 - DNA, 479 bp, Zea mays
  misc_feature: Ceres CLONE 1516535
  misc_feature (341)..(341): n is a, c, t, g, unknown, or other
  misc_feature (342)..(342): n is a, c, t, g, unknown, or other
  misc_feature (343)..(343): n is a, c, t, g, unknown, or other
  misc_feature (355)..(355): n is a, c, t, g, unknown, or other
  misc_feature (356)..(356): n is a, c, t, g, unknown, or other
  misc_feature (453)..(453): n is a, c, t, g, unknown, or other
aaaagctgggagctccaccgcggtggcggccggctctagaactagtggatcccccgggctgcaggaattcgtctcacccctagaaaaagacgcccccatttcgaagctcctcctcgcgattccaatccacgcacgcccatctccgactccgcgtccgcctcgcgcaggacatatattcagtgatggaacacaaggaggccggctgccagcagccggagggcccaatccctatgcattaaataactggtggtttcctttgggaagccctggccaccatgaaacaatggtgctcccaaggtggcccccaaggaaaaatgaaataatgaaaaccccgggagccnnnggcccccccagnntctgggggtgggccttccccccccaatcagaaaaaaggcaatttgggtccaaaaggggccgggggaaaaaaaaggggggaaaaaaggggaacccttnggcaaaaattcgcccgccaaacaccg

SEQ ID NO: 59636 - DNA, 675 bp, Zea mays
  misc_feature: Ceres CLONE 1516550
  misc_feature: Translation starting site: 516
aaagctggagctccccgcggtggcggccgctctagaactagtggatcccccgggctgcaggaattcgtctcacccctagaaaaaaaacccaacccatcatcatctatctagactagagcaagctaagctcaagctcggctagcattccagaagctgcatctatcagctaccggcctctcgattcatcgcttgcgatcgaatggagaagatgaacgtggttgcgagcaggaagcagcccggcgactggagctgccggtcgtgccagtacgtgaacttctgcaagcgcgacgcgtgccagcgctgcggcgagggcaagctgggccgtggagcgcacggactacgcggcgctgggcggcgactgggacgtgaagcccggcgactgggactggctacggtgcggcttgaacaactaccccctcccgcgccagctgcttcgagtgggccgcctccaagaacgagcccacggccgcccgtccccagggctggggggacaccgttccccggccaggccggaaatgatgccccggggaactggatcctgccccaaaactgggggttgcaacggtgcagaaacttcccccaacccgaacccgagtggctttcccggggggactgtttgccccaaaatcgtaacttaaggatttaaatgggggacccacacgcgggcccggagcc

SEQ ID NO: 59637 - DNA, 704 bp, Zea mays
  misc_feature: Ceres CLONE 1516551
  misc_feature: Encodes the peptide sequence at SEQ ID NO. 59638
  misc_feature (653)..(653): n is a, c, t, g, unknown, or other
aaagctggagctccccgcggtggcggccgctctagaactagtggatcccccgggctgcaggaattcgtctcacccctagaaaaagtgggttgtggcctcctataatcctgtcctcgcgttactactagttagttagagagacagagaggatcgatctgctggcggcgtctaagctggagaaaggcggcgccaccgccgagggcgacgagataggcatcgacccagcggcggagactccggagcagcgcaacaagttcctggtcctccgcctgtacgaggcgctcaacgcccgggaccacgccgccgtgcagtcgctgctggcgccggacctggagtggtggttccatggcccgcccaagcaccagcagcacatgatgcgcctcctgacaaccaccaccaccaccaccaccggcagcttccgcttcgtgccccgctccgtggacgccctcgccgcctcgtccggcaccgtcatcgccgagggccacgagaggggttgctactgggtgcacgcctggaccgtgggacccgatggggtgatcacccagctccgtgagtacttcaacaccgacctcaccgtcacccgcctcgccgccgccgtcgccgccaagtgcgtctggcagagccgccgccccgacagcgccaccaactccctngccgggactcctgctcgccctctgatcactctgagggataaattaaatacc

SEQ ID NO: 59638 - protein, 111 aa, Zea mays
  misc_feature: Ceres CLONE 1516551
  misc_feature (2)..(105): Pfam Name: WI12 Pfam Description: Wound-induced protein WI12
MMRLLTTTTTTTTGSFRFVPRSVDALAASSGTVIAEGHERGCYWVHAWTVGPDGVITQLREYFNTDLTVTRLAAAVAAKCVWQSRRPDSATNSLAGTPARPLITLRDKLNT

SEQ ID NO: 59639 - DNA, 716 bp, Zea mays
  misc_feature: Ceres CLONE 1516558
  misc_feature: Encodes the peptide sequence at SEQ ID NO. 59640
  misc_feature (414)..(414): n is a, c, t, g, unknown, or other
  misc_feature (454)..(454): n is a, c, t, g, unknown, or other
  misc_feature (478)..(478): n is a, c, t, g, unknown, or other
  misc_feature (481)..(481): n is a, c, t, g, unknown, or other
  misc_feature (507)..(507): n is a, c, t, g, unknown, or other
  misc_feature (515)..(515): n is a, c, t, g, unknown, or other
  misc_feature (521)..(521): n is a, c, t, g, unknown, or other
  misc_feature (539)..(539): n is a, c, t, g, unknown, or other
  misc_feature (545)..(545): n is a, c, t, g, unknown, or other
  misc_feature (551)..(551): n is a, c, t, g, unknown, or other
  misc_feature (552)..(552): n is a, c, t, g, unknown, or other
  misc_feature (557)..(557): n is a, c, t, g, unknown, or other
  misc_feature (584)..(584): n is a, c, t, g, unknown, or other
  misc_feature (657)..(657): n is a, c, t, g, unknown, or other
  misc_feature (658)..(658): n is a, c, t, g, unknown, or other
acccgcggtggcggccgctctagaactagtggatcccccgggctgcaggaattcgtctcacccctagaaaaagtgctttcttagaggtgggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggcccgcacatcaccgtncacgaggcccagtcccgcggcggccgtggaggcggcggcngtgggtacggtggtggccgtgaangcngcggctacgggcgtggcgggcgcccntgatggcngtggcngctacggcggtggcggcngctacngtggcnngcgcngctacggtggtgggtgcggcggctacngcggtggcaccgtggcggcggctacgggcactcccgacggaactgggagaaactgagcgtggggcccgcgcgnncaagtatccctgtcgctaccgtgatgtttaccctagtccagagggttattctcggtcg

SEQ ID NO: 59640 - protein, 112 aa, Zea mays
  misc_feature: Ceres CLONE 1516558
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (95)..(95): Xaa is any aa, unknown, or other
  misc_feature (103)..(103): Xaa is any aa, unknown, or other
  misc_feature (104)..(104): Xaa is any aa, unknown, or other
MAASDVEYRCFVGGLAWATDDHSLHNAFSTYGEVLESKIILDRETQRSRGFGFVTFSTEEAMRNAIEGMNGKELDGPHITVHEAQSRGGRGGGGXGYGGGREXXGYGRGGRP

SEQ ID NO: 59641 - DNA, 789 bp, Zea mays
  misc_feature: Ceres CLONE 1516565
  misc_feature (391)..(391): n is a, c, t, g, unknown, or other
gctctagaactagtggatcccccgggctgcaggaattcgtctcacccctagaaaaactctcgattcggaaaaccctccaaccctagccgggatccgacaacgcctccatccctagccgcctcctggaagtttcaaagctgaagaggccgggcgccatggcgacagatacggatactttcgcccctcacgctgagatccccccgctgctctccctcatcatcaatccctttcactccccccacgggacattttcttttttccgcccagtgaggaggcccccattatgctctcgtatattttcctgcgcccatcgcgccgctgtcccaagcccttttttttttccccccccccgggggggaaagaaagggggtttttcccccccccaatctcncaatccccccccctttatttccagtaccctccgtccgtccctcccctcccccgtcccggggcgcggagccctcttttctccctaccctcgcgctatcttccgccgctgcgcaccgtccggccttctcgccctatcgtgcgccccctccccccgacacgatcccccctcttcccgccgttcccctatcttccgtagcggcgtcacgcgcgggtagcgcccataccttcctctttcacaacgccctcctctgatgccgcttaccgcccgtctgcatccccaacaatccctaccgccaatgtcccaccacttcctctttctctctcctgtctttccccccctccacggccgcatttattctcccagtcccccgcctatcccactagacccttatcccgtcc

SEQ ID NO: 59642 - DNA, 820 bp, Zea mays
  misc_feature: Ceres CLONE 1516573
  misc_feature: Encodes the peptide sequence at SEQ ID NO. 59643
  misc_feature (21)..(21): n is a, c, t, g, unknown, or other
  misc_feature (23)..(23): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (54)..(54): n is a, c, t, g, unknown, or other
  misc_feature (55)..(55): n is a, c, t, g, unknown, or other
ccgttctgtggtgggggtttnancccgggggggggggtttgtatatnnnntccnntttttcaaagctggactccccgcggtggcggccgctctagaactagtggatcccccgaggctgcaggaattcgtctcacccctagaaaaaaagaccaccgacgcgtagcacagtccattattgccgtctcccttttgcgtgagcaaagaaagagagcgagaagagcagtcgccatgtctgggatcatccacaagatcgaggagaagctccacatggggggcgaccacttgattaacgaggaggagcaccacaggaaggccgaggagctccactggaaggaggagggggaggaccactggaaggacggggggggagcacacggaatgcatcgtgggagaagatcgggggacaagattgaccgggtggagcactggggaccaggcgcgggctaccttgttggtaagcgaaggaccacgtatttttgtgtgaaagcaccggcccaagcggccacgaaaccacccgagcatgttggccctcaggtatgtcacgtcaacaaggccgactcagcgtacctagaactatccttgggtggttcggcgagggaaaatttcaatgtgaattctgcggggcgctggggcgtgtttctaccgccttggctctggcattcgggtcaccggatttttgtctatttgtttgatgtcagtggctattgaacaacgtctcttagagtgggagccctgacaataattactgaaatgctctggccctctattgatcggcggtcaagtggggtgacgcacagtccagtgtaaagtggcctgaggt

SEQ ID NO: 59643 - protein, 159 aa, Zea mays
  misc_feature: Ceres CLONE 1516573
MSGIIHKIEEKLHMGGDHLINEEEHHRKAEELHWKEEGEDHWKDGGGAHGMHRGRRSGDKIDRVEHWGPGAGYLVGKRRTTYFCVKAPAQAATKPPEHVGPQVCHVNKADSAYLELSLGGSARENFNVNSAGRWGVFLPPWLWHSGHRIFVYLFDVSGY

SEQ ID NO: 59644 - DNA, 703 bp, Zea mays
  misc_feature: Ceres CLONE 1516585
  misc_feature: Encodes the peptide sequence at SEQ ID NO. 59645
aaagctggagctccccgcggtggcggccgctctagaactagtggatcccccgggctgcaggaattcgtctcacccctagaaaaattcctcggagaggagaagccgccgtcgcagcaatcacagcagcccggagaacggccaggtccgacaagatgcagatctttgtgaagacgctgacagggaagaccatcaccctcgaggtcgagagcagcgacaccatcgacaatgtcaaggccaagatccaggacaaggaagggatcccgccggaccagcagcggctgatctttgccgggaagcagctggaggatggccgcacccttgcggactataacatccaaaaggagtctacgctccacctcgtggtcatggctccccgggggcatcgttgatgccctcgctgcaggccctcccctcgcaggtccacgagggacaatattatcctgccttaaaatgctatgcactggctgcacccctagggcttttccacctgcctgaaagaataaaatgtgggttcccagcaacccatctttaggggcccaagaatgaaatttcttgaaccttgatggtgttttcctgccttgatttggttttccatggcaacaatggtttgttttgggcttcttttgacaccttttgttttgtttttaccaaaacccggtaatgtttttttcttttgcgcttacggttcgtaaacctgtgtctg

SEQ ID NO: 59645 - protein, 78 aa, Zea mays
  misc_feature: Ceres CLONE 1516585
  misc_feature (6)..(74): Pfam Name: ubiquitin Pfam Description: Ubiquitin family
  misc_feature: SWISSPROT Homolog: EC 3.1.2.15 Ubiquitin thiolesterase
MQIFVKTLTGKTITLEVESSDTIDNVKAKIQDKEGIPPDQQRLIFAGKQLEDGRTLADYNIQKESTLHLVVMAPRGHR

SEQ ID NO: 59646 - DNA, 636 bp, Zea mays
  misc_feature: Ceres CLONE 1516587
  misc_feature: Encodes the peptide sequence at SEQ ID NO. 59647
ctccccgcggtggcggccgctctagaactagtggatcccccgggctgcaggaattcgtctcacccctagaaaaattggttggagcagttttcctaaatctactcttagaaaatgatcgagcgtttgacattctttactgcataaccttcaaactgatggatcagaaatggcttgaaatgcacgccagttacatggatttcaatgtggttattaaatctacacggcgccagctcgagagggagctgttgctagaagacatccagaggatccaggacatgccatcatacatgcttctcacctgctagcaattgaacttggtcatacctaacattgcagcaaggtagtgcatctccatacactcgaagaagttgcgacgttggaaccacgtataccgaagctcactatggggggcgtgggcgatctaggttcatggactgtggatgtgctgctttaaattgtcgtgtttacctacttgacaacaaccttaacaaccaaatgccttttcgtttggaacaatgccctgccatcttggaacctaactttccgttgtaaaccgggacctacaggagagaaccgtgggaaaccttgtcccaaaaaaaaaatttgcaaccccctggtgctatgcccaaaataaaa

SEQ ID NO: 59647 - protein, 100 aa, Zea mays
  misc_feature: Ceres CLONE 1516587
PRGGGRSRTSGSPGLQEFVSPLEKLVGAVFLNLLLENDRAFDILYCITFKLMDQKWLEMHASYMDFNVVIKSTRRQLERELLLEDIQRIQDMPSYMLLTC

SEQ ID NO: 59648 - DNA, 741 bp, Zea mays
  misc_feature: Ceres CLONE 1516596
  misc_feature: Encodes the peptide sequence at SEQ ID NO. 59649
  misc_feature (379)..(379): n is a, c, t, g, unknown, or other
  misc_feature (474)..(474): n is a, c, t, g, unknown, or other
  misc_feature (519)..(519): n is a, c, t, g, unknown, or other
  misc_feature (537)..(537): n is a, c, t, g, unknown, or other
atatctggagctcaccgcggtggcggccgctctagactagtggatccccagggctgcaggaattcgtctcacccctagaaaaatctctaatcttcgggttcgcgtcgcagtgtcttccgcccgggctaccaccatgccgaagcagatccacgagatcaaggacttcctgctgactgcgcggcggaaggacgcacggtcggtgcggatcaagcgggccaaggacgccgtcaagttcaaggtgcgctgctccaggtaccttctacaccctctgcgtccccgacgccgacaagggcaacaaggtcaagaaatcccctcccccccggttctgactgcccccgggaaatttttagggtatgaaggccaaataaacgggggactntttttttgcggggggtaagggaagtttttgtctccccatgagttaatccccccccccccccccgggggggccccccacttacgctcggggtcttncaattctaactttatctaaaatctcttaaattttctgggtatagncgatataggatatgctgncaaaacacctctcagacccctctgctttcgcgattgggtttaatccctcgtaccccccccaggcgcgtcgggccctccgcgccccgcacacctccaaccgcgcaatcccccgcggatcttttcgccccccccgacacagatcgcaagaaagccgaccccgcgtcacctcgaatgtccccctcgcctctgccccgtaccgtgtgt

SEQ ID NO: 59649 - protein, 87 aa, Zea mays
  misc_feature: Ceres CLONE 1516596
  misc_feature (2)..(59): Pfam Name: Ribosomal_L38e Pfam Description: Ribosomal L38e protein family
MPKQIHEIKDFLLTARRKDARSVRIKRAKDAVKFKVRCSRYLLHPLRPRRRQGQQGQEIPSPPVLTAPGKFLGYEGQINGGLFFCGG

SEQ ID NO: 59650 - DNA, 638 bp, Zea mays
  misc_feature: Ceres CLONE 1516599
  misc_feature: Encodes the peptide sequence at SEQ ID NO. 59651
atagctggagctcaccgcggtggcggccgctctagactagtggatcccccgggctgcaggaattcgtctcacccctagaaaaaacacactcgactctcctctctcgcatccgcagcctttcgagctctactccaccccctcgatctcgaagcgcagcagcagcagtcaggcggccatggacgcgagcgcagccggagccggcgggaaggcgaagaagggcgcggccgggcgcaaggccggcgggccgaggaagaagtcggtgacgaggtccgtcaaggccgggctgcagtttcccgtcggccgcatcgggcggtacctgaagaagggccggtacgcgcagcgcgtcggcacgggcgcccccgtctacctggccgggggggggggggagctggccgcccaggtgctggacctcgccggcaacgctgccaaggacaacaagaagacccggatcatcccgcgccacgggctccttgccatccgcaaggacgaggagctcgggaaggtgcggtccggggtccccatcgcccacgggggctcctccccaaaataacccggagcccctgcccagaagaccggggaaaagggggccccaagaaaccacatcgcccagaaagcccgccatcccccaaggagggtca

SEQ ID NO: 59651 - protein, 124 aa, Zea mays
  misc_feature: Ceres CLONE 1516599
  misc_feature (31)..(104): Pfam Name: Histone Pfam Description: Core histone H2A/H2B/H3/H4
MDASAAGAGGKAKKGAAGRKAGGPRKKSVTRSVKAGLQFPVGRIGRYLKKGRYAQRVGTGAPVYLAGGGGELAAQVLDLAGNAAKDNKKTRIIPRHGLLAIRKDEELGKVRSGVPIAHGGSSPK

SEQ ID NO: 59652 - DNA, 660 bp, Zea mays
  misc_feature: Ceres CLONE 1516604
  misc_feature: Encodes the peptide sequence at SEQ ID NO. 59653
atagctggagctccccgcggtggcggccgctctagaactagtggatcccccgggctgcaggaattcgtctcacccctagaaaaaaaaaaaaaaaaaaaaatggtatattttgtccaagacgctggcagaggaggctgcttggaagttctcaagggataatggacttgaaatcgttactataaacccagcgatggttattggtcccctgctgcagcctacactaaataccagtgctgaagcaatcctgaagttaatcaatgggtcatcgtctacatatcccaatttttgctttggatgggttaatgtcaaggatgttgccctggcccatatccttgcatacgaggttccctcatcaaatggaaggtactgcatgggggaaagagttgttcactactcagaactggtgaacaccacccgcaacatgtatcctacccttcctcttccggacaagtgtgcagatgacaagccgtttgtcccaccctaccaagtatcaaaggagaaaataaaaagcttaggcctccgagttgattccccctggagaacaagcgtccaaggagaccaaatcccagacaaccccgcggggttgaaaaacttgggatatcgaacgcccattacgtgctcctgcccccctccttgttttctgtttttccctttccccgg

SEQ ID NO: 59653 - protein, 156 aa, Zea mays
  misc_feature: Ceres CLONE 1516604
  misc_feature: SWISSPROT Homolog: EC 1.1.1.219 Dihydrokaempferol 4-reductase
MVIGPLLQPTLNTSAEAILKLINGSSSTYPNFCFGWVNVKDVALAHILAYEVPSSNGRYCMGERVVHYSELVNTTRNMYPTLPLPDKCADDKPFVPPYQVSKEKIKSLGLRVDSPWRTSVQGDQIPDNPAGLKNLGYRTPITCSCPPPCFLFFPFP

SEQ ID NO: 59654 - DNA, 640 bp, Zea mays
  misc_feature: Ceres CLONE 1516607
  misc_feature: Encodes the peptide sequence at SEQ ID NO. 59655
  misc_feature (305)..(305): n is a, c, t, g, unknown, or other
aagctggagctccccgcggtggcggccgctctagaactagtggatcccccgggctgcaggaattcgtctcacccctagaaaaagtgcccgcggtgctagtgacggttgctctagatccgttcatcctggtggttttgtgaggtcgaaagcggcgagcgaattagaagatgctggacaagctgtgggacgacgtggtggccgggcctcgcccggagacgggcctcgagaagctccgcaaggccaccaccgcccgcccgctcgtcatcaacaaagacgcggacggcggcagctacaagcgggcgcantcgacgccgtcgaccccgacgacgccggtgacgccgtcgtcgtcgacgacgccgcgcggccccggcaagggggggggcagcgtcttccacccggggaccaaccccgcctcggggggggtgggcgcccacctcttcgaccgggcgcaggccaactcccccaccggctacaacgggctctacagcgacgagaccaggagccaccccccccttgatccgggcgaaatgggatggaccgcgaaaaagcccggtgtggcgggcccttgaaggtaatctaaaaacgggccggcgggcccctactatggcgggggcggcccctggggggaatacctggcggg

SEQ ID NO: 59655 - protein, 133 aa, Zea mays
  misc_feature: Ceres CLONE 1516607
  misc_feature (5)..(115): Pfam Name: Auxin_repressed Pfam Description: Dormancy/auxin associated protein
  misc_feature (46)..(46): Xaa is any aa, unknown, or other
MLDKLWDDVVAGPRPETGLEKLRKATTARPLVINKDADGGSYKRAXSTPSTPTTPVTPSSSTTPRGPGKGGGSVFHPGTNPASGGVGAHLFDRAQANSPTGYNGLYSDETRSHPPLDPGEMGWTAKKPGVAGP

SEQ ID NO: 59656 - DNA, 654 bp, Zea mays
  misc_feature: Ceres CLONE 1516611
  misc_feature: Translation starting site: 192
atagctggagctccccgcggtggcggccgctctagaactagtggatcccccgggctgcaggaattcgtctcacccctagaaaaaatccccgccgcctacgccggccgttcgcgctcacctagtcaccacattcgttctcgccgtggacgcgcgcgtgaggtgagtgagaccaccacgccagacaagaattaatggccctggagacgtgcttcagagcgtgggcgctgcacgccgcccctgctggcagcaaggacaggctcctcgtctgcagcagcggcggtaacctggtgctgccgtcgaagcgggtcgcggccgcgccgctgtccgtcggccgcgtcgccacgcgccgggcgcggcacgtctgccagtccaagaacgccgtggacgaagtgctggtggcggacgaaaagaactgggacgggatggtgatggcgtgcgagacgccggtgctggtggagttctggggcgccgtggtgcgggccgtgccagatgatcgccgcccgtgatcaacgagctgggccaaggactacccccggcaagaatcttgtgctggcaaggggaacacgggacgaaagcccccaacgtgggccgtcccccctacggaattccgcagcattccccacccgtggcttcttcttttcaagggcgggcgag

SEQ ID NO: 59657 - DNA, 784 bp, Zea mays
  misc_feature: Ceres CLONE 1516747
  misc_feature: Encodes the peptide sequence at SEQ ID NO. 59658
  misc_feature (47)..(47): n is a, c, t, g, unknown, or other
  misc_feature (51)..(51): n is a, c, t, g, unknown, or other
aaagctggagctcaccgtcggtggcggccgctctacactagtggatntctngggctgcaggttatccgtctcacccctagaaaaagtgctttctcagaggtgggttggcttctcctcccccaccggttcgtgttcaggttctggttcgtgggcgagagggaagagatggcggcgtcccacgttgagtaccgttgcttccttggcggcctcgcctgggcccccgacgaccactccctcagcaactccttcggcacttacggcgaggtcctttagtcgaacatcctcccgcctcggcggacgtcgagccccccgcggttttggttttcggcgcctgagcccacaggcggaccctgatgcgttttttttttccctcccgcgtgagggggggggggtctctactcccgtttaattatccacccccccccctcctcacctcccactggattgcctgtgcggccgcgtccacggtctctatattgtgtgcggtctcccctccttttccgctttagttcgccgttaggtgtccgccgccgtgaccttttcgtttacgtctgtcgcgtggcatggctcgtctggcgggtggcgttgttttcccgcgtgatgcctgccattcggatgtgtgcgcgggcgcgactgcttgcgtgtccgttgcagtgtcgccggcgcgctcctgttgcatccctccctttttcccctgctcaacactacgggacactctcgcgtaaacggtgcggctggcggtatctccgcgggagcaccagtgtcgcgtgtgcccaggggcgcg

SEQ ID NO: 59658 - protein, 35 aa, Zea mays
  misc_feature: Ceres CLONE 1516747
MAASHVEYRCFLGGLAWAPDDHSLSNSFGTYGEVL

SEQ ID NO: 59659 - DNA, 703 bp, Zea mays
  misc_feature: Ceres CLONE 1516751
  misc_feature: Encodes the peptide sequence at SEQ ID NO. 59660
  misc_feature (412)..(412): n is a, c, t, g, unknown, or other
  misc_feature (508)..(508): n is a, c, t, g, unknown, or other
  misc_feature (585)..(585): n is a, c, t, g, unknown, or other
gcggtggcggccgctctagaactagtggatcccccgggctgcaggaattcgtctcacccctagaaaaagacacacctcccaaaccctacactcccggcggcggcggcggcggcgcagcagcggcagcagcatccgaagatggtgaagttcctcaagcccggcaaggccgttatcctcctccagggccgcttcgccggcaggaaggcagttatcgtgcgcgtgttcgaggagggcacccgcgaccgcccctatggccactgcctcgtcgcaggcctcgccaagtacccaaagaaagtgatccgcaaggactccgccaagaagactgcgaataaatcgcgcgtcaagtgcttcatcaagctcgtcgacttcactcacctcatgcccagccgctacaccctcgacgtcgatttcnaggatgtcgacaccggtgggcccgacgcactctctacccacgacaggatggtcgccgcctgcaagacgccaaagcgcgcctggaggaagagttcangaacggcaaaacagggtgttctttaccagctccgcttctaaatgctcggcctcccgaaagccctgccttagctgacnattttgtgaaatcgaccacctcatctcctgttttctaataccttgaaaattccgggttaaaaaaaaaaaaaaaacgaaacccccgaaggacccaatcccccctaagggggtctaatac

SEQ ID NO: 59660 - protein, 136 aa, Zea mays
  misc_feature: Ceres CLONE 1516751
  misc_feature (52)..(136): Pfam Name: Ribosomal_L27e Pfam Description: Ribosomal L27e protein family
  misc_feature (7)..(40): Pfam Name: KOW Pfam Description: KOW motif
  misc_feature (92)..(92): Xaa is any aa, unknown, or other
  misc_feature (124)..(124): Xaa is any aa, unknown, or other
MVKFLKPGKAVILLQGRFAGRKAVIVRVFEEGTRDRPYGHCLVAGLAKYPKKVIRKDSAKKTANKSRVKCFIKLVDFTHLMPSRYTLDVDFXDVDTGGPDALSTHDRMVAACKTPKRAWRKSSXTAKQGVLYQLRF

SEQ ID NO: 59661 - DNA, 682 bp, Zea mays
  misc_feature: Ceres CLONE 1516753
  misc_feature: Pfam Name: K_trans Pfam Description: K+ potassium transporter
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
aagctggagctccccgcggtggcggccgctctagaactagtggatcccccgggctgcaggaattcgtctcacccctagaaaaccaagtcacccctgacagggaacagcctgacgagatactcaagccagacacccggcgacgagctggagttcctgaaccgaagcaaggatgccggcgtcgtgcacttcctcgggaacaccgtcgtgcaggcgcgcagggactcggggatcttgaagaaggtcgccgtgaattatgtgtatgccttccttcggaagatgtgcagggagaacagtgtgatcttcaacgttccacatgaaagcctcctgaatgtagggcagatatactatatatgaatatttttgttttagattcttctggtcggactcgaagtgaacattgtacatggtgatcagtcctagagtaaagctttaagtcaggtctgcggcttttagtcagttctgcgacttttcttgaacacatagattactggttatgccattggcacattcttccatgaagcttgctgactgctggtatcccaatggccttttctcccaactggccaaccattgctgggggggggtggcgggggggaaacttccaaaaaaaaaaaaaaaaacgggagaccgcnnnnnntttgggggggggggggggggtatacccccccacatattttttccc

SEQ ID NO: 59662 - DNA, 708 bp, Zea mays
  misc_feature: Ceres CLONE 1516754
  misc_feature: Encodes the peptide sequence at SEQ ID NO. 59663
  misc_feature (475)..(475): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (694)..(694): n is a, c, t, g, unknown, or other
ctccccgcggtggcggccgctctagaactagtggatcccccgggctgcaggaattcgtctcacccctagaaaaaaaagcccgcactaccacgcgaccacgcccccgctcctctcgtctctttcttcgcctcttccatcgcaggattcggcggccatgggcggcggcaacggccagaagtccaagatggcgcgcgagaggaacgccgagaagaacaagggcggcaaaggcagccagctggaggccaacaagaaggccatgaacatccagtgcaagatctgcatgcagaccttcatctgcaccacctccgaggccaagtgcaaagaacatgcggaggcgaggcatcccaagaacgacctctaccagtgcttcccccacctcaagaattagtaagcagcagaagcatatgatctgctcagctaaaagacaagtactacatatatatatatacgctgtgtgtcaattaatgggttgtangctgctgttgatgcggctgcttcgttcgtgttgccccgtctgaatatgtactgtaacccttggctgtcaacgtactgtgctaaaaacactgggtctgtgtggatcatgctgcctgcctgtgctgtgcttgctcaatattttcttttcaaannnnnnnnnnnnnnnnnnnnnnnnnnnnnnnnnnnnnnnnnnnnnnnnnnnnnnnnnnnnnnnggaaanaaaaaaaacgagcc

SEQ ID NO: 59663 - protein, 77 aa, Zea mays
  misc_feature: Ceres CLONE 1516754
  misc_feature (4)..(73): Pfam Name: DUF1909 Pfam Description: Domain of unknown function (DUF1909)
MGGGNGQKSKMARERNAEKNKGGKGSQLEANKKAMNIQCKICMQTFICTTSEAKCKEHAEARHPKNDLYQCFPHLKN

SEQ ID NO: 59664 - DNA, 685 bp, Zea mays
  misc_feature: Ceres CLONE 1516757
  misc_feature: Encodes the peptide sequence at SEQ ID NO. 59665
  misc_feature (384)..(384): n is a, c, t, g, unknown, or other
  misc_feature (387)..(387): n is a, c, t, g, unknown, or other
tggagctccccgcggtggcggccgctctagaactagtggatcccccgggctgcaggaattcgtctcacccctagaaaaacgtctccctctgtactccttcctcagcctcatcctatccaagaacgcagaaccgagacccacgaactcgcagcagaccagcagccatggccgcccccgcaacgagctccctgctgagcacgctgctgcagctaccgctcgctccgttctcggggaagagctcgccgccgtccgtggcgcacgtggcgcgccgggcgccgacggcggtggtggcggccaaggggtacaatgtgcagattctagtggacgagaacgagggggaagagtccatcttccgtaggtcccggcgggaggtgatgcgcgccngcntgctgcaagagatcaagcgccgccgggagtacgagagcaagacggacgaaaagaagcgcaaggcgcgcgaaggcggacgccgcaaccgtcgcaggcgtatgatgaacgacccaaggtcccagaagaagacgccgacgcgacctccaaggtcgggacgaggaccacgacactggaggtccacggcctcctgggaaacaaaggaacgcatcccaagtcaatttcccgcgtccataggaggccaagccaaacccctacaatccgagttttttgggccgggttcgtttccctcagcccaggg

SEQ ID NO: 59665 - protein, 173 aa, Zea mays
  misc_feature: Ceres CLONE 1516757
  misc_feature (49)..(102): Pfam Name: Ribosomal_S21 Pfam Description: Ribosomal protein S21
  misc_feature (74)..(74): Xaa is any aa, unknown, or other
  misc_feature (75)..(75): Xaa is any aa, unknown, or other
MAAPATSSLLSTLLQLPLAPFSGKSSPPSVAHVARRAPTAVVAAKGYNVQILVDENEGEESIFRRSRREVMRAXXLQEIKRRREYESKTDEKKRKAREGGRRNRRRRMMNDPRSQKKTPTRPPRSGRGPRHWRSTASWETKERIPSQFPASIGGQAKPLQSEFFGPGSFPSAQ

SEQ ID NO: 59666 - DNA, 715 bp, Zea mays
  misc_feature: Ceres CLONE 1516759
  misc_feature: Encodes the peptide sequence at SEQ ID NO. 59667
  misc_feature (78)..(78): n is a, c, t, g, unknown, or other
  misc_feature (82)..(82): n is a, c, t, g, unknown, or other
aagctggagctccccgcggtggcggccgctctagactagtggatcccccgggctgcaggaattcgtctcacccctagngagnccgcccgtcattttcgacacccatgacgctcgacgcctttgctcatctcctcccccaccgggcgatcgtccctccctccggtctgcgctgctacagtctcacccctgcgatggcgctgattggcgtcgcccttaggtggaaggaacgatggaacagaccttcatcatgatcaagctcgactgcgtccagcggggcctgatcggtgacatcatcagtcgcttccagaagaaagggtgctacctcaaggagatgaagttcatgaacgtggagaggtctttcctgcagtaacactacgctcaccttctccaacagcctttcttcccccaatggggggagaaatactttcccgtccttgtggacgaatgagtagaagggtaaaccttcctgtcgactgcccgcagaaacttaaggcgccccgatcccggaaagcagacccccgaaacatccttgagggataacaccttggaaacaggcaggccatgacatccatggaaatcaatacacttggaacaatgtgaagaaggaaaattcgtttttcccgtatcctccacaagtgtcgcaccactgaagaaaaaaccaaccttgtgaccccttggagatgtaaaacggtcgttggagccgttgagaggtttt

SEQ ID NO: 59667 - protein, 46 aa, Zea mays
  misc_feature: Ceres CLONE 1516759
  misc_feature: SWISSPROT Homolog: EC 2.7.4.6 Nucleoside-diphosphate kinase
MEQTFIMIKLDCVQRGLIGDIISRFQKKGCYLKEMKFMNVERSFLQ

SEQ ID NO: 59668 - DNA, 687 bp, Zea mays
  misc_feature: Ceres CLONE 1516761
  misc_feature: Encodes the peptide sequence at SEQ ID NO. 59669
  misc_feature (515)..(515): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
caaagctggagctccccgcggtggcggccgctctagaactagtggatcccccgggctgcaggaattcgtctcacccctagaaaaatcttgctctgaacgcattcctcccatctcccaagacctcctcagacccgagaagcgcagctgcggccatggacgccaccggcactggagctggagggaaggcgaagaagggagcggccggtcgcaaggccggcgggccgaggaagaagtcggtgacgaggtccgtgaaggccgggctccagttccccgtcggccgcattcgggcggctcctctcagaaaggccgctaccccccagcgcgttcggcaagcggggcccccctctaacctcggggcgccccccaaaacccccccccccttaagggcccggaaaatccccccggaaaacttttccagggaaaaaaagaaaaaaagcgatttttcccccccccccccccggggggtgtggggaaaccccccaaaacaaaaagaactccccggaaaagtttgttanaaaagcgggggaacttcccccccnnnnnnnnnnggggggggtgagcaaaaaaaccggcccggccccaaaaagggaaaaaagggtcccccccggggaaaaaaggaacaatccccccaaaaagggcccaatccccaaaaaaagtaaaggtttttgaggggcgacctaatttttt

SEQ ID NO: 59669 - protein, 168 aa, Zea mays
  misc_feature: Ceres CLONE 1516761
  misc_feature (121)..(121): Xaa is any aa, unknown, or other
  misc_feature (130)..(130): Xaa is any aa, unknown, or other
  misc_feature (131)..(131): Xaa is any aa, unknown, or other
  misc_feature (132)..(132): Xaa is any aa, unknown, or other
MDATGTGAGGKAKKGAAGRKAGGPRKKSVTRSVKAGLQFPVGRIRAAPLRKAATPQRVRQAGPPSNLGAPPKTPPPLRARKIPPENFSREKKKKSDFSPPPPRGVWGNPPKQKELPGKVCXKSGGTSPPXXXGGGEQKNRPGPKKGKKGPPRGKKEQSPQKGPNPQKK

SEQ ID NO: 59670 - DNA, 765 bp, Zea mays
  misc_feature: Ceres CLONE 1516765
  misc_feature (520)..(520): n is a, c, t, g, unknown, or other
  misc_feature (765)..(765): n is a, c, t, g, unknown, or other
tccccgcggtggcggccgctctagaactagtggatcccccgggctgcaggaattcgtctcacccctagaaaaaagcctccgcccatacacacacagccccatcctgccgccgcaggcgagaaccagcgccaccttaggttagggcggccgccgccggagaagtgcgcggttgccaagatgcagatcttcgtgaaagaccctgacggggaagacatcaccctcgaggtggattcctcgcacactcccgaccattgcatgcctctatcccgtacccggctcgcatcccctccgcccagccccattttcctcttttgcggttagtctcagtaggatggcctgctcttttttttcctccaatgggcgggcggggggggcggcgtcttccttctctttttttttcctcccccccccccccccccccaaaaccgctcttttacgtcgcggcgccctctccgtgacctcggcctccactcccgcactcccgttccttcccgccgttttgacgcccttcccgtttccnccgccgttcccggccccttttcatcccttcgcctacgccttggggctgcacctgcccgctgtgatcccccctttttcgtggacaatggttctggtctccgccccctttgttccggttccctcccttactatttcccgtatgcctctgccttccaccaggtttggctcctcccattgccggctctcgcttgtgaagcggattctcccgcgtttcctccccaccctttcccctcctgccacgccccn

SEQ ID NO: 59671 - DNA, 729 bp, Zea mays
  misc_feature: Ceres CLONE 1516766
  misc_feature (542)..(542): n is a, c, t, g, unknown, or other
  misc_feature (616)..(616): n is a, c, t, g, unknown, or other
  misc_feature (617)..(617): n is a, c, t, g, unknown, or other
  misc_feature (676)..(676): n is a, c, t, g, unknown, or other
ctccccgcggtggcggccgctctagaactagtggatcccccgggctgcaggaattcgtctcacccctagaaaaagtgtgttttatgttgagttgcaaattcaggtcctgatttttgtcctgccatgaaccgttaggcgatattgtattggaaaggatgcttccgttattgtttcacgatataccgcctcagagtagaagtttccagtaaaaatgaactctgatttgttcgtcgataaagtgcatttgtacagacacgcattacgaaactaggcattttcaatagcatattaatccagaaaaaggatacaagttggtgacgacaaaaagataaacgtgtgaacttagtaagaatttatgatgaacgtgagcatagtactgagaaatgtgacatgaaaccaaacaaaagaagaaaaatatatccaatagcagacattgtgcgagtcgatgtaaccgtggttgatgcagtgtaattttgttgttgtgttgatcaccaaaaaagaaccaggaagaagagaaggaagtgagcactgacattccctanaaacgtgattatcattcttcacttgtgcagatgaatacttgaatggcccttgttttggtggcctgctctcctannacttgtgcacaagtgctgaaatagagtgcttggctaatagttggagattagaggacgancaaggtgagagagcgcgagatataaacacgaatggacaagaactgtttcacta

SEQ ID NO: 59672 - DNA, 683 bp, Zea mays
  misc_feature: Ceres CLONE 1516770
  misc_feature: Encodes the peptide sequence at SEQ ID NO. 59673
gaagctggagctccccgcggtggcggccgctctagaactagtggatcccccgggctgcaggaattcgtctcacccctagaaaaaatcagatcacactcgtagagagaaggaaaaatatccccaaaccctagctcccgatctcgatggcgaaccctcgcgtcttcttcgacatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcaagtccatctacggccacaacttccccgacgagaagttcgtgcgcaagcacaccgctcccggtgtgctctccatggccaacgccgggcccaacaccaacggctcccagttcttcatctgcaccgtcgcgaccccttggctcgacggcaagcacgtcgtcttcggccaggtcgtcgagggcatggacgtcgtccaggccatccagaaggtgggcacccgcaacggctccacctccaaggggggcaagggccctgattgcggacagctctcctaaatctctctgatctgggccggt

SEQ ID NO: 59673 - protein, 172 aa, Zea mays
  misc_feature: Ceres CLONE 1516770
  misc_feature (5)..(171): Pfam Name: Pro_isomerase Pfam Description: Cyclophilin type peptidyl-prolyl cis-trans isomerase/CLD
  misc_feature: SWISSPROT Homolog: EC 5.2.1.8 Peptidylprolyl isomerase
MANPRVFFDMTVGGAPAGRIVMELYANEVPKTAENFRALCTGEKGVGKSGKPLHYKGSTFHRVIPEFMCQGGDFTRGNGTGGKSIYGHNFPDEKFVRKHTAPGVLSMANAGPNTNGSQFFICTVATPWLDGKHVVFGQVVEGMDVVQAIQKVGTRNGSTSKGGKGPDCGQLS

SEQ ID NO: 59674 - DNA, 689 bp, Zea mays
  misc_feature: Ceres CLONE 1516771
  misc_feature (382)..(382): n is a, c, t, g, unknown, or other
  misc_feature (383)..(383): n is a, c, t, g, unknown, or other
  misc_feature (406)..(406): n is a, c, t, g, unknown, or other
  misc_feature (407)..(407): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (451)..(451): n is a, c, t, g, unknown, or other
  misc_feature (452)..(452): n is a, c, t, g, unknown, or other
  misc_feature (466)..(466): n is a, c, t, g, unknown, or other
  misc_feature (512)..(512): n is a, c, t, g, unknown, or other
  misc_feature (514)..(514): n is a, c, t, g, unknown, or other
  misc_feature (591)..(591): n is a, c, t, g, unknown, or other
ctccccgcggtggcggccgctctagaactagtggatcccccgggctgcaggaattcgtctcacccctagaaaaatgcttccccgttgcagcgattgctcccggtggctcggcgccaatagaggcgccgccacctgactcggccgacccccatctcgctcgacgagatcgtcgctggtatccgcggttggaagcatcactagcgcctgatttattcctaacgcccttctcgtgaacccccaggtatatcttagagaatgttcatgccaagagtggcaacatatcgagaagccatgccaccatgcctttatgccaagagtggcaacagacctattggatcattcatggtgatgcacctggctgctattcccaactgaggtggcnnaacaccagtgttttccttcagcnntgaagttggtttnnngttgatgtccacccccgaggaaaatttanngagagctggtccantaagcttactcccccagaagagaatgcatggcatgtaaacagcttncnatggtgaaatgtccacctggtattttgttttcagattatctatgggcatgagacagctttcacgcatgttacctgantggtatctgtctttccttttttcagtttatgtgttgtttcaaaaacaaatggtgcattgtgattatggggaactggaaatgattctggggaaccccga

SEQ ID NO: 59675 - DNA, 713 bp, Zea mays
  misc_feature: Ceres CLONE 1516773
  misc_feature: Encodes the peptide sequence at SEQ ID NO. 59676
acccgcggtggcggccgctctagaactagtggatcccccgggctgcaggaattcgtctcacccctagaaaaaaaccaccggcggcggctcgagggaagcgaagaggaatcaacgcgatgtctgcgaccacggtggcggtgcccttctggcgggcgggcgggatgacctacatcggctactccaacatctgcgctgcgctggtacggaactgcctcaaggagcccttcaagtccgaggccgcgtcccgcgagaaggtccatttctccgtctccaagtggacggatggcaaacacgacaagcccactgtccgcacagaatccgatgaataaagctctggtgccatagtgacatactccttgctacagatgatttgaagtgttcgtgcaattttccggaacatgctatttagctggcgtgattttatagtccatgctgactaataaatactttttaacgacaattgtcatttttcggttgctatttgccacttcccactccctggaatcaggcaggtggacctgcaggcaatgcttccattttcgtaaaaaccaaaatttggtgttggtgcccaacccaattccatggttgggcctttgaaaatcccggagattatcgattgggaaaaaagaaaaaaaaaaccaagactctcagagggaccccacttcgccccaaaggggggcccgaaataaacccgcccccccttggccttcttt

SEQ ID NO: 59676 - protein, 70 aa, Zea mays
  misc_feature: Ceres CLONE 1516773
  misc_feature (9)..(57): Pfam Name: ATP-synt_Eps Pfam Description: Mitochondrial ATP synthase epsilon chain
MSATTVAVPFWRAGGMTYIGYSNICAALVRNCLKEPFKSEAASREKVHFSVSKWTDGKHDKPTVRTESDE

SEQ ID NO: 59677 - DNA, 653 bp, Zea mays
  misc_feature: Ceres CLONE 1516774
  misc_feature: Encodes the peptide sequence at SEQ ID NO. 59678
  misc_feature (142)..(142): n is a, c, t, g, unknown, or other
ctccccgcggtggcggccgctctagaactagtggatcccccgggctgcaggaattcgtctcacccctagaaaaactcccagaggctcttctcctcctcgcctcctctccctagcctccacgacgcaagggagagtgacgganagcgacgcggcgcgagcgaggagggccaaggggaagaggggaagcaccgcaccaggacccttgttcgccgccgtcgcctctgatctccgcgagggtgtcaggatttcatatgtcgaccagcacattcgctacttcctgcacgctgttggggcaatgtttagaacacgcaaggcttcccgacagcggtggaagaggcctttcggtctttaagctttcttcaggccaagttacgaaggttccaaagcctggaagaccttccaagaaaccttgggatgtcccctgcccgggggtggcttccaaggggaaaacttttccgcccctaaaggggaaaaaccccattttttatttttcaaaaagaagccttaattttttttgtaaccacccaaaaatggccggggtggggagattgcccaaacccctgccccggggtgggggtttttcccccccctgggggggggaaaaacaaaactctgggtttgtgtgtcacacccccccagggaggggccccccc

SEQ ID NO: 59678 - protein, 134 aa, Zea mays
  misc_feature: Ceres CLONE 1516774
MSTSTFATSCTLLGQCLEHARLPDSGGRGLSVFKLSSGQVTKVPKPGRPSKKPWDVPCPGVASKGKTFPPLKGKNPIFYFSKRSLNFFCNHPKMAGVGRLPKPLPRGGGFSPPWGGEKQNSGFVCHTPPGRGPP

SEQ ID NO: 59679 - DNA, 706 bp, Zea mays
  misc_feature: Ceres CLONE 1516775
  misc_feature: Translation starting site: 316
aagctggagctccccgcggtggcggccgctctagaactagtggatcccccgggctgcaggaattcgtctcacccctagaaaaagtgactaacgttgggccatggggcgtaagctgagggtctccaatggagctgacagagacggatacgcccatgcgtctggagagcatcaccgtccgcagcggcgtggccgtcaactccatctcattctcctacgtccactctgccggccacaagcgctctgcaggtccctggggtggttcctgtggacagcctgatcaggtccacctcgccgagatctgacgtggacacggaaatgtccagaacatacggcaccatctacgacaactaccgcaccgagataaccaccattaacttcgtgacgaaccttgacaagacctaccggcctttccgagcgtacggcgacggcgacgacacctccttcaccgtccccgtacaccccggcagtggctccatcgtgggcttcttcgcgcgcgtttacggggccggcgactacctggacgccattggcgtctacgtgcgccccctctaaaaatctttgttttgtgatgtgaatgaagcagctgcatgcatgctgctctactccacacagagccgagtctatcagccacagctacttgaatgcgtgcattcatgcggcttccacttgctttatatctaacctgagtgctgcgttgtggtgtgcc

SEQ ID NO: 59680 - DNA, 726 bp, Zea mays
  misc_feature: Ceres CLONE 1516777
  misc_feature: Encodes the peptide sequence at SEQ ID NO. 59681
  misc_feature (307)..(307): n is a, c, t, g, unknown, or other
  misc_feature (391)..(391): n is a, c, t, g, unknown, or other
  misc_feature (395)..(395): n is a, c, t, g, unknown, or other
  misc_feature (396)..(396): n is a, c, t, g, unknown, or other
  misc_feature (402)..(402): n is a, c, t, g, unknown, or other
  misc_feature (407)..(407): n is a, c, t, g, unknown, or other
  misc_feature (408)..(408): n is a, c, t, g, unknown, or other
  misc_feature (412)..(412): n is a, c, t, g, unknown, or other
actagtggagctccccgcggtggcggccgctctagaactagtggatcccccgggctgcaggaattcgtctcacccctagagagacaacaacaacaacccgcacaacggcacgattctcctcctccgtccgcgtagctctcggtttcggcgatgtcggggcgcggcaagggcggcaaggggctgggcaagggcggcgccaagcgccaccgcaaggtgctgcgcgacaacatccagggcatcacgaagccggcgatccgtaggctggccaggaggggcggcgtcaagcgcatttctgggctcatctacnaggagacccgcggcttgctcaagatcttcctcgagaacgtcatccgcgactctttcacctaccccgagggagggggggggggangacnntcaccnccatnnaatnccccccacccgctcaaggcgccagggccgcacgctctacgggtttcggcgggctaagccccctccccttctgatgctttgaagtgaccgccgtgggccggttgggggtctagttggccgggcccactggaagtttgttccggaatcctccttttccagggggttcccggttcccaagccccttttgggggaaaaatttccccccggccattaccaaggggaaagccctcccgtgtctttccccccaaaaaaaaaaaaaaaaaaacgaaagacttcgggggggacccccgatcccccccaaaagggagggccctt

SEQ ID NO: 59681 - protein, 105 aa, Zea mays
  misc_feature: Ceres CLONE 1516777
  misc_feature (53)..(53): Xaa is any aa, unknown, or other
  misc_feature (81)..(81): Xaa is any aa, unknown, or other
  misc_feature (82)..(82): Xaa is any aa, unknown, or other
  misc_feature (86)..(86): Xaa is any aa, unknown, or other
  misc_feature (88)..(88): Xaa is any aa, unknown, or other
MSGRGKGGKGLGKGGAKRHRKVLRDNIQGITKPAIRRLARRGGVKRISGLIYXETRGLLKIFLENVIRDSFTYPEGGGGGXXSPPXNXPHPLKAPGPHALRVSAG

SEQ ID NO: 59682 - DNA, 759 bp, Zea mays
  misc_feature: Ceres CLONE 1516779
  misc_feature: Encodes the peptide sequence at SEQ ID NO. 59683
  misc_feature (51)..(51): n is a, c, t, g, unknown, or other
  misc_feature (79)..(79): n is a, c, t, g, unknown, or other
  misc_feature (107)..(107): n is a, c, t, g, unknown, or other
  misc_feature (114)..(114): n is a, c, t, g, unknown, or other
  misc_feature (115)..(115): n is a, c, t, g, unknown, or other
  misc_feature (133)..(133): n is a, c, t, g, unknown, or other
  misc_feature (165)..(165): n is a, c, t, g, unknown, or other
  misc_feature (187)..(187): n is a, c, t, g, unknown, or other
  misc_feature (199)..(199): n is a, c, t, g, unknown, or other
  misc_feature (209)..(209): n is a, c, t, g, unknown, or other
ttgctggagctccccgcggtggcggccgctctagaactagtggatcccccngggctgcaggaattcgtctcacccctangaaaaaaaaaaaaaaaaacctccgagcngccgccnngccgccagcgccgacacngcgataaacaagagggaagaagaggccaaccngatccagcagcgatggcaggcngggggcatgctnggggggcgcntttctgggcgacgcgggcgctggaggtggtcaagcggaacgattccccgggcctattgtggaagcgcatcaagctcaccaccacccgcaagaacaacgccaagaagcgccctcagcggctctggcaaaaatgaggcggtataagagcttgtggtgcatcagcgtctgacgcggctcccacagctgacaaacaacagtagcttgaaccacaactggagccaggcctggggacctactatgctggataactggaaccttggcttttgtggccacccccccgggttttggatttggctgcccccggattgaaacctttctccctcccaaaggaaacatcctttgcttggtaccgggggaaacctttgcgccccttctttttttctcccggtttaaaaaaatcccaaacccccttgggcccccccggaaatccccccgattttcgtgggttcccccgtaccttcggggggggagggagaaaaaattttgggcgccgggtgtttttccccttttttccagaagggccaaagggaacctgccacgggtctttttgt

SEQ ID NO: 59683 - protein, 54 aa, Zea mays
  misc_feature: Ceres CLONE 1516779
  misc_feature (4)..(4): Xaa is any aa, unknown, or other
  misc_feature (8)..(8): Xaa is any aa, unknown, or other
  misc_feature (11)..(11): Xaa is any aa, unknown, or other
MAGXGHAXGAXFWATRALEVVKRNDSPGLLWKRIKLTTTRKNNAKKRPQRLWQK

SEQ ID NO: 59684 - DNA, 698 bp, Zea mays
  misc_feature: Ceres CLONE 1516782
  misc_feature (55)..(55): n is a, c, t, g, unknown, or other
  misc_feature (81)..(81): n is a, c, t, g, unknown, or other
  misc_feature (86)..(86): n is a, c, t, g, unknown, or other
  misc_feature (451)..(451): n is a, c, t, g, unknown, or other
cagagctggagctcaccgcggtggcggccgctctagaactagtggatttcttggnctgcaggaattcgtctcacccctagngaagngagcagcaaccagcaagcgcgcgcgcacaccaaacgcaactgcaactgcaactgcaagagcacgccacagcagaaaccaacagttccacacgaaacaaaaaaaaaaggggggacccctcccccctctggtgaaatttcccttccgccggggggccgtccgggaccccccccccctgggaaaaaatttcggcgcttcccccactttaggccctccgggcggggagaaaaatcctccaccccggcggccccccccacccccacggtaagccccgataattcccacggccgggaatgaccaccccacccccgcccgatgggggggggggggtaacttcataccatccatctaatcgtaacattaatanaacccccccccccgccccaaaaataaatgatatgatttatcccgccggattatcaacatttgatggggtggcgatgcggcggtacaagcacgccccccgcaacccccaacccatccccccgcttaccaacgcccccagatcgcctgataccccggaacccccaaaccccccctaagcctacggcgctctccagaaacgcccgcaccccccgacacggccacaccggtcgtaaacccccaccgcgacc

SEQ ID NO: 59685 - DNA, 550 bp, Zea mays
  misc_feature: Ceres CLONE 1516783
  misc_feature: Encodes the peptide sequence at SEQ ID NO. 59686
  misc_feature (330)..(330): n is a, c, t, g, unknown, or other
  misc_feature (365)..(365): n is a, c, t, g, unknown, or other
  misc_feature (463)..(463): n is a, c, t, g, unknown, or other
acccgcggtggcggccgctctagaactagtggatcccccgggctgcaggaattcgtctcacccctagaaaaaatttgttgcggaagtaaatataaactgcgagctatcatatcaagttactgtgaagagtgaagagatatcacaggggacctcttcaggcttcaaggcagatccgcagcagatggaggcgaagagcaggctgccggaggtgaccatcgtcccggcggcacggccgttggctggcgacggcacagtcgacgcggcaaaggcggcggcaggcaaggagcccgtaagcccgggcactccgtcctcggtggccgccggccgcancatctgtgatgagaggcgcgcggtggacggcgtcnccctgcctgggtggagctcgacgccctctgcagagtcctgccgtcgcggccatgaggcgcgcttccctactactctgaagctccccgtgcagcctgcntgatcgagttctgagcggcgactctggtgcatggtctggacaactgatggcgtccttggggggtttccttggcccagggtttccctt

SEQ ID NO: 59686 - protein, 94 aa, Zea mays
  misc_feature: Ceres CLONE 1516783
  misc_feature (50)..(50): Xaa is any aa, unknown, or other
  misc_feature (62)..(62): Xaa is any aa, unknown, or other
MEAKSRLPEVTIVPAARPLAGDGTVDAAKAAAGKEPVSPGTPSSVAAGRXICDERRAVDGVXLPGWSSTPSAESCRRGHEARFPTTLKLPVQPA

SEQ ID NO: 59687 - DNA, 648 bp, Zea mays
  misc_feature: Ceres CLONE 1516784
  misc_feature: Encodes the peptide sequence at SEQ ID NO. 59688
  misc_feature (72)..(72): n is a, c, t, g, unknown, or other
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
gagctccccgcggtggcggccgctctagaactagtggatcccccgggctgcaggaattcgtctcacccctanggaggagcctgacccttacgccttcgctcgcgccgccgccgccgccgccgctacgccccgcacctcgcttcatttcgtgtcgccaagatgacgaagcgcactaagaaggcaggaattgttggcaaatatggaaccaggtatggtgctagcttgcgtaagcaaatcaagaagatggaggtatctcagcattccaagtacttttgcgagttctgtgggaagtttgctgtgaagaggaaagcagttggaatttgggggtgcaaggactgtgggaaggtgaaaggtggtggcgcttacaccatggaaactgctaatgcggtcaccgtnnnggagcccaatccccccccctgaaggaagacaaactgaaacccggatatagctcctctatattattgggggttttcctgaaggttgcctttgggccggcattgtttggggggccctatctcagggggaaatggggaaattcccgtgccgggggtggtttgcccaagaaaaggtctcctaaaaattgggtttaaaccccccccgcacataaaggggttgttataaacccccccccccggggtgtgtggggtg

SEQ ID NO: 59688 - protein, 86 aa, Zea mays
  misc_feature: Ceres CLONE 1516784
  misc_feature (2)..(81): Pfam Name: Ribosomal_L37ae Pfam Description: Ribosomal L37ae protein family
  misc_feature (80)..(80): Xaa is any aa, unknown, or other
MTKRTKKAGIVGKYGTRYGASLRKQIKKMEVSQHSKYFCEFCGKFAVKRKAVGIWGCKDCGKVKGGGAYTMETANAVTVXEPNPPP

SEQ ID NO: 59689 - DNA, 679 bp, Zea mays
  misc_feature: Ceres CLONE 1516785
  misc_feature: Encodes the peptide sequence at SEQ ID NO. 59690
  misc_feature (595)..(595): n is a, c, t, g, unknown, or other
aaagctggagctccccgcggtggcggccgctctagaactagtggatcccccgggctgcaggaattcgtctcacccctagaaaaaactccagattgcgcgcacccacccacccttcgcccccgctgccacgcctaccccgtcacgggggcacctgcgcttccgcgccgcgcgccctctgccccgccccgcccggagaatttgttgccaatctatcaactcagctaatgtgttgggagcttcttcaacgacatctgatgaggcagtcccagtcccagttgtccagatagatcaggactcagaccgtgatgcgaccattgtgcagctaagttttggagatcgtttgggggcgctacttgacacgatgaaagcactcaaggaccttggccttgatgtcacaaaaggaagtgtgacaactgactcagctgtcacacaaacaaagttccacatcatgcgatttgggcgcaaggttgaggaccctgacatgttagaaaggattcggctaaccatcatcaacaaccttctccagtaccatcctgaatcaagtgagaagttagccatgggtgaattttttgggataaaacctcctgagaagaangtagatgttgatattgcaacacatatagttgttgaagatgacggaccaaaaaaaaaaaaaaaacgagacgctcgaggtacccaa

SEQ ID NO: 59690 - protein, 106 aa, Zea mays
  misc_feature: Ceres CLONE 1516785
  misc_feature (78)..(78): Xaa is any aa, unknown, or other
MKALKDLGLDVTKGSVTTDSAVTQTKFHIMRFGRKVEDPDMLERIRLTIINNLLQYHPESSEKLAMGEFFGIKPPEKXVDVDIATHIVVEDDGPKKKKKRDARGTQ

SEQ ID NO: 59691 - DNA, 729 bp, Zea mays
  misc_feature: Ceres CLONE 1516787
  misc_feature: Translation starting site: 75
ctccccgcggtggcggccgctctagaactagtggatcccccgggctgcaggaattcgtctcacccctagaaaaaatgatgctgggaaagagatctgggcgcccgtcgccggcgtcgcggcagcacatgcggcggaccacgagcatgacggagttcgcggcaccgcacgtgctggtagacgtcgcggaggaggaggaggacgaggagctgcggcttctgccggcgcacgccgaggccgcaggggaggcggccgagcaggaggacccctacgggtgggccatcgagcggcgccgcggcggccgggcgcgcggactggctggcggcgtaccgcgcccgcgcggctccggcactggcggtgctacaccggaactcggccgacttctcggctgccgagacagccgcgttcctccgcgcctgcgggctctgcaaccgccgcctcggacccggccgcgacaccttcatgtacaggggcgacacggcgttctgcagcctcgagtgccggcagcatcacatcacgatcgatgagtgcaccgagaagtgcgcgctcaccacgacgccgacgggagcggagtccgacctggtggtgccgctgccgaccagcggcgcgagctccgagaaacaggtacgctcgacgcgcatctgaattaaatcgtgaagggagggcggtctaatgccatcgatgatctggtaaactatgggcgttggcctctcatcgccttgttacatgtct

SEQ ID NO: 59692 - DNA, 670 bp, Zea mays
  misc_feature: Ceres CLONE 1516788
  misc_feature: Encodes the peptide sequence at SEQ ID NO. 59693
cagctggagctccccgcggtggcggccgctctagaactagtggatcccccgggctgcaggaattcgtctcacccctagaaaaactagcttgccgcgccgcctggatcgagcagccgagcgactaagcgaagactcccttttccccgagcacaagagaaccatggcggcggcggcagtatacggcggcttcaaggggaagcttggcgtcgaggatgcccccgagctgcagctcaaccgcatccgcatcacactctcatccaagaacgtcaagaacttggagaaagtttgtgcggatttggtaaagggagccaaggacaagcatttgagggttaagggacctgtcaggatccctactaaggttctccacatcgccggtcgcgagtccccttgcggtgaaggaacaaacacatgggatcggtttgagttccgcattcacaagagggtgattgacctaatcagctcccctgatgtggtgaagcagatcacctccatcacaattgagcccggtgttgaggttgaggtgaccattgccgacgtgtaaggacgtgaagttcagcaatgtcatcgacaatctttttctttgtgctccctgtgtgctcgcaagagagattttgaggttatattagcatacaagacttccttcccccctaaaaaaaaaaaaaaaaacgag

SEQ ID NO: 59693 - protein, 126 aa, Zea mays
  misc_feature: Ceres CLONE 1516788
  misc_feature (26)..(121): Pfam Name: Ribosomal_S10 Pfam Description: Ribosomal protein S10p/S20e
MAAAAVYGGFKGKLGVEDAPELQLNRIRITLSSKNVKNLEKVCADLVKGAKDKHLRVKGPVRIPTKVLHIAGRESPCGEGTNTWDRFEFRIHKRVIDLISSPDVVKQITSITIEPGVEVEVTIADV

SEQ ID NO: 59694 - DNA, 711 bp, Zea mays
  misc_feature: Ceres CLONE 1516789
  misc_feature: Encodes the peptide sequence at SEQ ID NO. 59695
  misc_feature (349)..(349): n is a, c, t, g, unknown, or other
  misc_feature (368)..(368): n is a, c, t, g, unknown, or other
  misc_feature (402)..(402): n is a, c, t, g, unknown, or other
  misc_feature (495)..(495): n is a, c, t, g, unknown, or other
tggagctccccgcggtggcggccgctctagaactagtggatcccccgggctgcaggaattcgtctcacccctagaaaaaagcgagcgagagagacgcacatctatctgtcaagcgacgccgcggcctcgatcagagtcggaggcgaacacccccatggcggcggctggcggcggcgcaggagggaaggtatccttcaagatcatcctcacctccgaccccaagctccctttcaaagtgttcagcgtgcccgaggcggcgccctttaccgcggtgctcaagtacgccgcggaggagttcaaggtcccgccccagaccagcgccatcatcaccaacgatggaattggcatncaccccccagcaagtgcanggcacgtgtttctgaaacatgggttcgagctgcntctcatcctcgcgatagggtggagctgtatcctgtcttccgggtaaaggaatattcagtccatggcttatgagcaaacttggaaaaaataaanctttaatgtgggcctttcttggtgtagaagtttgttcaagggaaaaaacgaaactttccggaagggcccaaggggaggcccccggttggagggggaattttcaaagggacccgtttccaaccccggagaaaaaaaaaaaaaaagcccggggggccattcccccaaaagggaaaatccccccccccgggcctttttaacggctggggggaaaacccg

SEQ ID NO: 59695 - protein, 97 aa, Zea mays
  misc_feature: Ceres CLONE 1516789
  misc_feature (10)..(85): Pfam Name: UPF0185 Pfam Description: Uncharacterised protein family (UPF0185)
  misc_feature (65)..(65): Xaa is any aa, unknown, or other
  misc_feature (72)..(72): Xaa is any aa, unknown, or other
  misc_feature (83)..(83): Xaa is any aa, unknown, or other
MAAAGGGAGGKVSFKIILTSDPKLPFKVFSVPEAAPFTAVLKYAAEEFKVPPQTSAIITNDGIGXHPPASAXHVFLKHGFELXLILAIGWSCILSSG

SEQ ID NO: 59696 - DNA, 688 bp, Zea mays
  misc_feature: Ceres CLONE 1516794
  misc_feature: Encodes the peptide sequence at SEQ ID NO. 59697
  misc_feature (493)..(493): n is a, c, t, g, unknown, or other
  misc_feature (496)..(496): n is a, c, t, g, unknown, or other
  misc_feature (526)..(526): n is a, c, t, g, unknown, or other
  misc_feature (529)..(529): n is a, c, t, g, unknown, or other
  misc_feature (532)..(532): n is a, c, t, g, unknown, or other
  misc_feature (541)..(541): n is a, c, t, g, unknown, or other
  misc_feature (553)..(553): n is a, c, t, g, unknown, or other
  misc_feature (565)..(565): n is a, c, t, g, unknown, or other
  misc_feature (566)..(566): n is a, c, t, g, unknown, or other
  misc_feature (571)..(571): n is a, c, t, g, unknown, or other
agagctggagctccccgcggtggcggccgctctagaactagtggatcccccgggctgcaggaattcgtctcacccctagaaaaagtgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcngcngctacggcggtggcgggcgcccctgatgcngcngcngctacggcngtggcggcggcngctacggtggcnngcgcngctacggtgggtgtggcggcggctaccggcgtggcaacgtgggcggcgctacggcaacttcgacgggaactggagaactgagcggtggggcccccccggcaagttatcctgttccta

SEQ ID NO: 59697 - protein, 112 aa, Zea mays
  misc_feature: Ceres CLONE 1516794
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (104)..(104): Xaa is any aa, unknown, or other
  misc_feature (105)..(105): Xaa is any aa, unknown, or other
MAASDVEYRCFVGGLAWATDDHSLHNAFSTYGEVLESKIILDRETQRSRGFGFVTFSTEEAMRNAIEGMNGKELDGRNITVNEAQSRGGRGGGGGGYGGGRGGXXYGGGGRP

SEQ ID NO: 59698 - DNA, 733 bp, Zea mays
  misc_feature: Ceres CLONE 1516795
  misc_feature: Encodes the peptide sequence at SEQ ID NO. 59699
  misc_feature (76)..(76): n is a, c, t, g, unknown, or other
  misc_feature (406)..(406): n is a, c, t, g, unknown, or other
  misc_feature (472)..(472): n is a, c, t, g, unknown, or other
  misc_feature (574)..(574): n is a, c, t, g, unknown, or other
  misc_feature (576)..(576): n is a, c, t, g, unknown, or other
  misc_feature (591)..(591): n is a, c, t, g, unknown, or other
ctggagctccccgcggtggcggccgctctagaactagtggatcccccgggctggcaggaattcgtctcacccctangaaaaaagtctcgctccaaaccaaagccatcggaggagcaactggacgaccatggcctcgccgctgctcaagtcacactctcagctcgccgccgccgccgccctgcactccgtgaggagagccgaccgctgccctgcgacactacacctgggcaagttccatgaccacgggctcaggtccggccgttctaagagatccggttcagcgagggtgggcgccttcccgtcgctggacgtggtgccgctgatggtgacgatggtggagcacgtggacatgtcgcgggactacgtcgtgaccaagtccatctggcatctcagcgacgtagccctncagagcgtctataccttctacgccatggtcaccgtctggggagtctgcttcttcgcgtccatgaanggatccttctacgacagcgagacgtacagagagcaggggtggcgacgggaccgtgcactggtactacgacagggcagaggaaccctggagcctctgcaaggnangaactgctgccggangaactgctccaggaaattgaccaaaagggtgggggcctccaggaccttggagaaacccaccaggagggaccccctccaaaagtgatcccccccggggcaatacccgagggggatggaaccgggtactctaccgccttttatt

SEQ ID NO: 59699 - protein, 182 aa, Zea mays
  misc_feature: Ceres CLONE 1516795
  misc_feature (115)..(115): Xaa is any aa, unknown, or other
  misc_feature (150)..(150): Xaa is any aa, unknown, or other
  misc_feature (155)..(155): Xaa is any aa, unknown, or other
MASPLLKSHSQLAAAAALHSVRRADRCPATLHLGKFHDHGLRSGRSKRSGSARVGAFPSLDVVPLMVTMVEHVDMSRDYVVTKSIWHLSDVALQSVYTFYAMVTVWGVCFFASMXGSFYDSETYREQGWRRDRALVLRQGRGTLEPLQGXNCCRXNCSRKLTKRVGASRTLEKPTRRDPLQK

SEQ ID NO: 59700 - DNA, 623 bp, Zea mays
  misc_feature: Ceres CLONE 1516799
  misc_feature: Encodes the peptide sequence at SEQ ID NO. 59701
  misc_feature (361)..(361): n is a, c, t, g, unknown, or other
  misc_feature (466)..(466): n is a, c, t, g, unknown, or other
gcggtggcggccgctctagaactagtggatcccccgggctgcaggaattcgtctcacccctagaaaaaaaaccaatcagatagagagagcatagtcgatcatgaagggtggcaagaaggaagtggccggtgcggtggtggccatactgctggttctgcagctcatggcagctccaccgacggccatggccgcccgctcgccgcgcggagccgtgccggatggctccctcgccacgacgcccaaggtgacgatgctgtcggccacgctgtgctacacgggggagacatgcaaatacactccctgcttcactcctgcttgctcctgcagctttagtgatcgcctctgctacgtcatatttacntcctgtttgcttgagttgaggcattcgcgaagcacactcttactgcatgcgcggccgacacgacaacctgctctcgtgagctctggtcagtgatgcatgtttcanggcatccatggatgcttttaccgaaaatgccaatttaataaccccgggcccgggaacccgaaaaaaaagggggggttggtttttatttaccccccttggggggccaaaaaagggggaaaatatatgttggggggggtggggaaaaaaaaaaaaaaaa

SEQ ID NO: 59701 - protein, 117 aa, Zea mays
  misc_feature: Ceres CLONE 1516799
MKGGKKEVAGAVVAILLVLQLMAAPPTAMAARSPRGAVPDGSLATTPKVTMLSATLCYTGETCKYTPCFTPACSCSFSDRLCYVIFTSCLLELRHSRSTLLLHARPTRQPALVSSGQ

SEQ ID NO: 59702 - DNA, 766 bp, Zea mays
  misc_feature: Ceres CLONE 1516800
  misc_feature: Encodes the peptide sequence at SEQ ID NO. 59703
  misc_feature (766)..(766): n is a, c, t, g, unknown, or other
ggagctccccgcggtggcggccgctctagaactagtggatcccccgggctgcaggaattcgtctcacccctagaaaaaactcctgcagtccttctccacctagctcccccgcgccaagaacacgccagctagcaagcgcgctcgatcgaataccgttaccgtgtcgccatggccgccaccgcgtctctatcagccgtcggggcgccgctgtcggtgcccgggctcaggaagccgctcggtgtgtcgtcgctcacagctctgcagccaagggcggcgaggatgacgacgacggccgtgcgggcgtttggcgtagccctcgtccaggtccattcaaggagaaagctggcgcccaggctgaaccccgccggccctggtcggctgaccatggtgctgccggaaccccccccagggcgggggaaaacaagggggggttcacgcgggcccctcaagaaaattccctccccacacaattcggggcccggggggggggcccggatcctttggtattttggcagggccccccaagggggcgttttcaaatttcaaacccccgtcaagaaggggcccgaatcggaaaacccttcttttataaacctttctcccctcggggaccctgtcccggggggcctgggcggggcccgggattaaattgggcggggggcattattccccctgggggggttaaatgagttttggggaaaaaggctcccaccccctattttttgttgtcttaaaaaaaggggatttttatgtccaaaaaaaaaan

SEQ ID NO: 59703 - protein, 159 aa, Zea mays
  misc_feature: Ceres CLONE 1516800
MAATASLSAVGAPLSVPGLRKPLGVSSLTALQPRAARMTTTAVRAFGVALVQVHSRRKLAPRLNPAGPGRLTMVLPEPPPGRGKTRGGSRGPLKKIPSPHNSGPGGGARILWYFGRAPQGGVFKFQTPVKKGPESENPSFINLSPLGDPVPGGLGGARD

SEQ ID NO: 59704 - DNA, 946 bp, Zea mays
  misc_feature: Ceres CLONE 1516805-R
  misc_feature (437)..(437): n is a, c, t, g, unknown, or other
cgtctcggccgctctagaactagtaggatcccccttgctttctttatttttttttttacttcttaaacagatacgataatattcgtaggataagataatggtccacaacacttccgaaccgattacaaagttcaccttaaaaaaaattgcaaaccaaacaataattccaagtcaaacgataacaactaattgtccctcactgctcctcttagatcacacccttgtcgctcacatagataccatccaaaaacttcctgatatccttcttcttgacatggcatttctggttgatgagggcggcggagccagacactaactcgacgtcgttgccatcgagaataaactcgtccttgaccttctcggatcggaggatggtcacgccgtgaagcatgtccacctttctgaccttcttctcggcgaggaagttccttatctcnatggccgcgctggagtcggtgaatgacacgttgatggggaaatgggcgtagacaaaactcatcttgtagcggcagcccttggtgacccccttgattatgttcccgacctggaaaatggggggtccgtattggcggcattggtgccgaacgggttcctaaaccatagattcaaccttgagtctgggggccgccccccctccccctggaaattggaggggttgagggggctttaaattcccgggggagattccccccgggggacaatcaacttgcccaaattgggggggccccccccagggggggcgccccccgtttttttttttttcccaaggggagaaaaaatttttttttgcgggaacaccatgtttttagggggggcccaacaggggaaaaacaacctttttttttcccggtgagaggagtatatggccggcggggaaaaaagaaaaaagtgtgccccgagaaattattgcccctttttttcccccttggggggggggaacttgtgt

SEQ ID NO: 59705 - DNA, 712 bp, Zea mays
  misc_feature: Ceres CLONE 1516810
  misc_feature: Encodes the peptide sequence at SEQ ID NO. 59706
  misc_feature (479)..(479): n is a, c, t, g, unknown, or other
  misc_feature (507)..(507): n is a, c, t, g, unknown, or other
  misc_feature (597)..(597): n is a, c, t, g, unknown, or other
  misc_feature (689)..(689): n is a, c, t, g, unknown, or other
ccccgcggtggcggccgctctagaactagtggatcccccgggctgcaggaattcgtctcacccctagaaaaaagtttttaggaccggccgggatgctggactgggcgcccgtggtggtgggcgtcgtgctcttcgtgctcctctcgccgggcctgctcatcgagctccccggcatgcaccgctgggtcgacttcggcagcctccgcgtcaccggcaaggccgccaccgtccacaccatcatcttcttcgtcctcttcctcattgtcaccatggcgtgcaaactccacatctacaccggcgcctagctgctgtacctcagctcgctacctgtgggcgactagctgagctccctagctaatcttcaccgcacgcaccgtacgtacctgttcgtcgtcgtctattcgtcaacccgttgttttgtattatatgctctctctcgtcatatatatcacacggtcgatcgccccggcatttcatangctgtacctgtattcctacttttacaanggtatacttgtatacgtacgtgatcttgttttagcatcatcctgatgcttcaaaaaaaaaaaaaaaacgagacgctcgaggtacccattncgccctatagtgagtcgtattacgcgcgctcactggccgtcgttttacaacgtcgtgactgggaaaacccctggcgtacccaacttaatcgncttgcagcaatccccctttcgcc

SEQ ID NO: 59706 - protein, 70 aa, Zea mays
  misc_feature: Ceres CLONE 1516810
MLDWAPVVVGVVLFVLLSPGLLIELPGMHRWVDFGSLRVTGKAATVHTIIFFVLFLIVTMACKLHIYTGA

SEQ ID NO: 59707 - DNA, 741 bp, Zea mays
  misc_feature: Ceres CLONE 1516811
  misc_feature: Translation starting site: 140
aaagctggagctccccgcggtggcggccgctctagaactagtggatcccccgggctgcaggaattcgtctcacccctagaaaaaatcggttggactcgatttctctttaacaccgcagagcatgacgcaggcggcggctatggcttgggtgtcgaccctgtcgcggagcttactcgagatccctgtcgtcttctgtcagtcctccccggtcagcgtggtggtccgtgaatgaacgcacaagaactatggcgacatcatcgtccgcaacctctccgtccactatccttgtcggctagtgctccggagtaccgccccaactctgggctcactaatatctgcttgtggagagatgcttgagcttcaatgggctgatgcagccccatattgatcacaagactgtggacctcaccacggtcggccagactcttaagacgattaccttgtccatcctatgctgacgtgttatactgtccatatattcgaaggcctatggagatcgcttgatacttaatggaactaggtaatcgagcgcaagatctacctttataatggtatcaaattgcggaaatagtcgctgactcttttaaaaccccggcatgtggtaatctacgtgtttctttaagaaaaaaaataaacttaaacccttagcgtgcccatttttccctctaaggagtggaaaataaactgccggtcaattgactgattttttttaaccttcataaacaggaaaaacccgggggt

SEQ ID NO: 59708 - DNA, 752 bp, Zea mays
  misc_feature: Ceres CLONE 1516816
  misc_feature: Encodes the peptide sequence at SEQ ID NO. 59709
  misc_feature (277)..(277): n is a, c, t, g, unknown, or other
  misc_feature (361)..(361): n is a, c, t, g, unknown, or other
  misc_feature (409)..(409): n is a, c, t, g, unknown, or other
  misc_feature (548)..(548): n is a, c, t, g, unknown, or other
ggagctccccgcggtggcggccgctctagaactagtggatcccccgggctgcaggaattcgtctcacccctagaaaaagccctttcccctatccacgagcaaggcacagcagcagcgcaggggagtcggagtgacagccgcccgcaggatgccgacactaaacctgagcaccaacgtgccggtggacgcggtggtcgccgccgacatcctcagggactgctccaaggccgtcgccaggatcatcggcaagcccgaatccggacacaacttcggcttncacggatccacattctaagtcgactccagcagaaaccgaagacgatggtcgctgcgtccaaacatccagctcaatacataccancaccactacattcataaagcgctggatcatggtgttcatccaattcanccccgcacttcatgggaaatcccggctccgaagcacgagaccccaccaccacctagttatgggcctttgtacttcccacctgaaaacattgcatgggatgatgggcatgtatctgattcacaaattttattggacctcncttttttcccccaaaaaaaaaaaaaaaacgagggcgctcgagggaccccctttccccctaatgagggagcgtattaccccgccccccctgggcgccccttttttaaacgcgggggaggggaaaaaccttgggggttccccaaattttaggcccttgggggaaatctcccctttttccccggggggggaaataataaagaagacc

SEQ ID NO: 59709 - protein, 48 aa, Zea mays
  misc_feature: Ceres CLONE 1516816
  misc_feature (43)..(43): Xaa is any aa, unknown, or other
MPTLNLSTNVPVDAVVAADILRDCSKAVARIIGKPESGHNFGXHGSTF

SEQ ID NO: 59710 - DNA, 725 bp, Zea mays
  misc_feature: Ceres CLONE 1516817
  misc_feature: Encodes the peptide sequence at SEQ ID NO. 59711
  misc_feature (381)..(381): n is a, c, t, g, unknown, or other
  misc_feature (389)..(389): n is a, c, t, g, unknown, or other
  misc_feature (614)..(614): n is a, c, t, g, unknown, or other
  misc_feature (725)..(725): n is a, c, t, g, unknown, or other
acccgcggtggcggccgctctagaactagtggatcccccgggctgcaggaattcgtctcacccctagaaaaaatcaccaaacaagcaagctagctggtcaccagttgttaacatatacatcagcaagctccacgaaagcaagaagaagaagaaacatgacgaccactgctgcggtcgtcaagctcctgacagccgtactcctcttcttcgccgtctctcttcggggtaccaagggcgagccatgcggcacgtccagcatccacgtgcagaccgtcaacacgggcgcgacggcggccgccggcgacacgctgttcgaggtccaagtgaaaaacctgtgcccatgcagcgtcaagaacgtgcgcatggacggtggcggcttcncgacgacngtggaggtcgacccggtcctgttccgcccagtcgacggcggtgtctacctggtgaacgccggcgagtccatcgcgagcatgggcatcgtgagcttccgttacgcttgggacacttttctcagtgactcctaggagcttggaggtcgacggccagtgctagtagctactagctaccaaactactagagtcgtagcaagctggttgccttgttgaagtatactgtantgtggggctgtgggctgtatatcgcttttgaatacagtgctagtaataacgcataatcctccacgaaaaaaaaaaaaaacgagcgctcgagtaccccatttcgcctatagn

SEQ ID NO: 59711 - protein, 121 aa, Zea mays
  misc_feature: Ceres CLONE 1516817
  misc_feature (76)..(76): Xaa is any aa, unknown, or other
MTTTAAVVKLLTAVLLFFAVSLRGTKGEPCGTSSIHVQTVNTGATAAAGDTLFEVQVKNLCPCSVKNVRMDGGGFXTTVEVDPVLFRPVDGGVYLVNAGESIASMGIVSFRYAWDTFLSDS

SEQ ID NO: 59712 - DNA, 703 bp, Zea mays
  misc_feature: Ceres CLONE 1516819
  misc_feature: Encodes the peptide sequence at SEQ ID NO. 59713
aagctggagctccccgcggtggcggccgctctagactagtggatcccccgggctgcaggaattcgtctcacccctagaaaaatctccttcgcaaaccctcctaccccattccgccgcccgccccgcgaccccgaggaggaggcaagatgaagacgatcctggcgtcggagacgatggacatcccggagggcgtcacagtgacggtggcggccaagctggtgacggtggagggcccccgtcggaagctcacccggaacttcaagcacctcaccctcgacttccagctgcaggagggtggcctcgagctcaaggtggacccctggctcggccaccgccgcactatggtcgctatttggcgccgccctcgcccagggggggaacccttttccgggtggggaaccaacccccccccgcggcacaaatgacggtgtggcgaggcggcttgttctctccttcgcggggccgtgcgtcgctcgcgacgcgggcgtccgggcttacgcagtgtgtttggtgcgccgcgattgtccgctatgtcggccccggcttgacgggggggcgccgcgcgtccccccccgataaaggccgtggcgcgccgttagtccgcgggtcggggtggggttgtggggcgcgtccgttctgccgcgtcggggcatggccgtcgcgacgattaggccggggcgctagaaaccgcgcgggcccgtac

SEQ ID NO: 59713 - protein, 92 aa, Zea mays
  misc_feature: Ceres CLONE 1516819
MKTILASETMDIPEGVTVTVAAKLVTVEGPRRKLTRNFKHLTLDFQLQEGGLELKVDPWLGHRRTMVAIWRRPRPGGEPFSGWGTNPPPRHK

SEQ ID NO: 59714 - DNA, 724 bp, Zea mays
  misc_feature: Ceres CLONE 1516821
  misc_feature: Encodes the peptide sequence at SEQ ID NO. 59715
  misc_feature (724)..(724): n is a, c, t, g, unknown, or other
aaagctggagctccccgcggtggcggccgctctagaactagtggatcccccgggctgcaggaattcgtctcacccctagaaaaaaatctttcccccgtcctccctcgccttcgcctcgccggcaggagatttccaccaccaccgccggaccaccccgaccctccttccctctcgcgctatggcccagactgttgtgctcaaggttggcatgtcctgtgagggctgtgttggagctgtcaagcggctcctgggcaagatggaaggcgtcgagtcctacgacgtacacatcatggaacagacggtccccgagaagggcaatgtgacacctgactccgccctgcaaactggtttcaagaatggtaagaagacttccccctgggaggctgacgccctgaaaagtaaacccccccgcaccctgccggagccgcacccctgataggtccaatgatctggaaattccccagtaaaaacacgcgaatgtctctccccttggaacggtttccaataattgccaaactggttaactcggccccccactttttaccaggtggtattttgttgtaaccggtgatggtcctcttattgtttttcggggggccgaaaaatcaaatattttgtttcgtagcttgaccaaagccaaattgagagattttctgggcgcccccaattctagccctataattggaggccctcatacggcccgctatactatttgccctttttn

SEQ ID NO: 59715 - protein, 85 aa, Zea mays
  misc_feature: Ceres CLONE 1516821
  misc_feature (5)..(85): Pfam Name: HMA Pfam Description: Heavy-metal-associated domain
MAQTVVLKVGMSCEGCVGAVKRLLGKMEGVESYDVHIMEQTVPEKGNVTPDSALQTGFKNGKKTSPWEADALKSKPPRTLPEPHP

SEQ ID NO: 59716 - DNA, 696 bp, Zea mays
  misc_feature: Ceres CLONE 1516822
  misc_feature: Encodes the peptide sequence at SEQ ID NO. 59717
  misc_feature (44)..(44): n is a, c, t, g, unknown, or other
aagctggagctccccgcggtggcggccgctctagaactagtggnatcctcgggctgcaggaattcgtctcacccctagaaaaaagagcaaagcatagtcacctgcctatctatctagcgagagagagagaggaaagctagctagctagcatggagtgcggcagcaagaaggcagcaggcggtgtgttggcgctgctgcttctccagctggtgttagctccgacgacggcgacggcccgcctcctgcaggcggatacctccaccgtggttggcctggacatcatcgcgagggagtttggccatccagtgagaggcatcctctgtggtgaaacctgtgtcttcctaccatgctatacggcagccatgggttgccaatgcattggccaaatctgcatgatgtgatatcccccccaccgctatttgtaatttgtgttgggagaaacacaaggacgggaccggtggtgttcaacttattgcctgggtatgggggtcctattaagtcaggtttattcaaaagggattttttggcatgtgttaaacagcctgtgtgtattccatggatgctcccttttctcatcccatttgttaaaaaaaaaaaaaccccggcccccccgagggaccccattcccccccatagggaggcctaattccccccccccccctggccgtcctcttttcccaccccccggcccgggac

SEQ ID NO: 59717 - protein, 83 aa, Zea mays; identical to SEQ ID NO: 54608
  misc_feature: Ceres CLONE 1516822
  misc_feature (55)..(84): Pfam Name: Cyclotide Pfam Description: Cyclotide family

SEQ ID NO: 59718 - DNA, 689 bp, Zea mays
  misc_feature: Ceres CLONE 1516823
  misc_feature: Encodes the peptide sequence at SEQ ID NO. 59719
  misc_feature (541)..(541): n is a, c, t, g, unknown, or other
  misc_feature (542)..(542): n is a, c, t, g, unknown, or other
aaagctggagctccccgcggtggcggccgctctagaactagtggatcccccgggctgcaggaattcgtctcacccctagaaaaacttgctcgctgcgccgccgcctccgacatcgtcccttcgtccccacgagcaaccgataatccgccggcgttgagatgttggtttatcaggatctcctatctggcgacgagctcctgtcggattcattcacctacaaggagctcgagaacggcgtcctgtgggaggtcgagggaaagtgggtcacccaaggtcctgttgatgtggacattggtgccaatccatccgccgagggtggtgaggacgaaagcgttgatgacacagctgtgaaggtggttgatattgttgacacattccgtctacaggagcaacctccttttgacaagaaatcatttgtgtcttacatcaaaaaatacatcaagaatctcactgctgtgttggagccagagaaagcggatgagttcaaaaagggtgtcgagggtgcaaccaagtttctcctttagcagctgaaggacctccnnatttttgttgggtgagtccatgaaggatgatgcgtctgtggtgattcgctattaacagggatgtgcccactatccggacatccctctatttctctcatggtcttaaggaaaatcagtgctaggcgtgcggcgaaattagttaccctt

SEQ ID NO: 59719 - protein, 121 aa, Zea mays
  misc_feature: Ceres CLONE 1516823
  misc_feature (1)..(122): Pfam Name: TCTP Pfam Description: Translationally controlled tumour protein
MLVYQDLLSGDELLSDSFTYKELENGVLWEVEGKWVTQGPVDVDIGANPSAEGGEDESVDDTAVKVVDIVDTFRLQEQPPFDKKSFVSYIKKYIKNLTAVLEPEKADEFKKGVEGATKFLL

SEQ ID NO: 59720 - DNA, 659 bp, Zea mays
  misc_feature: Ceres CLONE 1516826
  misc_feature: Encodes the peptide sequence at SEQ ID NO. 59721
ctggagctccccgcggtggcggccgctctagaactagtggatcccccgggctgcaggaattcgtctcacccctagaaaaagattcctcagtcgccgagcaagccattcctgatcccgccccaaccccaatcgacaaacgccgccccttctcgtctcgacctctccccaccggctaaccctagcagcggcacgcgggcgacggcgaccagtagagggctagtcgcgccaccggcgaagggattcagcggtctacccgtcctccgacacaggcgcggcggcgtcctgcagattattattggtttgttgcaaaatgtctacggaagcgactttgaacaattctggtggttctgaatctgcattgctgttactggaacagcttgctgaagtttttggaaagttaaaaactcacaccgaaacatttctgcatttgcaaaatggcataaaatgggaagatattgaagggcatttcctcagccttgatgagtcgtacagaagcaagtttgatgaactggtagagaaggagaaggcattagaagaaaagaaagctgaagcttgtaggttgattgcagagaaagaggctaaagtttctacaaaagagcatgcctcactgaatcagcttcaggagctaagggatgctgctgtctcttctctagcagagg

SEQ ID NO: 59721 - protein, 116 aa, Zea mays
  misc_feature: Ceres CLONE 1516826
MSTEATLNNSGGSESALLLLEQLAEVFGKLKTHTETFLHLQNGIKWEDIEGHFLSLDESYRSKFDELVEKEKALEEKKAEACRLIAEKEAKVSTKEHASLNQLQELRDAAVSSLAE

SEQ ID NO: 59722 - DNA, 688 bp, Zea mays
  misc_feature: Ceres CLONE 1516830
  misc_feature: Encodes the peptide sequence at SEQ ID NO. 59723
  misc_feature (437)..(437): n is a, c, t, g, unknown, or other
  misc_feature (447)..(447): n is a, c, t, g, unknown, or other
  misc_feature (451)..(451): n is a, c, t, g, unknown, or other
aaagctggagctccccgcggtggcggccgctctagaactagtggatcccccgggctgcaggaattcgtctcacccctagaaaaactctcgcgccgccgcggaacacaacaccgcaccacactacccagcggaatccgcccacccgcacccgcacccggagcagaggagatatgtcgcaggggaagggaggagcggcgaggaaggaggaggtggtcaccagggagtacaccatcaacctccacaagcgcctccacggctgcacattcaagaagaaggcacccaacgccatcaaggagatcaggaagtttgcgcagaaggccatgggcaccacggacattaggatcgatgtgaagctcaacaagcacatctggagcagcgggatcaggagcgtgccgcggagggttcgtgtgaggatcgccctgcagaggacgacgagnaggatgctanggangagctctactcccttgtcaccgtcgcagagatccccgccaagggcttggaagggctggggacctaggtcgtttgacaaaaccgataaagctgtcgcgttatctacatctttagaggagtcctaagttgtattttgcaacaaccaaaaccttttggattccccaaaggttgtctatttcccgcaacaaaattgccagggccaagttttccttttcatggggggccgcctcccctttct

SEQ ID NO: 59723 - protein, 134 aa, Zea mays
  misc_feature: Ceres CLONE 1516830
  misc_feature (10)..(99): Pfam Name: Ribosomal_L31e Pfam Description: Ribosomal protein L31e
  misc_feature (89)..(89): Xaa is any aa, unknown, or other
  misc_feature (93)..(93): Xaa is any aa, unknown, or other
  misc_feature (94)..(94): Xaa is any aa, unknown, or other
MSQGKGGAARKEEVVTREYTINLHKRLHGCTFKKKAPNAIKEIRKFAQKAMGTTDIRIDVKLNKHIWSSGIRSVPRRVRVRIALQRTTXRMLXXSSTPLSPSQRSPPRAWKGWGPRSFDKTDKAVALSTSLEES

SEQ ID NO: 59724 - DNA, 659 bp, Zea mays
  misc_feature: Ceres CLONE 1516832
  misc_feature: Encodes the peptide sequence at SEQ ID NO. 59725
ctggagctccccgcggtggcggccgctctagaactagtggatcccccgggctgcaggaattcgtctcacccctagaaaaaacgctccaaccctagcatcttctgcctgcctcggcacccgggcctttgccttgtgaacaaaagtcgtcgcgttcctcttggctgatgaaatcctcttctcgtctagatctgagcctccgcctgtctttcggatcagatgcttggtccgatcgaacaacggtgagtcttgctctgttatttgattgttctaaacgcatggttttgtttttgtgatgatgtgcaggttccgatctgtttcgtttgattgatgagttgacgcatcggctcgaaacgaggctgcatggtttttgtgcctggaggtttctgattagcgtgtttaaggaaaccccccgccacaattccttgctagaagtgctcgatccgtccaattgatatctgccgagctgcgacgttccgggggatctggatcttagcggacttgacatttgggaaggggccgacgggcttctaaagcctggccggggaaacaagggaggggaaaaggatacctgaaaaaaaaagtgaaatttgaactcctgaagggcctttgccccggttgggtgcccctcccatgggccggaattctaaataaaaatttct

SEQ ID NO: 59725 - protein, 42 aa, Zea mays
  misc_feature: Ceres CLONE 1516832
MKSSSRLDLSLRLSFGSDAWSDRTTVSLALLFDCSKRMVLFL

SEQ ID NO: 59726 - DNA, 716 bp, Zea mays
  misc_feature: Ceres CLONE 1516833
  misc_feature: Encodes the peptide sequence at SEQ ID NO. 59727
  misc_feature (663)..(663): n is a, c, t, g, unknown, or other
ggagctccccgcggtggcggccgctctagaactagtggatcccccgggctgcaggaattcgtctcacccctagaaaaactgctgcaacccaaccaaacccgcacgacacgacaccaagtcgaggagctcgagggcaccaatcatggccggcgtgaactccagcgtcgtcgggctcaagcccgccgcggcagtgccgcaggccgccgccgcctcatcgccggcgaagcgggtgcagctggccgcgcccgagggccgccgcgccgctctgctcggcctggcggccgtcttcgccgtcacggccaccaccgggtcggccaaggccacgatcttcgatgagtacctcgagaagagcaaggccaacacagagctgaacgaccagaagaggctggccaccaattggccccaacctttgcgcgcgcctacaccgtggagtttcggcagctgccagttccccctacaacttcactggggtgcccaggacctcccccaagcaaaagaaagtcccccttcattcaccaacaaacctcaaaaattgaatgccgaaggggaaggaaaaaattccaatgccggcctcccacgtttttctggaaagtggggaaaccacctaaccaccccccgtctgatggggaaatggaaggaaaatctccccctcggcctttgccnaccccaaaatatagtccaaagctggcggggaaattaaaactcttccaggggag

SEQ ID NO: 59727 - protein, 185 aa, Zea mays
  misc_feature: Ceres CLONE 1516833
  misc_feature (8)..(151): Pfam Name: PsaN Pfam Description: Photosystem I reaction centre subunit N (PSAN or PSI-N)
  misc_feature (174)..(174): Xaa is any aa, unknown, or other
MAGVNSSVVGLKPAAAVPQAAAASSPAKRVQLAAPEGRRAALLGLAAVFAVTATTGSAKATIFDEYLEKSKANTELNDQKRLATNWPQPLRAPTPWSFGSCQFPLQLHWGAQDLPQAKESPPSFTNKPQKLNAEGEGKNSNAGLPRFSGKWGNHLTTPRLMGKWKENLPLGLCXPQNIVQSWRGN

SEQ ID NO: 59728 - DNA, 711 bp, Zea mays
  misc_feature: Ceres CLONE 1516837
  misc_feature: Encodes the peptide sequence at SEQ ID NO. 59729
  misc_feature (330)..(330): n is a, c, t, g, unknown, or other
  misc_feature (333)..(333): n is a, c, t, g, unknown, or other
  misc_feature (392)..(392): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (410)..(410): n is a, c, t, g, unknown, or other
  misc_feature (413)..(413): n is a, c, t, g, unknown, or other
  misc_feature (465)..(465): n is a, c, t, g, unknown, or other
  misc_feature (466)..(466): n is a, c, t, g, unknown, or other
  misc_feature (546)..(546): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (679)..(679): n is a, c, t, g, unknown, or other
actgctggagctccccgcggtggcggccgctctagaactagtggatcccccgggctgcaggaattcgtctcacccctagaaaaagacctgcagccaaccatctaccagcgactcagcgagcgagagcagcacacactgcacgcagctagctaggagcagcagcagcggcggcgatggcggcctccatgatctcctcgtcagctctggcggtggcgcctcagggcctgccgcccctcggccgccgcgcctcctccttcgccgtcgtctgctccaagagaagatcattaccgacaaggccctgggggattgggggtggcctgaccttctacntcnacgccaacgggagaaagggcaaggttttttccccccccccccgggggaagagggagggnnnnaaannnnnannnatnccnccccattcttaaaaaagaataaaaggtccccccccccggggaggggtgggtnnttgggaacccctgggaatttctgaactggggcaggtcccccttcgctggggatccccccggcgcgggcgcccccccctcntnnnagaaccccaatgtcctcttttgggggggagaaaatccaatcgcgggccatctggcgcagacctagtgtagagatcgcgggttccgcaaaacatccccccccactaagggagtcccggctcctgcccgtncgacgggaacgttcgggcgcacgctccgtcgg

SEQ ID NO: 59729 - protein, 83 aa, Zea mays
  misc_feature: Ceres CLONE 1516837
  misc_feature (53)..(53): Xaa is any aa, unknown, or other
  misc_feature (54)..(54): Xaa is any aa, unknown, or other
  misc_feature (74)..(74): Xaa is any aa, unknown, or other
  misc_feature (76)..(76): Xaa is any aa, unknown, or other
  misc_feature (77)..(77): Xaa is any aa, unknown, or other
  misc_feature (78)..(78): Xaa is any aa, unknown, or other
  misc_feature (79)..(79): Xaa is any aa, unknown, or other
MAASMISSSALAVAPQGLPPLGRRASSFAVVCSKRRSLPTRPWGIGGGLTFYXXANGRKGKVFSPPPRGKREGXKXXXXPPHS

SEQ ID NO: 59730 - DNA, 715 bp, Zea mays
  misc_feature: Ceres CLONE 1516840
  misc_feature (715)..(715): n is a, c, t, g, unknown, or other
ggagctccccgcggtggcggccgctctagaactagtggatcccccgggctgcaggaattcgtctcacccctagaaaaagtcgcgccattcaacccgccggtgccgccgatgcttcacgctgtttgccggtcgccgtctcgacttcccttgttgtgtattcgaaccatagctgtcctaccgtcctcccttcccagcacccaatggaccacgtggggctgctctgcccgttaggcagcggcaacctgcggctgcagagcgacctcgccgttctggccacaacccatggcgcgcatgtgcagtacgccgtcgggcgcgctaaagctggcgctgctggtggtgtgtcgtgccctgacctcttcgttattcattacccggtatgacatactcttctcgttcggttcacaccgccacgtgtcctcgatttgcattgctctgcgttgtccagcctcgacaacccacggtttgaacacgtgacagatgatgacttaacttctgtggatggacatcttggtcgcttttgtagaaggaatgtttggttggctttttgaaaccaattccaactgcactttgggcttgtgaaaccgttaaggtgcattggttgtgtgggcctgtgtccgccccaagtatgccctcccacctttgcccttggaaaaaattaacctgcctaagacgggcatattccccaaataagggccccgggaaaaaaagaacttcn

SEQ ID NO: 59731 - DNA, 691 bp, Zea mays
  misc_feature: Ceres CLONE 1516841
  misc_feature: Pfam Name: DUF914 Pfam Description: Eukaryotic protein of unknown function (DUF914)
  misc_feature (332)..(332): n is a, c, t, g, unknown, or other
tccccgcggtggcggccgctctagaactagtggatcccccgggctgcaggaattcgtctcacccctagaaaaagtataataagcttcccctttctgcaactgatctgatccgggctgccgtgagctctgctcgccctgatggagttcaagagggatgtatggagcctgctcctcgtgctgctcctcgggcagctcgtcgccttctccatggccgcctcaagctttgcctcctccctcattgctaatcttggagtcgatgccccactgacacagtctttcttagcctacctgttgctgaccttagtctatgtaccaatcgtcctgcgtcgacngcagaagctgcaaatagcttggtactggtacctagctctgggcttcttttatgtacaggggaaatatcttggttgtggagggcgtaccaatactcctacattacccggtgtgacttttgttggaatgctggactgttgtattgggtcctccttgctcccctggaacgcactgggcacaaaaaaattccttcttggcaattcgggggggcagggaaatttttttggaaggggcccccccttttggcggtttttaaaaagaaaaattccccaaaaaaggcaaaattcccaaaaaaaaaaaaaaaaaaccggggccccctccggggcccccatttccccccctaatggggaggccctaattg

SEQ ID NO: 59732 - DNA, 685 bp, Zea mays
  misc_feature: Ceres CLONE 1516844
  misc_feature: Encodes the peptide sequence at SEQ ID NO. 59733
  misc_feature (433)..(433): n is a, c, t, g, unknown, or other
  misc_feature (503)..(503): n is a, c, t, g, unknown, or other
  misc_feature (552)..(552): n is a, c, t, g, unknown, or other
  misc_feature (604)..(604): n is a, c, t, g, unknown, or other
  misc_feature (610)..(610): n is a, c, t, g, unknown, or other
  misc_feature (611)..(611): n is a, c, t, g, unknown, or other
aaagctggagctccccgcggtggcggccgctctagaactagtggatcccccgggctgcaggaattcgtctcacccctagaaaaacttgacgaagtgacgactcacaagcacagcaaggctcgctcgctcgcacacaccaagcaagcaggccgcagcccgcaggcgtctcacaggctctccgccgttccccaacgcgctttccccggcgccatggccaggctggcgctagcgctcctcctgctgctggccgtggcggcatccgcgtgggccggcgccggcgcgagccacctcgatctgggcctgggcttcctctcctccggggaccgccggcgggaatgccgcggcacggtggccgagtgcctggacgaggaggagggcctggacctgggggcggggcccgcgtccgtggagtcccaccgccgcgcgctctacngcggcggcggcggcgggtacatcagctacggcgcgctgcggcgggacaacgtgccctgctcccgccgcgncgccagctactacaactgccgccccgggggccaggccaacccctaccanccgcgctgctcccgcatcacccgctgcccgcgctgagcggatccggcatccnacccgnncgccgagaataagttctttttgcctgttcaccccacccgagtgctaccgctaccggcgccgctgttcacagtaa

SEQ ID NO: 59733 - protein, 125 aa, Zea mays
  misc_feature: Ceres CLONE 1516844
  misc_feature (57)..(125): Pfam Name: RALF Pfam Description: Rapid ALkalinization Factor (RALF)
  misc_feature (75)..(75): Xaa is any aa, unknown, or other
  misc_feature (98)..(98): Xaa is any aa, unknown, or other
  misc_feature (114)..(114): Xaa is any aa, unknown, or other
MARLALALLLLLAVAASAWAGAGASHLDLGLGFLSSGDRRRECRGTVAECLDEEEGLDLGAGPASVESHRRALYXGGGGGYISYGALRRDNVPCSRRXASYYNCRPGGQANPYXPRCSRITRCPR

SEQ ID NO: 59734 - DNA, 680 bp, Zea mays
  misc_feature: Ceres CLONE 1516845
  misc_feature: Encodes the peptide sequence at SEQ ID NO. 59735
  misc_feature (680)..(680): n is a, c, t, g, unknown, or other
ggagctccccgcggtggcggccgctctagaactagtggatcccccgggctgcaggaattcgtctcacccctagaaaatcatcgcggctactctccccagccatcctcttcacaaagaagccggcttccctgcgctccatttcctctgcgacagcgagacacggggttcgggtggtggtagccgcggcgtcagcggccgcagcgtcaccagtgtccgcggcgcgggtgcgaccgtcggcggcggaggtagcgcggactgtcgtggagcttgccgcgtctgggactctctccatggtgggcccagacggctggcctctcggcgtcggcgcgcacttcgtcgcggattctgccggtgcacccgcgctctgcctgtctgccgctcgggtcgccgcgcccgatgcgccggccagcttccacgtcgagtttcgacagagtggggctaggacaccacagtgcactatgcttggtgccttaactaagcctagtgatgaatctgtgttgaagaagctttctactaggtggcaaaagaaattttgggaaagattgatcaagatcttttgtatttaatatctgttgaccggatcttgcacatggaagattttcatgaggcaggacatgtaactttattcagttttgtagtcttttttagttggtagtttcctttttcatccataagtaagn

SEQ ID NO: 59735 - protein, 91 aa, Zea mays
  misc_feature: Ceres CLONE 1516845
MVGPDGWPLGVGAHFVADSAGAPALCLSAARVAAPDAPASFHVEFRQSGARTPQCTMLGALTKPSDESVLKKLSTRWQKKFWERLIKIFCI

SEQ ID NO: 59736 - DNA, 698 bp, Zea mays
  misc_feature: Ceres CLONE 1516850
  misc_feature: Encodes the peptide sequence at SEQ ID NO. 59737
  misc_feature (623)..(623): n is a, c, t, g, unknown, or other
  misc_feature (651)..(651): n is a, c, t, g, unknown, or other
  misc_feature (698)..(698): n is a, c, t, g, unknown, or other
ggagctccccgcggtggcggccgctctagaactagtggatcccccgggctgcaggaattcgtctcacccctagaaaaaagcactagtctcctcttcgcacgagcgcaacaccatccacccaccagttcgaagcggaggcgaccggcaacctgcggcggagatgtcaggcaggggcaagggcggcaaggggctcgggaagggcggcgcgaagcgtcaccggaaggtgctgcgcgacaacatccaggggatcacgaagccggcgatccggaggctggcgaggaggggtggcgtgaagcgcatctccgggctgatctacgaggagacccgcggcgtgctcaagatctttctcgagaatgtcatccgcgacgctgtgacctacacggagcacgcccgtcgcaaaaccgtcaccgctatggacgtcgtgtacgccctcaaacgccagggccgcactctctatggcttcggcggctaggttaggtgtgggtaattgcctgtccaggtgtctcggatctgtggtactagtttggctgccttcctgtgttcgtattgtagtagttgtggtagctgggttgcttgtcgtcctgtagtcgtgcttcttttggtctgtaagaaccgctgtttcnatggggatggaattgaaccgtgaaatangaatgtttggcatgttaaactttttctccaaaaaaaaaaaaaaaacn

SEQ ID NO: 59737 - protein, 103 aa, Zea mays; identical to SEQ ID NO: 6459
  misc_feature: Ceres CLONE 1516850
  misc_feature (25)..(94): Pfam Name: Histone Pfam Description: Core histone H2A/H2B/H3/H4

SEQ ID NO: 59738 - DNA, 691 bp, Zea mays
  misc_feature: Ceres CLONE 1516851
  misc_feature: Encodes the peptide sequence at SEQ ID NO. 59739
  misc_feature (384)..(384): n is a, c, t, g, unknown, or other
  misc_feature (403)..(403): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (662)..(662): n is a, c, t, g, unknown, or other
  misc_feature (665)..(665): n is a, c, t, g, unknown, or other
aagctggagctccccgcggtggcggccgctctagaactagtggatcccccgggctgcaggaattcgtctcacccctagaaaaaaccgaagcttctcagtagtaaatggcggctccctcctccaccgccgccaccatcatcagctcctgctgccgcctcgggcctccctctccgcccgaacaagccgctgcaggcgctcgcatgccgcaggcgccggcagaatgcgtgtcggcgtcgcacgcgctgcgcggggcgtgcgtggcaaccgcgcgcaccaaagcgccggcgcggtggaatccagcccaggcagtgcccgcccgtggccgccaactccctaggaaacgtcttgcccgagaatctgccacgcccaacccgcgcccagtangatcgaacagccgtctcanactcggcggaccgcggcggaacttggtggaagccaccgccctctgttcctcgacgcggagggacccccgcacgggctggttactcgctcttgacgcaccccccgggcactggtgaaaaatccggagttgtaaaaaaaaaaacgcgccaaatttggaaaaaacggagagttttaatttgtcaccaaaaccccttgaaaattcctgtgcccggaactttttgggttaaaaaagaaattttgnnnttaattttgtaaactantgnacccctcgaaggcccaagccaaattt

SEQ ID NO: 59739 - protein, 105 aa, Zea mays
  misc_feature: Ceres CLONE 1516851
  misc_feature (62)..(62): Xaa is any aa, unknown, or other
  misc_feature (68)..(68): Xaa is any aa, unknown, or other
MPQAPAECVSASHALRGACVATARTKAPARWNPAQAVPARGRQLPRKRLARESATPNPRPVXSNSRLXLGGPRRNLVEATALCSSTRRDPRTGWLLALDAPPGHW

SEQ ID NO: 59740 - DNA, 687 bp, Zea mays
  misc_feature: Ceres CLONE 1516854
  misc_feature: Encodes the peptide sequence at SEQ ID NO. 59741
  misc_feature (532)..(532): n is a, c, t, g, unknown, or other
aagctggagctccccgcggtggcggccgctctagaactagtggatcccccgggctgcaggaattcgtctcacccctagaaaaaatcaggcatccaagcttaaagcaagcagatctaagctccaggcagcgtcccgacagagtgagtgagtagcacgacaacaacgatggcttccctgaaggccgcgaagcccatcggagttgcggcgcagggcaaggagccggcacccaagctcgacgagacggcgacgaaaccgtcagccgcgaagagcggtggcgttaagaaggctgagcagacgccccgggaaaccaaaaggaaggtgaagagcagcagaccggcggcggcggccaataagtgacgtacagtacgtgtggagtgtaatgcagcttccatgcatgcatgagtgcatccatgccatgttatgaatctagtccttgctttcttgtatctaccatgtgacgcgacgtgtgcgtcccttcatgtgtgatgatgccagatgaatactacaaataagacgttgtgactgtgctcantttgctatctctctcatcgcatggttggcgtcggtctttgtgctcgtgaacgggtggcaactgggggcgttggtgatcccattcccccccctgaagcgtttatttactggcccccccggggccgggtttataccactccggactggggaaaaccc

SEQ ID NO: 59741 - protein, 63 aa, Zea mays
  misc_feature: Ceres CLONE 1516854
MASLKAAKPIGVAAQGKEPAPKLDETATKPSAAKSGGVKKAEQTPRETKRKVKSSRPAAAANK

SEQ ID NO: 59742 - DNA, 701 bp, Zea mays
  misc_feature: Ceres CLONE 1516856
  misc_feature: Encodes the peptide sequence at SEQ ID NO. 59743
  misc_feature (346)..(346): n is a, c, t, g, unknown, or other
  misc_feature (382)..(382): n is a, c, t, g, unknown, or other
  misc_feature (385)..(385): n is a, c, t, g, unknown, or other
  misc_feature (390)..(390): n is a, c, t, g, unknown, or other
  misc_feature (392)..(392): n is a, c, t, g, unknown, or other
  misc_feature (395)..(395): n is a, c, t, g, unknown, or other
  misc_feature (397)..(397): n is a, c, t, g, unknown, or other
  misc_feature (401)..(401): n is a, c, t, g, unknown, or other
tccccgcggtggcggccgctctagaactagtggatcccccgggctgcaggaattcgtctcacccctagaaaaaatcgccagacacactatagaccacagccagtcagccacatcactagctagctgtgcagaggcaatggcgtccaaggttgagctggtggtggaggtcaagtccccggctgacaagctgtgggcggcgctgcgcgactccacggagctgttccccaagatcttccccgagcagtacaagagcatcgagaccgtcgagggcgacggcaagtcggccggcaccgtccgcctcctcaagtacaccgaggcggtgccgatgctgacgttcgccaagganaatcttgataccccccacgacgaggggggggtggtntcntacancntgntnaacnccccacctcgcggacttcttacagatcttcaagatccccctgaaggtgacttccgccaaggcggaacgcgaagggccgccccctccttcagcttgggccatggagttcgacaaggcccaacaacctgtggccccaaccccgaacgtcatcaagggaaaccgcccccccaaacgttccccggacctttaaggagtttcctccttcaagaaagaaaatggggggcggccccttgcgcgattgtcccctgtcccgtcaccgttcccccgcccatatctcctacccgcgtcagagatttttcta

SEQ ID NO: 59743 - protein, 188 aa, Zea mays
  misc_feature: Ceres CLONE 1516856
  misc_feature (70)..(70): Xaa is any aa, unknown, or other
  misc_feature (85)..(85): Xaa is any aa, unknown, or other
  misc_feature (86)..(86): Xaa is any aa, unknown, or other
  misc_feature (87)..(87): Xaa is any aa, unknown, or other
  misc_feature (89)..(89): Xaa is any aa, unknown, or other
MASKVELVVEVKSPADKLWAALRDSTELFPKIFPEQYKSIETVEGDGKSAGTVRLLKYTEAVPMLTFAKXNLDTPHDEGGVVSYXXXNXPPRGLLTDLQDPPEGDFRQGGTRRAAPSFSLGHGVRQGPTTCGPNPERHQGKPPPQTFPGPLRSFLLQERKWGAAPCAIVPCPVTVPPPISPTRVRDFS

SEQ ID NO: 59744 - DNA, 680 bp, Zea mays
  misc_feature: Ceres CLONE 1516857
  misc_feature: Encodes the peptide sequence at SEQ ID NO. 59745
ggagctccccgcggtggcggccgctctagaactagtggatcccccgggctgcaggaattcgtctcacccctagaaaaagcaatacccgacgcgcaagccagtgccgcgcccagatctccgcgacagatcagtcgttcgtccagctaactgcactgcacgcaatggccaccacggcgaccgaggcgaccaagacgactgcaccggcgcaggagcagcaggccaacggcaacggcaacggcgagcagaagacgcgccactccgaggtcggccacaagagcctgctcaagagcgacgacctctaccagtacatcctggacacgagcgtgtacccgcgggagccggagagcatgaaggagctgcgcgagatcaccgccaagcacccatggaacctgatgaccacctccgccgacgagggccagttcctcaacatgctcatcaagctcatcggcgccaagaagaccatggagatcggcgtctacaccggctacttggtcctcgccaccgggcttccactcccggaggagggcaccctcttggccatggacattcaccggcaaaactacgaactaggccttcccggcatcaacaaggccgggggggccacaaaaatcgattccgcgaagggccccgccctccccgtctaggaaaaacccggggcggaaaaggaaccaattctggtt

SEQ ID NO: 59745 - protein, 160 aa, Zea mays
  misc_feature: Ceres CLONE 1516857
  misc_feature (51)..(161): Pfam Name: Methyltransf_3 Pfam Description: O-methyltransferase
  misc_feature: SWISSPROT Homolog: EC 2.1.1.104 Caffeoyl-CoA O-methyltransferase
MATTATEATKTTAPAQEQQANGNGNGEQKTRHSEVGHKSLLKSDDLYQYILDTSVYPREPESMKELREITAKHPWNLMTTSADEGQFLNMLIKLIGAKKTMEIGVYTGYLVLATGLPLPEEGTLLAMDIHRQNYELGLPGINKAGGATKIDSAKGPALPV

SEQ ID NO: 59746 - DNA, 675 bp, Zea mays
  misc_feature: Ceres CLONE 1516858
  misc_feature: Encodes the peptide sequence at SEQ ID NO. 59747
ggagctccccgcggtggcggccgctctagaactagtggatcccccgggctgcaggaattcgtctcacccctagaaaaaagccaagcaaataagacgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacgcctgcggctgcggtagcagctgcaagtgcgacccctgcaactgctgatcacatcgatcgacgaccatggatatgattattatctatctagcttggtggtggtggttgaacaataataggcgaggcccgagctggctgccatacataggtatttgtgtgtgtgtgagaaagagagaaaacagaagtcttcagttggctatctctctctctgcatgtttggcgtcagtctttgtgctcatgtacgtgtggctacatgcatggtggtttgatccgattgcgtctgctgaaaccaatatataattgggtccccgaggatttgattggaaactatatataaaaa

SEQ ID NO: 59747 - protein, 76 aa, Zea mays; identical to SEQ ID NO: 42649
  misc_feature: Ceres CLONE 1516858
  misc_feature (1)..(76): Pfam Name: Metallothio_2 Pfam Description: Metallothionein

SEQ ID NO: 59748 - DNA, 687 bp, Zea mays
  misc_feature: Ceres CLONE 1516865
  misc_feature: Encodes the peptide sequence at SEQ ID NO. 59749
  misc_feature (477)..(477): n is a, c, t, g, unknown, or other
aaagctggagctccccgcggtggcggccgctctagaactagtggatcccccgggctgcaggaattcgtctcacccctagaaaaaagtccttctccacctagctcccccgcgccaagaacacgccagctagcaagcgcgctcgatcgaataccgttaccgtgtcgccatggccgccaccgcgtctctatcagccgtcgcggcgccgctgtcggtgcccgggctcaggaagccgctcggcgcgtcgtcgctccggcccctgcagccgagggcggcgaggatgacgacgacggccgtgcgggcgtcggcgtcgccctcgtccacgtccatcaaggagaaggctgcggccgggctgaccgcggcggccctggcggccgcgctggtgctgccggacgtcgcggaggccgcgcagtccggcgggctcacgccgtcgctcaagaacttcctcctcagcatcgtgtccggtggggtcgtgctcgntggtattgtcggcgccgtcgtcgccgtctccactttcaacccgtcaagagggcctgatcgaaatcatcgtatcgatcgtctcgcctgtgtcctgtcctgtgcctggtgctgctgtatcgactgggggggctaaatcccctgtgggtaaattgattttggaaaatgttcagacttatttcttttctaaagagtgggagttcgagtttaact

SEQ ID NO: 59749 - protein, 147 aa, Zea mays
  misc_feature: Ceres CLONE 1516865
  misc_feature (104)..(104): Xaa is any aa, unknown, or other
MAATASLSAVAAPLSVPGLRKPLGASSLRPLQPRAARMTTTAVRASASPSSTSIKEKAAAGLTAAALAAALVLPDVAEAAQSGGLTPSLKNFLLSIVSGGVVLXGIVGAVVAVSTFNPSRGPDRNHRIDRLACVLSCAWCCCIDWGG

SEQ ID NO: 59750 - DNA, 642 bp, Zea mays
  misc_feature: Ceres CLONE 1516869
  misc_feature: Encodes the peptide sequence at SEQ ID NO. 59751
  misc_feature (423)..(423): n is a, c, t, g, unknown, or other
  misc_feature (465)..(465): n is a, c, t, g, unknown, or other
  misc_feature (482)..(482): n is a, c, t, g, unknown, or other
  misc_feature (505)..(505): n is a, c, t, g, unknown, or other
tccccgcggtggcggccgctctagaactagtggatcccccgggctgcaggaattcgtctcacccctagaaaaaaaccgcgaagcactacactacactacaccacacccacccgacgacgatcacacacgcagaagatcgagttcgttcgatcgtgaccgtgacgcaggaagctataagctagccaagacaggaataataatggcggcgtcgacggtggcgagcctctctgtcccggtgacgacgacgaccttcgcggcggcggcggcagcgggcggcgccgacgtgctgatcgtcgtcccgaggagggcgggcgctgggcgcgtctgggttccctcgcggcgcgcgcctgcggcgcggcagcggggcgttgggtcgcgtgcggtcagcgggccggccacgcgcggagatctccgacagtgtcngagacatcagcagcggaggagactgcgcgacgacagaaggcnactccagtgcccgcggntggaacaaggtgaagaactcacngcacggcagccacgcccgcaacagcttcaaggaaacaacgccacaacccgttcgaaaaatactggcaggaacactcgggacttccagggatggcccattctcgaacaaactaggttagcccgaaaacctaaataggc

SEQ ID NO: 59751 - protein, 146 aa, Zea mays
  misc_feature: Ceres CLONE 1516869
  misc_feature (75)..(75): Xaa is any aa, unknown, or other
  misc_feature (89)..(89): Xaa is any aa, unknown, or other
  misc_feature (95)..(95): Xaa is any aa, unknown, or other
MAASTVASLSVPVTTTTFAAAAAAGGADVLIVVPRRAGAGRVWVPSRRAPAARQRGVGSRAVSGPATRGDLRQCXRHQQRRRLRDDRRXLQCPRXEQGEELTARQPRPQQLQGNNATTRSKNTGRNTRDFQGWPILEQTRLARKPK

SEQ ID NO: 59752 - DNA, 730 bp, Zea mays
  misc_feature: Ceres CLONE 1516876
  misc_feature: Encodes the peptide sequence at SEQ ID NO. 59753
  misc_feature (237)..(237): n is a, c, t, g, unknown, or other
  misc_feature (337)..(337): n is a, c, t, g, unknown, or other
  misc_feature (400)..(400): n is a, c, t, g, unknown, or other
  misc_feature (405)..(405): n is a, c, t, g, unknown, or other
atcgctggagctccccgcggtggcggccgctctagaactagtggatctctcgggctgcaggaattcgtctcacccctagaaaaatttccactttcgagcgcagaaacgagagggcaggagcagccgcagtcccggcgatcccgccgccggtcgccctcatacttcctcgtcactgccttcgtttctctttccaacaatcaagatgagccgtggcggtagcgcgggtggtggtcaaanttctctgggttacctctttggaagcggtgagccccccaaaccagcattggcaccagctgtaagtgctccacctgctgctgcaggtgctccacctgctganaaaccacctgctgcaaaagtttgttgcccccccccccgaggcggggggggggtaccacccaanccacnaaccccccccgtggggaaggggaaaaacacaggaaattttctttgggagcgtccttcgaccagggccatgtttcttccttccgatggctcctcctttggaaaactggctccgggataacttaccccgcttccccaaccttatctcctccttttgttcccgccatcctttaccgccctatgtcgccgccgcaacttctcttcgtggtggccccgccttataggacctcccgtggggcccatacaggtgcggctaacgcccccagggcaagattaggtgcccttaacccccaatatccatggccactctaaatacgactacccccgc

SEQ ID NO: 59753 - protein, 106 aa, Zea mays
  misc_feature: Ceres CLONE 1516876
  misc_feature (12)..(12): Xaa is any aa, unknown, or other
  misc_feature (45)..(45): Xaa is any aa, unknown, or other
  misc_feature (66)..(66): Xaa is any aa, unknown, or other
  misc_feature (68)..(68): Xaa is any aa, unknown, or other
MSRGGSAGGGQXSLGYLFGSGEPPKPALAPAVSAPPAAAGAPPAXKPPAAKVCCPPPRGGGGVPPXPXTPPVGKGKNTGNFLWERPSTRAMFLPSDGSSFGKLAPG

SEQ ID NO: 59754 - DNA, 690 bp, Zea mays
  misc_feature: Ceres CLONE 1516877
  misc_feature: Encodes the peptide sequence at SEQ ID NO. 59755
aagctggagctccccgcggtggcggccgctctagaactagtggatcccccgggctgcaggaattcgtctcacccctagaaaaagagctctctctagcattacccggacggcggaagcgtaagcgcaaaacgaatcaagcggccgccatggtgaagggacgcacgggacagcgcgtcaggctctacgtccggggcaccatccttggatacaagaggtccaagtcaaaccagtacgagaccacgtctctcgtgcacatcgagggggtgaacaccaacgaggatgtcgcgtggtacgctggcaagcgcatggcgtacatctaccaggccaagaccaagagcaatgagacccgctacaggtgcatctggggcaaggtcacacgaccgcacggaaactcgggcgtcgtccgtgccaaattcatgtccaacctcccacctgagtccatggggcacaaggtcagagtgttcatgtacccgagcagcatttaacgttttgttggactaaagatggactagaaatggccatgtgtttatttctcacttttctctgagctataaatgccttgtgttggtaacttagattgttcaagagctcagcctgtgcgagttatgccaaaatttgatgacgaacggatcaactattgtcgtaatgttatgccagcagcagatcttaatttgccccgttacatcaaaa

SEQ ID NO: 59755 - protein, 112 aa, Zea mays
  misc_feature: Ceres CLONE 1516877
  misc_feature (12)..(106): Pfam Name: Ribosomal_L35Ae Pfam Description: Ribosomal protein L35Ae
MVKGRTGQRVRLYVRGTILGYKRSKSNQYETTSLVHIEGVNTNEDVAWYAGKRMAYIYQAKTKSNETRYRCIWGKVTRPHGNSGVVRAKFMSNLPPESMGHKVRVFMYPSSI

SEQ ID NO: 59756 - DNA, 653 bp, Zea mays
  misc_feature: Ceres CLONE 1516880
  misc_feature: Encodes the peptide sequence at SEQ ID NO. 59757
  misc_feature (548)..(548): n is a, c, t, g, unknown, or other
ctccccgcggtggcggccgctctagaactagtggatcccccgggctgcaggaattcgtctcacccctagaaaaagggtcgtccgccgccaccaattgctagcgcaatcctagccctagcccagcgcccctccctgcgtcgtgctcggtagcgatggcgtcgttttctgaagcgcccccggggaacccaactgctggcgagaagatcttcaagaccaagtgcgcgcagtgccacaccgtcgacaagggcgccggccacaagcaaggtcctaatttgaatggtctgtttgggaggcagtctggtacaacacctggctactcttactcttcggctaacaagaacatggctgtgatttgggaggagaacactttgtatgactacttgcttaatcccaagaagtacattcctggaaccaagatggtattccctggactgaaaaagccacaggaacgtgctgatctcattgcatacctgaagaatgccactgtctgatgaggatgctgctgtggctctaaagatgaagagcagcgattcttttttgcagctaanataatgacacgaatttactttaatttgacaggctggatgaacagaaagctaagaactccaggtagttctgtaacgtttttgtctattgctgggggcaaacacacc

SEQ ID NO: 59757 - protein, 112 aa, Zea mays; identical to SEQ ID NO: 4641
  misc_feature: Ceres CLONE 1516880
  misc_feature (12)..(111): Pfam Name: Cytochrom_C Pfam Description: Cytochrome c

SEQ ID NO: 59758 - DNA, 734 bp, Zea mays
  misc_feature: Ceres CLONE 1516883
  misc_feature: Encodes the peptide sequence at SEQ ID NO. 59759
  misc_feature (734)..(734): n is a, c, t, g, unknown, or other
tccccgcggtggcggccgctctagaactagtggatcccccgggctgcaggaattcgtctcacccctagaaaaaacggataaaaagaaagaggagctcggacaagggagcgccatcgtttggtttcctagctgaattctcgatcgctcgcccgctccacaagaaagaagctagcttttatgatggcgtctctggtgtctcggcagcaccgtagcggtggccgaggctgtcacctctgggaggacgcggccagcgcgccggtacttgctggtcgtgccgccagatgacagcagggccggtccctcccccgccaaggaggataaaggcctcggcgagaccatcttcggctttatcttaagaaagcacccattgatggagaaatgaccttttctttaacaacccccccataccgcgcgcggaccgcaggcctccccgtgtcaactatgaccgcacagcaaaaaggcttccccgacgcctaactaactccgtcagacggaaggtgtgggtaaaaattcgtccgggcctcctccgggccttttttgatcgaaaaaataaaaattggaatgttggggtttgtttaatcggatggctctgaacttttatggttcggttttggtctttctttagaggcgaaaatgtggtccgcccacctattcttatggatggcaccttgtttttgtgactggcgacactttccatttacttcataatgccacacaagtacgctatacgcccn

SEQ ID NO: 59759 - protein, 34 aa, Zea mays
  misc_feature: Ceres CLONE 1516883
MASLVSRQHRSGGRGCHLWEDAASAPVLAGRAAR

SEQ ID NO: 59760 - DNA, 664 bp, Zea mays
  misc_feature: Ceres CLONE 1516982
  misc_feature: Encodes the peptide sequence at SEQ ID NO. 59761
gctctaaactagtggatcccccgggctgcaggaattcgtctcacccctagaaaacctccgccgtcgcctgtccactttccccgtgcttctccgccgtcgaggccgcgtcccagtgcgaagagaccacgactcagatggccagccgctgggtccggcccgaggtgtacccgctgttcgcggcaacgggcgtggccgtcggcatctgcggatttcagctcttccggaacatcaccggcaacccggaagtcagggtaaacaaggcagggagggcagctggtgtgcttgagaaccatgaggaggggaggcgttacgccatgcatggcctaagaaactttgtgcacgacaagactcctgagatcatgcctgcagttaacaagttctttcactgaccctaagtgaaacatgttggattggaatactactactactacttgctactgggggattttaacacttttgctgggcaactccattatgttggggaacttccccttgacctcctaaaagaactttttgaggtgcctgggggatgaccttcctattatgtattaattggggaattaattttgcttccccccctccctttgagggtccacattcaatctgagtcttgctggattttgccccacctttaaattgtaaaaatattttctcttttgggatc

SEQ ID NO: 59761 - protein, 84 aa, Zea mays
  misc_feature: Ceres CLONE 1516982
  misc_feature (2)..(85): Pfam Name: B12D Pfam Description: B12D protein
MASRWVRPEVYPLFAATGVAVGICGFQLFRNITGNPEVRVNKAGRAAGVLENHEEGRRYAMHGLRNFVHDKTPEIMPAVNKFFH

SEQ ID NO: 59762 - DNA, 858 bp, Zea mays
  misc_feature: Ceres CLONE 1516987
  misc_feature: Encodes the peptide sequence at SEQ ID NO. 59763
  misc_feature (1)..(1): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (714)..(714): n is a, c, t, g, unknown, or other
  misc_feature (715)..(715): n is a, c, t, g, unknown, or other
nttttnnnnnnnnnnnnnnnnngggggnnntnnnnnnnttactttnnnnnnntcacagctggagctccccgcggtggcggccgctctagactagtggatcccccgggctgcaggaattcgtctcacccctagaaaatcagcagtgacgaactcgaagcttgcgttcttgtagtagaggtcggcagcaagcggcggtagagcgagaggtcgagaagatgaagagcagcactctgttggccatcctagttctccaggcccttctggtctctgcggccgtggccaaaggacctgcagggccgactacgaaaaagcattgctggtgcggcgagtgcaccagctggtcgggcgtgtgaacctgtgagaacttcttcactaagtgtgccgccccctgtcagtaattgcgttccccgtgtccacggacaacgggggcccttgggggggggggggccgcgacctccccccccccacaacctgcgggccggtaagaatccactgaaagagcatccttcccgattgccccccgggggtccgccccgccccccctgccgcgccgccgggcccggattgggagtccgcttcgccaggggcgcccgtccgcggccgtctcccgctctttgtgtttccatcaccttggccagccccctcacgctgataaaggaggcggggcgtggtgggggcgggcgagagtgagaggaggggggggcggcgcggagnnggggcgaacggtcccgcgcagtgtcacataacctccgtgaatttgcaacagtgatgcccgtccagggccgcccgcgccctccatgcactcccccagaccacacacgcataaacccatcctatcgcggggcccccggccggccg

SEQ ID NO: 59763 - protein, 45 aa, Zea mays
  misc_feature: Ceres CLONE 1516987
MKSSTLLAILVLQALLVSAAVAKGPAGPTTKKHCWCGECTSWSGV

SEQ ID NO: 59764 - DNA, 576 bp, Zea mays
  misc_feature: Ceres CLONE 1517052
  misc_feature: Encodes the peptide sequence at SEQ ID NO. 59765
  misc_feature (89)..(89): n is a, c, t, g, unknown, or other
atagctggagctccccgcggtggcggccgctctagactagtggatcccccgggctgcaggaattcgtctcacccctagaaaaagcggcngtatccctaatccctacctccagtctctgggcaccaaatttccggcggcgatggcggcggctgtggcgaggtcagggttccggcgcatgttctccgtctctgccttcgcgccgccgaaggcgcccgccgcgcgccccaaggccgacccatcccccaacctcttcgtctccggcttaagcaagcgtaccacaagtgaaggacttagagaagcctttgcggagtttggtgaagttttgcatgctcgagttgtgaccgatcgtgtcagtgggttttctaagggatttggctttgtaaggtatgctacgaccgaagaggcagcccagggaatagagggaaaggatgggaaaggtccttgatgggatgggttaattttttgccgaaattaccctaaaaccccagacccaccccccggaaggaaaacaggggatggaaattccccagcccccccaacaatttcttggggggaaggccccccccccaggggttc

SEQ ID NO: 59765 - protein, 101 aa, Zea mays
  misc_feature: Ceres CLONE 1517052
  misc_feature (37)..(99): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAAAVARSGFRRMFSVSAFAPPKAPAARPKADPSPNLFVSGLSKRTTSEGLREAFAEFGEVLHARVVTDRVSGFSKGFGFVRYATTEEAAQGIEGKDGKGP

SEQ ID NO: 59766 - DNA, 752 bp, Zea mays
  misc_feature: Ceres CLONE 1517068
  misc_feature: Encodes the peptide sequence at SEQ ID NO. 59767
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
nnnnnnnnnnnnnnnnnnnnnnaaaannnnnnnnnaaaaggnnnnnnnnnnnnnnccaaactggtactccccgcggtggcggccgctctagaactagtggatcccccgggctgcaggaattcgtctcacccctagaaaaaactgcaaccccggaacagagcgaggcgacgccgaggcacctcatctccggcgaagggaaatggcgaccgttccaggggatctgatctggcagattgtgaggaagaacaactccttcctggtgaagcagtttggcaacggcaatgccaaggtgcagttcaccaaggagcccaacaacctctacaatttacactcctacaagtactctggcttagcaaacaagaaaactgtaacgatccagccagctgctggaaaggactcggctgtggtcctctctactaccaagaccaagaagcagaacacacccgcggagctcacccacaagtctgtgatgcgcaaggagttccgcaagatggccaaggcttgtgaaaaaccagggtgggcaaccactattaccgggcctgaatctggccaaagtctggccccttggtagggttgaagctctggtgtaccggcagccctccagggttgcccagctcttggttgttcaagaaaaaaaaaacaggccattccttaagccacttaagcccttgttattttccgtctctttgggtgccccaactagtccccccaaccctctcattatttcaattccaacccccgccccccaaacc

SEQ ID NO: 59767 - protein, 123 aa, Zea mays
  misc_feature: Ceres CLONE 1517068
  misc_feature (5)..(121): Pfam Name: Ribosomal_L28e Pfam Description: Ribosomal L28e protein family
MATVPGDLIWQIVRKNNSFLVKQFGNGNAKVQFTKEPNNLYNLHSYKYSGLANKKTVTIQPAAGKDSAVVLSTTKTKKQNTPAELTHKSVMRKEFRKMAKACEKPGWATTITGPESGQSLAPW

SEQ ID NO: 59768 - DNA, 868 bp, Zea mays
  misc_feature: Ceres CLONE 1517074
  misc_feature: Encodes the peptide sequence at SEQ ID NO. 59769
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (40)..(40): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (50)..(50): n is a, c, t, g, unknown, or other
  misc_feature (54)..(54): n is a, c, t, g, unknown, or other
  misc_feature (443)..(443): n is a, c, t, g, unknown, or other
  misc_feature (444)..(444): n is a, c, t, g, unknown, or other
  misc_feature (445)..(445): n is a, c, t, g, unknown, or other
  misc_feature (446)..(446): n is a, c, t, g, unknown, or other
  misc_feature (457)..(457): n is a, c, t, g, unknown, or other
  misc_feature (460)..(460): n is a, c, t, g, unknown, or other
  misc_feature (600)..(600): n is a, c, t, g, unknown, or other
  misc_feature (717)..(717): n is a, c, t, g, unknown, or other
  misc_feature (719)..(719): n is a, c, t, g, unknown, or other
  misc_feature (764)..(764): n is a, c, t, g, unknown, or other
attttttnnnnnnnnnnnnnnccaatccacccaacgcccncnnnnnnncncagnaaccaaagctggagctccccgcggtggcggccgctctagaactagtggatcccccgggctgcaggaattcgtctcacccctagaaaaacccagccccactctctccatctagagctccctaactgcaccggccgccacaccaccgtaccccgacccctcgacaacaatggccaccgtcctaggcagcccccgcgcgccggccttcttctttctcgaccgatcactcaccctcccggtgcccgcggccggcgccccaccgccgtgggcgcttgccttgcgggccaaaggggggggggataattatgtttgggccctagtgccccccccccacaacaaggggggggtgggtctttttgaaaaaaaaacaggcaacaaaaaaaaaaaaaaannnncacccaccgcncgncccgcctgcttcataaaacaacatttggattagtttttgaaaccaatgattaatattaccttgttctctcttgctacaaaggacgaccaaccacgaagcagaacagatcgaaagacatatacctcatcctacttagtaanatcaaagttttgtgacgagtatcctaaatagtgaagctgacaacgacagcatcgaagaaggttgagactacgctggaggtgtgctgtagactgagggcagattaagatacaattttntntacttccaatcggatggggtcgacccccgaggggacccactcctnactcatcactccactgccgagagacccgcagccggggggggtaaagaggagcagcacagacacccccagccacctccagcctctcccgcccgcaaggagccgcg

SEQ ID NO: 59769 - protein, 90 aa, Zea mays
  misc_feature: Ceres CLONE 1517074
  misc_feature (75)..(75): Xaa is any aa, unknown, or other
  misc_feature (76)..(76): Xaa is any aa, unknown, or other
MATVLGSPRAPAFFFLDRSLTLPVPAAGAPPPWALALRAKGGGDNYVWALVPPPHNKGGVGLFEKKTGNKKKKKXXPTARPACFIKQHLD

SEQ ID NO: 59770 - DNA, 694 bp, Zea mays
  misc_feature: Ceres CLONE 1517089
  misc_feature: Encodes the peptide sequence at SEQ ID NO. 59771
  misc_feature (395)..(395): n is a, c, t, g, unknown, or other
aaaagctggagctccccgcggtggcggccgctctagaactagtggatcccccgggctgcaggaattcgtctcacccctagaaaaaattattgccgcgactacggcctacttcttcacattcaccgagcaatgcatgcagttattgatagacagaaaaatcatggtatgcatttccgtgtattagctaaagcattgcgtatgtcggggggagatcatatccactccgagaccgtattacgtaagttataaggggaacgcgaataactttaggatttgttgatttattgcgcgacgaggttatggaaaaagatcgttctcgcgctatctttttcactcaggactggctatccatgccaggtgttatcccccccggcttgtgggggtagtcatgtctnccctatgccagctctgaccgaaatctttgagatgattccgtattccacttggggggaggaactttgggacaccctttggcgaaattgccctggggccgcacctaatcccggggtgttttagaatcctgtttacccaacctcggaacaaaaggcccccattcttggttcgggaaggctaatgaaatttatccgacttcccccttgccaaatgggaggttctcaaaccaaaccggcaggctggtggcaaatatcggaacgggaaactccaccttttgcagcggtgtcccaaaaccggaggg

SEQ ID NO: 59771 - protein, 39 aa, Zea mays
  misc_feature: Ceres CLONE 1517089
  misc_feature: SWISSPROT Homolog: EC 4.1.1.39 Ribulose-bisphosphate carboxylase
MHAVIDRQKNHGMHFRVLAKALRMSGGDHIHSETVLRKL

SEQ ID NO: 59772 - DNA, 819 bp, Zea mays
  misc_feature: Ceres CLONE 1517095-R
  misc_feature: SWISSPROT Homolog: EC 5.2.1.8 Peptidylprolyl isomerase
ccaaattgctgtactcaagcgtctcgtttttttttttttttttcaggcgccgcacatggaactccattgactctacgatcaaggttacagaatgttacagttgtactcgatttttaactcagtaacaccaatccgcggtaagtttcatgaggggataccggaattttttctttacttgagaagaatttccaacgtttcccttgctgacctatgccaattactgggcactgaggacttcagtctcaaacacaaccactgagtttggttgaattccccaggctgggaacccgccggctccattagcacaatcactgctggaccgggtactagttacttcaaccacttggctggtcatatctcccttgttaaatcccttaatcactgactcctgtactatggggaaagcgaatggctgctgcccaaggtgcttggcgctgcaaaacttcttggacctatgacaattctccctttagaccctgcactgacaggtgacgtgcgggacccttttccggatgggggctgccccatatctcacgatcagcgtctaaaaacctatgcttctcctgacttcgtcactgtaatgtgctcctggaacttacatcggtttctttgagggcggcggaatcattttcttgccagttttttttttatgcgttgaaaccgaattttctttcacggcgagggggattcccttgggtttctcaaaaccgggcaggccaccctggttttggagggccacaaagccgttgttctctccccctttaagttggaaggggggttttttttggcgcccccctttgggctaaaatattctaggaa

SEQ ID NO: 59773 - DNA, 672 bp, Zea mays
  misc_feature: Ceres CLONE 1517111
  misc_feature: Encodes the peptide sequence at SEQ ID NO. 59774
ggagctccccgcggtggcggccgctctagaactagtggatcccccgggctgcaggaattcgtctcacccctagaaaaaaccgtccccgtctcaccgcactgccttgccccctactctgcctcgcttagcttagccgccgctgctacgcactctcgccgtccttgttcccgcgtcgctctgctcgcgatggcgtcccgcgttgcagtgctgctcgtggccgtggcggccgtgctgttcgccgcggcgtcggcgcaggagatggacctgggcgtgccgcccgcgccggcgcccgacacgggcgcggcagcgggggccgcggcgtcggtcctggccgtggcttgctctgccgtcttcttcatcctcgtcgccggtggcctcgtgcagtaggcgctgccgtcgacgtggtggctagctgctggtttcgggtccggcggagccctgttcgatcgttttcgccctagtttatagtaaaagtagcagtcatgggctgtgttgattgtgtccctgtccccccccgggggggcttggtgatctggggctattgcttattctttttggaccaaactgcattggtccaacgtataccttgggttgaaggcgggtgtttgtattaataaaaaacgaagggatcctccgttcgccaaaaaaaaaaaaaaaaaaaacaagacccct

SEQ ID NO: 59774 - protein, 66 aa, Zea mays; identical to SEQ ID NO: 45446
  misc_feature: Ceres CLONE 1517111

SEQ ID NO: 59775 - DNA, 672 bp, Zea mays
  misc_feature: Ceres CLONE 1517127
  misc_feature: Encodes the peptide sequence at SEQ ID NO. 59776
aaagctggagctccccgcggtggcggccgctctagaactagtggatcccccgggctgcaggaattcgtctcacccctagaaaaagtgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccgcaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcagctacggcggtggcgggcgccgtgatggcggcggcggctacagcggtggccggcggcggctacggtggccgcggcggcttaacggtggtgggtggcggcggcctacggcgggtggcaaacggtggcgggcggcttacggcaactcccgaacggaaactgggaggaacctgagcccg

SEQ ID NO: 59776 - protein, 163 aa, Zea mays
  misc_feature: Ceres CLONE 1517127
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAASDVEYRCFVGGLAWATDDHSLRNAFSTYGEVLESKIILDRETQRSRGFGFVTFSTEEAMRNAIEGMNGKELDGRNITVNEAQSRGGRGGGGGGYGGGRGGGSYGGGGRRDGGGGYSGGRRRLRWPRRLNGGGWRRPTAGGKRWRAAYGNSRTETGRNLSP

SEQ ID NO: 59777 - DNA, 580 bp, Zea mays
  misc_feature: Ceres CLONE 1517129
  misc_feature (57)..(57): n is a, c, t, g, unknown, or other
tccccgcggtggcggccgctctagaactagtggatcccccgggctgcaggaattcgntctcacccctagaaaaatccgtggcttttctccagaagggtggggttggcttctcctcccccacggttcgtgtcaggttctgttcgtgggcgagagggaaagatggcggcgttcggacgttggaataaccgtttgcttcctttggcgggccctcccccttggggccccccgaaacgaaccactttcccttttaaaaaacgcccctttctggcacccttttgaggggggagggggccccccccgcgggttccgaaaaaaacctcccccgggaatccgggggaaacaccaaaaaaggccccccggggttttcggggtttttttaaaacttttttttccccggggggaaaaaccccttttttttcctaatccccccctttttggggggggtttttaaaagggggggagggggggttttttttatggggggcccaaaaaaaaaaataaccccctttttataaaaaaaagaggggggaggaccttttttccccgccgccccgaccccccccctttataataaagaggg

SEQ ID NO: 59778 - DNA, 730 bp, Zea mays
  misc_feature: Ceres CLONE 1517165
  misc_feature: Encodes the peptide sequence at SEQ ID NO. 59779
  misc_feature (730)..(730): n is a, c, t, g, unknown, or other
aaactggagctccccgcggtggcggccgctctagaactagtggatcccccgggctgcaggaattcgtctcacccctagaaaaaaaaaccaatcagatagagagagcatagtcgatcatgaagggtggcaagaaggaagtggccggtgcgatggtggccatactgctggttctgcagctcatggcagctccaccgacggccatggccgcccgctcgccgcacggagccgtgccggatggctccctcgccacgacgcccaaggtgacgatgctgtcggccacgctgtgctacacgggggagacatgcaaatacattggctgcctcactcctgcttgctcctgcaactatagtgatcgtctatgctcccccctatttagtgggggggggggggaggcccttcccgcaaaagcccaaccccctaccaatatggatggcgccgggccgaacgaccaacccgcgcctgccttcctccctgacctttctggtatcaaggtgatgcattgttttcaaggggatccccttggaaatgctctaccgttgtatggcgtctattaatataccccgccggccatggtaaccccgaaccgaaagggggggggtttgttcttcttatgttcccggcactccccggggctcccccctcacccgggggaatacctcttcctcgagacgtcgcacctacaaaaatactacaacacactcatcccctgcctatacccccccttcccacn

SEQ ID NO: 59779 - protein, 145 aa, Zea mays
  misc_feature: Ceres CLONE 1517165
MKGGKKEVAGAMVAILLVLQLMAAPPTAMAARSPHGAVPDGSLATTPKVTMLSATLCYTGETCKYIGCLTPACSCNYSDRLCSPLFSGGGGEALPAKAQPPTNMDGAGPNDQPAPAFLPDLSGIKVMHCFQGDPLGNALPLYGVY

SEQ ID NO: 59780 - DNA, 603 bp, Zea mays
  misc_feature: Ceres CLONE 1517174
gctctagaactagtggatcccccgggctgcaggaattcgtctcacccctagaaaaacgttccttccgtccatccatccgccatggcgaccgccacgctactgagctcctccttcgccatgcccgccgccgcccgtagggcctcctccccttcctccgcctcattgagcttcgccaagtcgcagctcgccggcctctccctctccgcggcgtgcactccaccgccgcccctcctcccaagaggagcagctccagcccattgtcgcgcggcgtgtgtgcccgtttcccggacaagaaaaacaaccgggcgaacaagtggccttttccacccacaaaacaaaaaagcggcgggttcttgaaccttcatgaaaaaaaagccgtggtgggaaaggccggaaaaacctttatacaaagggcgcctttcccacccaggggcctctaaaaccctcccgaaaaaaaccggcttctcaatccctttactccgaaaaggggccgggtctttcaccccctaaataaaaaagtgagagccccccccccaaaaagagaaaaacaaaacctaggtgggggggggggggcctatactcttatgctatttgtgattttcg

SEQ ID NO: 59781 - DNA, 649 bp, Zea mays
  misc_feature: Ceres CLONE 1517178
  misc_feature: Encodes the peptide sequence at SEQ ID NO. 59782
  misc_feature (546)..(546): n is a, c, t, g, unknown, or other
aagctggagctccccgcggtggcggccgctctagaactagtggatcccccgggctgcaggaattcgtctcacccctagaaaaagcgcacctccctttccccaactcgatctcgcacctagggtttcgtctcgccgctctcgtcctccgcgaagatgccgaagaacaagggtaagggaggcaagaaccggaagcgaggaaagaacgaggctgacgacgacaagcgcgagctcgtcttcaaggaagacgggcaggagtacgcgcaggtgactcggatgctcggcaacgggcggtgcgaggccatctgcgtcgatggcacgcgccgcctctgccatatccggggtaagatgcacaagaaagtctggatcgcggctggggacatcgtcctcgtcggcctccgcgactaccaggacgacaaggccgacgttatcctcaagtacatgaacgacgaggcgcgcctgctcaaggcctacggggagcttcctgacacgctcaagctcaacgagggcgtcgacgtcgatgggccccaagaagggaggagggcaccnactacatccagttcgaagacgaggacttcgaccagatctaagaaatctggttcctgcttacggctacctgtattgttacgtgacgctttcttctgcttcttgt

SEQ ID NO: 59782 - protein, 165 aa, Zea mays
  misc_feature: Ceres CLONE 1517178
  misc_feature (30)..(94): Pfam Name: eIF-1a Pfam Description: Translation initiation factor 1A / IF-1
MPKNKGKGGKNRKRGKNEADDDKRELVFKEDGQEYAQVTRMLGNGRCEAICVDGTRRLCHIRGKMHKKVWIAAGDIVLVGLRDYQDDKADVILKYMNDEARLLKAYGELPDTLKLNEGVDVDGPQEGRRAPTTSSSKTRTSTRSKKSGSCLRLPVLLRDAFFCFL

SEQ ID NO: 59783 - DNA, 659 bp, Zea mays
  misc_feature: Ceres CLONE 1517197
  misc_feature: Translation starting site: 192
  misc_feature (595)..(595): n is a, c, t, g, unknown, or other
ggagctccccgcggtggcggccgctctagaactagtggatcccccgggctgcaggaattcgtctcacccctagaaaaacggcttcgccgtgttcatggtccacctgtccaccatccccgtcaccggcaccagaatcaacccgaccaggagcctgggcgccgccttcctctacaacaaggacaagccatgggatgaccactggattttactggatgggcccgctcctgggcgctgccatcacgcccttctaccaccaatacatcctccgggagggcgccatcaaggctctcggctccttcaagatcaacgcgtgatgtacagagataaagaaaggccttcactgaactgcgtgatagagcaaccgccatcgatctatctaacgtggagagaggcggatacacgaccgctccagggatgagaataagtttgtgcctctggcccggtctcctaagtctcttttgttccagaatgcagctgcgacgcctcctctccttgctgtggtggactccttaatttccccggcccctgtaatcatcaatcaccatgcgtgcacataatatctgctgccaaggaatctttcttgagttgtgtttcnaatgtaatccaatcttatcgttcgagtaattgaatgattcctgcgcgacgttctaggtaccaaa

SEQ ID NO: 59784 - DNA, 603 bp, Zea mays
  misc_feature: Ceres CLONE 1517210
  misc_feature: Encodes the peptide sequence at SEQ ID NO. 59785
  misc_feature (243)..(243): n is a, c, t, g, unknown, or other
  misc_feature (279)..(279): n is a, c, t, g, unknown, or other
ctccccgcggtggcggccgctctagaactagtggatcccccgggctgcaggaattcgtctcacccctagaaaaaaggaccatccgccgccgcagccatccgcttgttctcttcggttcagttctcgagtttccaggatgaaggtaatagctgcctatctgcttgctgttctgggtggaaacacttccccgactgctgatgatgttaagagcattctgggaaatcagttggtgctgaagctgantgaagaaaaactagagttcctgctcacagaactcanagacaaggacataacagaagtgattgcagctggaagggaaaggttatcctctgtgccttcaggtggtggtgcaattgacatgggacctccagcagctgtagctgggcggtggcccaccacctgctgaagaagcaaagaaggaaaataaggttgaagagaaagaagagcctgaatgaaaatatgggttttcagctttgttccaattaaaaccagccccacccggttttacagttttcttccccaaatgggtccccataaaaatttgggcccggtttcccccaaaaaaaaaaaaattgggccaaaaagcctaaccacccgtacctg

SEQ ID NO: 59785 - protein, 89 aa, Zea mays
  misc_feature: Ceres CLONE 1517210
  misc_feature (36)..(36): Xaa is any aa, unknown, or other
  misc_feature (48)..(48): Xaa is any aa, unknown, or other
MKVIAAYLLAVLGGNTSPTADDVKSILGNQLVLKLXEEKLEFLLTELXDKDITEVIAAGRERLSSVPSGGGAIDMGPPAAVAGRWPTTC

SEQ ID NO: 59786 - DNA, 819 bp, Zea mays
  misc_feature: Ceres CLONE 1517529
  misc_feature: Encodes the peptide sequence at SEQ ID NO. 59787
  misc_feature (12)..(12): n is a, c, t, g, unknown, or other
  misc_feature (32)..(32): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (819)..(819): n is a, c, t, g, unknown, or other
gcctttgtcctnccacgcccgccccactttcntcnnnctttcctttcnnnnnntatgttnnnnnacaaactggagctccaccgcggtggcggccgctctagaactagtggatcccccgggctgcaggaattcgtctcacccctagaaaaagcaggctatcagtgtatttgttctaacagatcgcaacgctggtacaacgcagtgacctgccagaccgggccactatgagattgttgggaaagaccagatagcttgtgtatgaagaagctgatccgatgtagcctatcatgtgctacgccattgcccttaagggatttggcttttaaatgtagtagacccctcccccgccgctctttgcctcccaagcgagtggtgtgtgcggtggccggttcgagggtccacctgtgcaaactccgtctcaaatgccggtaattggtgatcataccaaacgagggcacaaggggggtaagaagggggggggggaaaaaaagggggggaggcgggtggtgacactcccgcccaagggtgaagtggcggccaaaaaatggggtgcgggggccggacactaatatgcggcagcggtctggccggagaaaaacatggggggggggcacccgaaaaaatcaaaaggggcggggggtgggcataagcacgggagatctgggcggcacacggggggggggaaataaggggggtgtgcaacaaaatggtggcgaggggcgcaatcatagtaacacaacaactggtggggtgattccggtgcgggggggacattggcgggggggtggtgaccagatctgtaaaatggggggtggcgan

SEQ ID NO: 59787 - protein, 57 aa, Zea mays
  misc_feature: Ceres CLONE 1517529
  misc_feature (2)..(2): Xaa is any aa, unknown, or other
  misc_feature (3)..(3): Xaa is any aa, unknown, or other
  misc_feature (4)..(4): Xaa is any aa, unknown, or other
MXXXKLELHRGGGRSRTSGSPGLQEFVSPLEKAGYQCICSNRSQRWYNAVTCQTGPL

SEQ ID NO: 59788 - DNA, 644 bp, Zea mays
  misc_feature: Ceres CLONE 1517534
  misc_feature: Encodes the peptide sequence at SEQ ID NO. 59789
aaagctggagctccccgcggtggcggccgctctagaactagtggatcccccgggctgcaggaattcgtctcacccctagaaaaactttgggtcttcttgctcaacgagatctagcaacggatttgatcgatcttctcaagatcgttgtgtggtgcaacttgcattgaccctgtattttagattgttttatatggactaggcgcacggttttccaatgcttttgtctagaatcaagtccaatgatttggtttaaattactaaatgctcttcaagatgtgtaggcggttaaggcttcttgcgtaattgaacaagaggattgctagcgtctaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttccaacagttgcgcagcctgaatggcgaatggaaattgtaagcgttaatattttgttaaaattcgcggtaaattttttgtaaatcagctcattttttttaccaataggcgaaatcggcaaa

SEQ ID NO: 59789 - protein, 37 aa, Zea mays
  misc_feature: Ceres CLONE 1517534
KAGAPRGGGRSRTSGSPGLQEFVSPLEKLWVFLLNEI

SEQ ID NO: 59790 - DNA, 806 bp, Zea mays
  misc_feature: Ceres CLONE 1517547
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (40)..(40): n is a, c, t, g, unknown, or other
  misc_feature (42)..(42): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
ccccgcaccacacgtgaggtggtgctccctctcccnnncngnccgnnngggccttnnnnnnntaaaaactgggactccccgcggtggcggccgctctagaactagtggatcccccgggctgcaggaattcgtctcacccctagaaaaacctgggacatctgacaggaaagtgacgattactggaacacccgaagctatccggaaccgcggagtccatgatcatgcagagggtgtcggccctttcatagaggtgtggagtcctctcccgaaggaagggcgtctgctactgctgtcttttagcatagcgccgcgttcgaagtattgttaggagggcttgtttagctcgtgttattataccactagcaaccacccgcaccaccccccccgagaaaggaacgaattttaagagcagcccccgcctcacgcggcggctttctcttctcccccgtccatggggggggtggggggcttcattttactttttaacctggctgcacccccccccggggtgttggtgcgtctctcaagaatgggctcacacaccggacgcatgtgcataattcacgcgtgctgtattctttaacgccgcgcgtccttcacgctaacccccaccccttcctcccacaggcaacggattgaaagcgacggttgatcttcccgggctaggtgcttccagcaggggcttcctcactcccccaggcggcctaaaacccgtgctccgttcaactattaatataccccgaattcccgcggggccaatgtgggtgcccgtgtattcagtccttgccccgttccgcggggactcg

SEQ ID NO: 59791 - DNA, 678 bp, Zea mays
  misc_feature: Ceres CLONE 1517554
  misc_feature: Encodes the peptide sequence at SEQ ID NO. 59792
  misc_feature (678)..(678): n is a, c, t, g, unknown, or other
tcaccgcggtggcggccgctctagaactagtggatcccccgggctgcaggaattcgtctcacccctagaaaaagtatccgaattctacatccaggaccttcctttacaggccagctatgttgactgtgatgggagttgctgtgatctgtgtctgcgtgggaatactcctccatacctttgccagggtttatgccgtgcccacattcatatgggagttgctggagcgtggacccatgtcagttttacgatgagccttagctgttgtttggaaatttgtaaccagacagtaccacgcgatgcgcctaagatcaaaggaacatgattacccgtggtaaggaagttcatttgtggttaaaccccaaaaatccgattcgctgctcgtaaacatcatcccacatcatcccttttcttgttacacaacaaaacagatcactagtacggctcagtggaacccccatttatccctataatcaaagtccgaatttaccccacccctactttgccactaccctctctccactcccacacttgcacctcgatacaacccctttgtttcttccctccccttaattttccctgtcacctgactcccccccctatcttccctgctttgattgtcactctctcttcataaacatcaacacccctgatacaaacaccctttccacaatatgttgn

SEQ ID NO: 59792 - protein, 44 aa, Zea mays
  misc_feature: Ceres CLONE 1517554
MLTVMGVAVICVCVGILLHTFARVYAVPTFIWELLERGPMSVLR

SEQ ID NO: 59793 - DNA, 829 bp, Zea mays
  misc_feature: Ceres CLONE 1517555
  misc_feature (791)..(791): n is a, c, t, g, unknown, or other
ttgtttgcgtggagctatgtataccccccctacttgctgaataaccgtactctcaaaaaactggagctccccgcggtggcggccgctctagactagtggatcccccgggctgcaggaattcgtctcacccctagaaaaactgttccccacccatatcgtgaacccgccgccgactcagcagcaggagacgcgccaaggagagcccgcaaggaggcgactatgagggccaagtggaagaagaagcgcatgaggaggctgaagaggaagcgccgaaagatgaggcagagatccaagtaggctgatggggattgtggatggtggtgacgacatggttgtgttacgattcttcgatgcgtgtgagttcatggagagatgtcacatcctaagttcgtcgtcaccgttttgccatgtcgccaaatagcttcgtcttggaaaaccttgcacttcagtaaggcccatcccaaccgcggttttttacgctaaattccccgagttttttgtgtttacgacaaaatccagtcagcccgcttttgttggaccccttcctattgacggggaggctccccttttggcctggcttacacaaaaacaaaaaaaaaaccataaacagctctcgaaggttacccccacattccgcccctctataatggaggtctggaaattaaccccgccgcctctcaccggggcaccgcctttactcttaacaaacattcccgggtgacatgggggcaaaataaccctgtggccgttatacccccaaacgcttcaaaatccggcctttatgccagcanaaaattataccccctttttccgcccataatcgtgggcg

SEQ ID NO: 59794 - DNA, 690 bp, Zea mays
  misc_feature: Ceres CLONE 1517562
  misc_feature: Encodes the peptide sequence at SEQ ID NO. 59795
cggagctggagctcaccgcggtggcggccgctctagactagtggatcccccgggctgcaggaattcccctaacccctggaaaaaaccaggttgaccagaagaagcagacctcgtggcgcacgctcatggaaggagccatctctacttccccaggcgcaaggatcgccgtggtcaccggcgggaacaaaggtattgggctagaggtgtgccggcagctggccgggaacggcatcaccgtcgtcttaacagccagggacgagacgaggggcgcagctgccttggaggagctcagagcgctgggtctttccgacgtcgttttccatctgctggacatcacggacgcgtcgagcatcgctaggctagccggtttcttgaaggcccgtttcgggaggctagacattctgataaataatgccgcgtttggcggcgtcaaataccgccccggggtcctgctgctgctgccgggtcagtgacaagtgaaaaaaaaaaaaaaaaacgagacgcttcaaggaccccaatttccccctatagtggagtcggattaccgcccggctcacttggcccttcgtttttaaaacccgcgttaacctgggaaaaacccttgcccttacccccaactttaaatcccccttgggaaccaccatcccccccctttttccccccccttggggcatacccaccccgaaacaa

SEQ ID NO: 59795 - protein, 115 aa, Zea mays
  misc_feature: Ceres CLONE 1517562
  misc_feature (12)..(112): Pfam Name: adh_short Pfam Description: short chain dehydrogenase
  misc_feature: SWISSPROT Homolog: EC 1.1.1.184 Carbonyl reductase (NADPH)
MEGAISTSPGARIAVVTGGNKGIGLEVCRQLAGNGITVVLTARDETRGAAALEELRALGLSDVVFHLLDITDASSIARLAGFLKARFGRLDILINNAAFGGVKYRPGVLLLLPGQ

SEQ ID NO: 59796 - DNA, 833 bp, Zea mays
  misc_feature: Ceres CLONE 1517563
  misc_feature (52)..(52): n is a, c, t, g, unknown, or other
  misc_feature (53)..(53): n is a, c, t, g, unknown, or other
gaaagaggaaaaaataaaaaaaacgtaaattatgggggaaaaaaagggaaannggacatggtgaaggtccgcgcgaagggggccggtctatactggtggatcccccgggctgcaggaattcgtctcacccctagaaaattttctctctctactgatatagtatatatgtggtgtgtctatatatgtgtgcacgtggttttcgctcggctttttatcaacgattggaaaataaaagctttctcttaatctgtattttttattttgaatgaaaaaaataaaccactatatttttctggatgaaaaaaaaaaaaaaaggcgagacgctccgagggtacccgatttcgcccttataaataaaaaccgaataacaaaaaattaaatgaaacgtgtgttttacaaacgtcggtgaataggagaaaaagcctgggggttttccccaacccccaacaggggggggtggcgggtggattgggcccttttttggacaaagaaagggggtcccccacccccaaagaagggacccgcgtgccgtattttgccgccttttccccaaaaagatttggtgcacacccctgtgacgtggcgaaaaatggggtaatttttaaaggggcgcggggggagtgtatttgatgaaagaggggacacacgtggcggaatttgggggaaataaataagcgggacaacatgtgtgtttttgtaaatataggaagggggggataattcgggcgaaaagggcactcttgtttatagtgcgggggggaaaaatataacctcaaatataacagctcggacgatgggtgtgtttcccatcgttcttataaaaacaaaggggg

SEQ ID NO: 59797 - DNA, 672 bp, Zea mays
  misc_feature: Ceres CLONE 1517570
  misc_feature: SWISSPROT Homolog: EC 3.2.1.23 Beta-galactosidase
ccatgctggagctcaccgcggtggcggccgctctagaactagtggatcccccgggctgcaggaattcctctcacccctagaaaaatgtggatgctacgaaagtttctcaacagctcatctagagtaccgtaatccgtagtacggcaaatgttaacacgcacgaactggaatcatgaccaagggatattaccttctgttcatgctgaaacgatcagcagtttctttctttgcatcatatgccacgtcaaatcaaggcacttgcctctgaaatctttgtggtcaagtcaaaccagcacttcgacagaacgattgatggatgcatgtattactgttacataaatgtccatttgctcaacttcatttcttatatgagatgcctacttgcctaggactcgtctgatgaaaaaaaaaaaaaaaaacgagacgctcgaggtacccaattcgccctatagtgagtcgtattacgcgcgctcactggccgtcgttttacaacgtcgagactgggaaacccctggcgttacccaacttaatcgccttgcagcacatcccccctttcccccagctggggtaaatagccaaacaggcccgccaccggatccccccttcccaaaaagtgtccccaaacccgaaatggccaaaggggaaaattgccaaccgttaaaaaatctttgt

SEQ ID NO: 59798 - DNA, 662 bp, Zea mays
  misc_feature: Ceres CLONE 1517584
  misc_feature: Encodes the peptide sequence at SEQ ID NO. 59799
  misc_feature (592)..(592): n is a, c, t, g, unknown, or other
aaagctggagctccccgcggtggcggccgctctagaactagtggatcccccgggctgcaggaattcgtctcacccctagaaaaaataccgaccttgcattttctcaataccttgagcacctaagcaagtccaatgtctcatgcccagccccttcgtttacaggcccagtggaaacacgtcgatattcaggataaccaagccaatgctatgaaggaaccaggaaccagtggtgggtatggctccccaatgaaagatgacaagaacaaggatgtggatacaatagcttcgaacttcatcaagcttaagcacagggcttgggcactccagaagagcacaaccatgtaccaaccttccacttaaaggtgttgctagttcaataagtcaatactatatacttatgcttgcctctatatagtctataagtcctagttcaaataaacagatgctgcttgcacccttggatatttgtggagtgaacacattgttgatagcatatggattaaaaaagtaatgtaattatcctggagatgtggtaattatgtggccaatattattttgccaccaatgattgcattgaagtacttttcatgtnttgacaaaaaaaaaaaaaaaaaaacccaggacgcctccgaggtaccccaaatttcgcccataaataggga

SEQ ID NO: 59799 - protein, 75 aa, Zea mays; identical to SEQ ID NO: 55919
  misc_feature: Ceres CLONE 1517584

SEQ ID NO: 59800 - DNA, 698 bp, Zea mays
  misc_feature: Ceres CLONE 1517590
tggcggccgctctagaactagtggatcccccgggctgcaggaattcctctcacccctagaaaaaaggtcccgaaggcccgaaccttaggatcgccggcgaaccaccggagctgagccccacaaacattactgtaccacacggtttggtggtgtggcgacttggcgaccaagcgcacaagaacaaaacaagagggcgagaaacccacggagaacggtggaacacacggaagaacccgatgatgatctggccttccccctcctccactatgttgcccagtcctcacagcccctgtttccccgccatcttttcccacgacaaaccacaatcctgtttagattttattttttttcccccccccaaaagagggaggaggggctgtccccccgtctccctcctccccgtaaatttttctcccaaacaccttaaaccacttctcccctcacaccccccccccgctcttccccttatactcctataatccccaactcatctccctgtcctccgctccccccattttcccccccccccccatctcccccccccccccccacccttgcccccaccttcccccccccttttccccccccctatatttccccccttctcccctcctctcctctatattccccccctctttcctccctcttctcttgactcccccgcccccaagtacccccatcctctcccccaccccccc

SEQ ID NO: 59801 - DNA, 663 bp, Zea mays
  misc_feature: Ceres CLONE 1517595
  misc_feature: Encodes the peptide sequence at SEQ ID NO. 59802
  misc_feature (548)..(548): n is a, c, t, g, unknown, or other
catagctggagctcaccgcggtggcggccgctctagaactagtggatcccccgggctgcaggaattcctctcacccctagaaaaaacctgcccggtttccctctcccccctcactcaacgccgcgtaggcagcaggagccgccaagttcgcccgtccgcgcacctgtccgagataatggtccgtttgcggagtccgaggaagttgcaggcgaagaccctaagcagcagctggttggtgaaggttgtccgcattgcaaccactgctcaggataagatgaagtcgtggtggaggatttttaggagttccaagattatgacaagttctaggcgtgggttagcggcaaaccccagtcggctgcctgtgaaggccgtgtattgctacgtggtgttttcccactttgatctatgttaatgactaagtggatgtctcgggcatcatgatgtaatcaaattaatactcttttatgttattatttgaccactgtgtgatgatgtccccaaaaaaaaaaaaaaaacgagacgctcgagggtacccaattccccctatnagtgagttcgtattacgcgccgtctcctgggctgtcgtttttaaaacgttcttgatggggaaaaccccgggccgttacccactttaactccccttggcacgacatcccccctttc

SEQ ID NO: 59802 - protein, 78 aa, Zea mays
  misc_feature: Ceres CLONE 1517595
MVRLRSPRKLQAKTLSSSWLVKVVRIATTAQDKMKSWWRIFRSSKIMTSSRRGLAANPSRLPVKAVYCYVVFSHFDLC

SEQ ID NO: 59803 - DNA, 665 bp, Zea mays
  misc_feature: Ceres CLONE 1517602
  misc_feature: Encodes the peptide sequence at SEQ ID NO. 59804
caaaactggagctccccgcggtggcggccgctctagaactagtggatcccccgggctgcaggaattcgtctcacccctagaaaaaccatacaagacacagagaactcaggagatgagaaaagcgagaaaactgttcttctaattgatagtgaactgtacaatcgctctgattttatcactgagtacaaggatgccaaattctttgtaataaagtcctacaccaagaacctgtaacccattgttgtagtctcagtttgctttcctcaaaaaaaaaaaaaaaaaaaaaaaaaaaaaaaaaaaaaaaaaaccgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaaaaggcccgcaccgatcgcccttcccaacagttgcgcagcctgaatggcgaatggaaattgtaagcgttaatattttgttaaaattcgcgttaaatttttgttaaatcagctcatttttttaaccaataggccgaaatcggcaaaatcccttataaatcaaaagaatagaccgagatagggttgagtgttgttccagtttg

SEQ ID NO: 59804 - protein, 46 aa, Zea mays
  misc_feature: Ceres CLONE 1517602
KTGAPRGGGRSRTSGSPGLQEFVSPLEKPYKTQRTQEMRKARKLFF

SEQ ID NO: 59805 - DNA, 653 bp, Zea mays
  misc_feature: Ceres CLONE 1517603
  misc_feature: SWISSPROT Homolog: EC 3.2.1.23 Beta-galactosidase
  misc_feature (225)..(225): n is a, c, t, g, unknown, or other
  misc_feature (239)..(239): n is a, c, t, g, unknown, or other
aaagctggagctccccgcggtggcggccgctctagaactagtggatcccccgggctgcaggaattcgtctcacccctagaaaaaagcatctcaagccaccatcgaccttcaagtctcgccgacgaccccgaggccttcgctgagctcaaggtgaaggagctcaagaacggccgcctcgccatgttctccatgttcggattcttcgtccaggccatcgtcaccggngaagggcccgctcngagaacctcgctgaccacattgccgaccccgtcaacaacaacgcttgggcctacgccaccaacttcgtccccggcaagtgagggaggcgccgccggtgacctttaggtgtccggatgcatgtgagcgcacgctggttttcggtttgtaccatgatgtaaactatttgtttcatcacaaggaatatttgtgtgcaaaaaaaaaaaaaaaaaacgagacgctcggagtacccaaatcgccctatagtgagtcgtattacgcgcgctcactggccgtcgttttacaacgtcgtgactgggaaaaccctggcggttccccaacttaatcccttgcaagcaatccccttttccgcggctggcgaaataccaaaaaggcccgcaccgaatcgccccttcccaaagttggccagcctggaa

SEQ ID NO: 59806 - DNA, 665 bp, Zea mays
  misc_feature: Ceres CLONE 1517664
  misc_feature: Encodes the peptide sequence at SEQ ID NO. 59807
aaagctggagctccccgcggtggcggccgctctagaactagtggatcccccgggctgcaggaattcgtctcacccctagaaaaaattattatccacaacactcatcgatctacacacatacatagtttcttctactacacgacgacaaacatggggaagcctgcgaagatcggagagtggggtggataccccggccatcgtcgggatctgagggctactccggaccggctgatcgaggtgaaggtcacggcggacaacagcagctgcatccgctccatctccttcatctacatcggagccgatggcaaaccgtacgaggaggggccatggggtttcggccatgctggcacggagtacaagattgatctgtgcacgttcgacgagagcttgactgagatctcccggaccacgggcccagcctacaacattgacaatctggtcaagtctctcaaattcgtcaccaacaaacgcgcttacggaccgtacggcagggacgagggcacccccgttccgtgtcaaggggatgaacaacggccacgtcgctggcttctttgggccctccggagattgccttgacgcaatcgggctcttccgggaacccctgctaatacctaaaacgatggatccggacctcctgcatgcatccatattccggcatccatgcg

SEQ ID NO: 59807 - protein, 141 aa, Zea mays
  misc_feature: Ceres CLONE 1517664
  misc_feature (15)..(129): Pfam Name: Jacalin Pfam Description: Jacalin-like lectin domain
MGKPAKIGEWGGYPGHRRDLRATPDRLIEVKVTADNSSCIRSISFIYIGADGKPYEEGPWGFGHAGTEYKIDLCTFDESLTEISRTTGPAYNIDNLVKSLKFVTNKRAYGPYGRDEGTPVPCQGDEQRPRRWLLWALRRLP

SEQ ID NO: 59808 - DNA, 672 bp, Zea mays
  misc_feature: Ceres CLONE 1517666
  misc_feature: Encodes the peptide sequence at SEQ ID NO. 59809
aaagctggagctccccgcggtggcggccgctctagaactagtggatcccccgggctgcaggaattcgtctcacccctagaaaaaatcctccaccacaccacacgcgccgcaaagcagagcacgggggcctgagagcagagcgccatcagccatcctttgcctgcccaagcagcaagcaacagcagcaacggcggctggcccgatggctctgtctctctccggcacctccgcccgcttcgccctcgcgtctctggtcccccgggccagggcctacacggcgacggcggcgtccggggccatgaggcgcgcggcggacggcgcggccgcgggcgatgccaatgaggccgggcgcgccgccgccgccgctgccgagggctcgtgggtgcccgaccccgtcacgagccactaccgccccacctactgggccgccaccgtcaaccccgccgacctccgcgccgctcacctcgtccgcacctacgcccgggcctgagcggccccgactcccttcaccctgctccgcctcgtctcgtatgacatacgcgcaccgtacgtaccatactgagacgacgtcagcggtcgaggttcgtgtggcgaacagcgtgttgagacacgtgcgcgtgcgtacgcatcctgtgacgccagtaacattcctgagagagcgcgagcgacgcc

SEQ ID NO: 59809 - protein, 95 aa, Zea mays
  misc_feature: Ceres CLONE 1517666
  misc_feature (1)..(89): Pfam Name: LEA_3 Pfam Description: Late embryogenesis abundant protein
MALSLSGTSARFALASLVPRARAYTATAASGAMRRAADGAAAGDANEAGRAAAAAAEGSWVPDPVTSHYRPTYWAATVNPADLRAAHLVRTYARA

SEQ ID NO: 59810 - DNA, 680 bp, Zea mays
  misc_feature: Ceres CLONE 1517667
  misc_feature: Encodes the peptide sequence at SEQ ID NO. 59811
  misc_feature (394)..(394): n is a, c, t, g, unknown, or other
acagctggagctccccgcggtggcggccgctctagaactagtggatcccccgggctgcaggaattcgtctcacccctagaaaaaacggaagtcatttctccctatctaaggccacctttcactccgccgttctctgtcacgaccgggaaaaacctcgccgccgccggcctcctctctcttgccttccatcccccgttgcgtcgaaccgtccctctcggtaaacccgcatcgccttgaacccttaacctccaggcggaggatccgccgaaaggctggaccagttacccccatcctgcacggcgcaggggagtagagagaggatgatggagtcggaggtggtgaggatggagatggtgctggctcctacgctcccgttcaggagggggggacggcnaacaagttcccaagggccacccccggggccgccagtgaaagcacctgcgccacctgcttcagccgctgatgcatcctccatgccccccgacccccccagagatctgaatattcaatcgccgccatccatttccccccccaaaagaatactgggctcttcacgggcttttcggcatcgctcctcggtatccccggaccgggtttgcgcttcccccgcgatccgcaggtgtttcggccgattccggaggccttcgcggagaaaaccggcccacggtcccctggcccat

SEQ ID NO: 59811 - protein, 120 aa, Zea mays
  misc_feature: Ceres CLONE 1517667
  misc_feature (25)..(25): Xaa is any aa, unknown, or other
MMESEVVRMEMVLAPTLPFRRGGRXTSSQGPPPGPPVKAPAPPASAADASSMPPDPPRDLNIQSPPSISPPKRILGSSRAFRHRSSVSPDRVCASPAIRRCFGRFRRPSRRKPAHGPLAH

SEQ ID NO: 59812 - DNA, 655 bp, Zea mays
  misc_feature: Ceres CLONE 1517668
  misc_feature: Encodes the peptide sequence at SEQ ID NO. 59813
  misc_feature (571)..(571): n is a, c, t, g, unknown, or other
atgctggagctccccgcggtggcggccgctctagaactagtggatcccccgggctgcaggaattcgtctcacccctagaaaaaacccccagatccaaatccagcgaagcgacagagatcaaggatggagctggaggtgggtgcgccttcgccggcgaggtacctggtgggggcagcgatcatgatggccggcgtggtgctcccgctggcgtacatgatcttccgcagcaagcgttcgccttcctccgcctccgccgcggggccctcctccttctccaagcagacgtaggaacaaagggctcatctgatctgagcgagtgggtgaatcgatcgccttcccctgatgcttgtcattctgtctgttttgccacgcgagaggggcggagtgcttctcgagactgggcatcatcccgtcaaatactagctgattagtagtcagttccttttgtaccttgtgtagatcaaatcgattgcttattttggctgatttgataccattataaacaatggggtttactttttgagtgcactaccttacaagcatcattcctaccggatttcagttttccttntgccgagaggtaagagatcaaaagaaaggaaaacataaaccttaaactcgaacccctccagggcacccctattcccccccaaaa

SEQ ID NO: 59813 - protein, 54 aa, Zea mays
  misc_feature: Ceres CLONE 1517668
MELEVGAPSPARYLVGAAIMMAGVVLPLAYMIFRSKRSPSSASAAGPSSFSKQT

SEQ ID NO: 59814 - DNA, 677 bp, Zea mays
  misc_feature: Ceres CLONE 1517671
  misc_feature: Encodes the peptide sequence at SEQ ID NO. 59815
aaagctggagctccccgcggtggcggccgctctagaactagtggatcccccgggctgcaggaattcgtctcacccctagaaaaattcctctcgctccgttgctcgcctcgggtcaaaccctaagcagggagttgatttatccgctgcagccatgagtaagttgcagtctgagtctgtcaaggatgccatctcccagattgttggggatgccaaggagaagaataggaagttcactgagactgtggaacttcagattggtctgaagaattatgatccacagaaggacaagcgtttcagtggctctgttaagttgccccatatccctcgtcccaagatgaaggtgtgcatgcttggtgatgcccagcatgttgaggaggccgagaagatgggacttgactacatggatgttgaggctctcaagaaaatgaacaagaacaagaagcttgttaagaggcttgccaagaagtaccatgctttcttggcatcagaggccatcatcaagcagattccccgtctccctggtcctggtctcaacaaggcaggcaagttccccgaccctgggttactccacccggaaatcccttcgcatcccaagggtgaaccaagactaaaggcaaaccggtcaagtttcccgcctccaagaagggttccttttggcttggggccgttcccccccc

SEQ ID NO: 59815 - protein, 175 aa, Zea mays
  misc_feature: Ceres CLONE 1517671
  misc_feature (9)..(173): Pfam Name: Ribosomal_L1 Pfam Description: Ribosomal protein L1p/L10e family
MSKLQSESVKDAISQIVGDAKEKNRKFTETVELQIGLKNYDPQKDKRFSGSVKLPHIPRPKMKVCMLGDAQHVEEAEKMGLDYMDVEALKKMNKNKKLVKRLAKKYHAFLASEAIIKQIPRLPGPGLNKAGKFPDPGLLHPEIPSHPKGEPRLKANRSSFPPPRRVPFGLGPFPP

SEQ ID NO: 59816 - DNA, 661 bp, Zea mays
  misc_feature: Ceres CLONE 1517673
  misc_feature: Encodes the peptide sequence at SEQ ID NO. 59817
aaagctggagctccccgcggtggcggccgctctagaactagtggatcccccgggctgcaggaattcgtctcacccctagaaaaagccggccacactcgtctctctcacgagccacagcccacagcaggctagctctctagcggtctagccagtccacgcagcgcagggatggcgtcgttcgccgtggcaacggccccgtcgctagcggccccggcagccaagaggaggcccgccgccggcgtcacgtacgtggagggcatgaacgcctacagcggcctcaaggggctcaacaaggtgaccatgctcggggtgcgcaagaccgccgactactccttcgccaaggtcgtggcgtcgctcagccccgcgggcaggaagcggcgcggcggggcgttcggcgcccagatgaacgccccccccgagatcttcaggatcgccgccaccatgagcggcctcgtgctcgtcggcgtcgccgtcggcttcgtgctgctccgggtggaggccgccctcgaggaggccgagtaggggcgctcgcgcctgcttcataagccgtgataaatatataaaaacctgaagtatggctttccgatccaatctttgggaaaggacctgtatcaaccattgaccaattgattaaaaaaaaaaaaaaaaaccgcaaaccccc

SEQ ID NO: 59817 - protein, 117 aa, Zea mays
  misc_feature: Ceres CLONE 1517673
  misc_feature (79)..(114): Pfam Name: PetM Pfam Description: PetM family of cytochrome b6f complex subunit 7
MASFAVATAPSLAAPAAKRRPAAGVTYVEGMNAYSGLKGLNKVTMLGVRKTADYSFAKVVASLSPAGRKRRGGAFGAQMNAPPEIFRIAATMSGLVLVGVAVGFVLLRVEAALEEAE

SEQ ID NO: 59818 - DNA, 682 bp, Zea mays
  misc_feature: Ceres CLONE 1517676
  misc_feature: Encodes the peptide sequence at SEQ ID NO. 59819
aagctggagctccccgcggtggcggccgctctagaactagtggatcccccgggctgcaggaattcgtctcacccctagaaaaaatctggcttacctcttcggagagggaaaacgccgcacacgcggattccattctgttcttgtagatcttcggttccctcctctcggcggagggtcaggtgccctctccatctgctgcggggggcttggatgtctgacctcgccgagtgtgcactgacatggaaagcggcacggttgcgcatgccaccatcacgggcctcagcgtggcgaacgacatcttcattggactgaccctggatctgatcaccggaggcatgtgctacatgtgccactgctgcgagcacaggaacactaggtcctgctctgacatgctttacaactgacctatccccgttcccctctaggactaaagagttcttcccagttatgatcaaacaactctctcgagagcatgaccaagcgattgcttgctgtgtacatgtgtcctggacataagttcatacatggtgggaacacccgatttctgcgaattctgccttctcttgtgatgcagatctgagcccgtgcatgtcaatagcaaacgatctggccttttctccagtacgactcagagacacgatgacgctcgaggatccccagtccgcctatcagggagtcgtat

SEQ ID NO: 59819 - protein, 54 aa, Zea mays
  misc_feature: Ceres CLONE 1517676
  misc_feature (2)..(54): Pfam Name: COX5C Pfam Description: Cytochrome c oxidase subunit Vc (COX5C)
  misc_feature: SWISSPROT Homolog: EC 1.9.3.1 Cytochrome-c oxidase
MESGTVAHATITGLSVANDIFIGLTLDLITGGMCYMCHCCEHRNTRSCSDMLYN

SEQ ID NO: 59820 - DNA, 646 bp, Zea mays
  misc_feature: Ceres CLONE 1517679
  misc_feature: Encodes the peptide sequence at SEQ ID NO. 59821
  misc_feature (378)..(378): n is a, c, t, g, unknown, or other
  misc_feature (390)..(390): n is a, c, t, g, unknown, or other
  misc_feature (391)..(391): n is a, c, t, g, unknown, or other
aaagctggagctccccgcggtggcggccgctctagaactagtggatcccccgggctgcaggaattcgtctcacccctagaaaaaaaaaaaggccacttacctgcagtcaccactcccaagccagtacccacagtcctacgagcagtcgcacgcaagtgtcaagagacaaaacggtcgacatggctcgcacgcaatctgccgtagcggtcgccgtggtggccgcggtgctgctgctggcagcggcggcgacgacctcggaggccgccatcacctgcgggcaggtgagctccgccatcgcgccctgcctctcctacgcccgcggcacggggtccggcccctccgcgtcctgctgtagcggcgtcaggaaccctcagagcngcgccagcaccnngccgccgacagggcgcgcccgccttgcaaactggcctcaagaaccgccgccagggggcgttcagcgggctctaaaccccgggaaacccccgcaagaattccccttcaaagggggggggttaaggattccccttaacccatttagaaccctccacccaattggtcccaggggggaaattaaaacctaaaccccccccggaaaaaacggccccccttaataaaataacaaaaacatttttcccccggtgccccccgc

SEQ ID NO: 59821 - protein, 132 aa, Zea mays
  misc_feature: Ceres CLONE 1517679
  misc_feature (67)..(67): Xaa is any aa, unknown, or other
  misc_feature (71)..(71): Xaa is any aa, unknown, or other
MARTQSAVAVAVVAAVLLLAAAATTSEAAITCGQVSSAIAPCLSYARGTGSGPSASCCSGVRNPQSXASTXPPTGRARLANWPQEPPPGGVQRALNPGKPPQEFPFKGGGLRIPLNPFRTLHPIGPRGEIKT

SEQ ID NO: 59822 - DNA, 689 bp, Zea mays
  misc_feature: Ceres CLONE 1517680
  misc_feature: Encodes the peptide sequence at SEQ ID NO. 59823
aagctggagctccccgcggtggcggccgctctagaactagtggatcccccgggctgcaggaattcgtctcacccctagaaaaactcgctccttcccgtgaaccacaaacctaacgcggagcggcgcgggccggccgccgggcgaggtgcgcgtagctgccgtcgattgtcgccggatccatccaccatgggcggtggcaacggccagaagtccaagatggcccgcgagcgcaacttggagaagaacaagggggccaaggggagccagctcgagaccaacaagaaggccatgagcatccagtgcaaagtgtgcatgcaaacattcatgtgtaccacgactgaagtgaagtgccgggagcacgccgaggccaagcatcccaagagaggacgtgtaccagtgcttcccccatctgaagaagtgaaagggctgaacttagcaacccgtgcctggtttggtcactacgattcgggccaagggggcgttccccttgtgtggagggggttccttccccggttatccttcccgtccagtcatggcgccctgtcctaagttaaaccctccttaaaaaaacccatgtgggtgtcccccttcccctgaaaattcctggttttgccggttaaaaccccggttgggtttccaaaccaaaaaattttcctgggccaaaaacaaattccgagcccgtgagagaa

SEQ ID NO: 59823 - protein, 120 aa, Zea mays
  misc_feature: Ceres CLONE 1517680
  misc_feature (4)..(73): Pfam Name: DUF1909 Pfam Description: Domain of unknown function (DUF1909)
MGGGNGQKSKMARERNLEKNKGAKGSQLETNKKAMSIQCKVCMQTFMCTTTEVKCREHAEAKHPKRGRVPVLPPSEEVKGLNLATRAWFGHYDSGQGGVPLVWRGFLPRLSFPSSHGALS

SEQ ID NO: 59824 - DNA, 659 bp, Zea mays
  misc_feature: Ceres CLONE 1517684
  misc_feature: Encodes the peptide sequence at SEQ ID NO. 59825
  misc_feature (659)..(659): n is a, c, t, g, unknown, or other
aaagctggagctccccgcggtggcggccgctctataactagtggatcccccgggctgcaggaattcgtctcacccctagaaaaagcggccacacagactccagtctcctctagccgtctcgcgcgcttcaccttccccaccccgccgccgccatcgcacgcccgcagccgcatccgctatgggtgcgtacaagtacgtctcggagctatggcggaggaagcagtccgatgtgatgcggttcgtgcagcgcgtgcgctgctgggagtacaggcagcagccggccatcgtccgcctcacaaggcccactcgccctgacaaggcgcgccgcctcggctacaaggccaagcagggttatgttgtttaccgtgtccgtgttaggcgtggtggcaggaagaggcctgtgcctaaaggtattgtctatggcaagccaaagcaccagggtatcacccagctcaagttccagaggaacaagaggtctgttgctgaggagagggctggacgaaagcttggtggactcagggttctcaactcctactgggtgaatgaggatagcacctacaagtactttgagatcattcttgttgatgtggcccacactaccatccgcaatgatccaaggatcaactggctatgcaatcctgtgcacaagcaccgggagn

SEQ ID NO: 59825 - protein, 160 aa, Zea mays
  misc_feature: Ceres CLONE 1517684
  misc_feature (2)..(160): Pfam Name: Ribosomal_L15e Pfam Description: Ribosomal L15
MGAYKYVSELWRRKQSDVMRFVQRVRCWEYRQQPAIVRLTRPTRPDKARRLGYKAKQGYVVYRVRVRRGGRKRPVPKGIVYGKPKHQGITQLKFQRNKRSVAEERAGRKLGGLRVLNSYWVNEDSTYKYFEIILVDVAHTTIRNDPRINWLCNPVHKHRE

SEQ ID NO: 59826 - DNA, 614 bp, Zea mays
  misc_feature: Ceres CLONE 1517686
  misc_feature: Encodes the peptide sequence at SEQ ID NO. 59827
  misc_feature (614)..(614): n is a, c, t, g, unknown, or other
aaagctggagctccccgcggtggcggccgctctagaactagtggatcccccgggctgcaggaattcgtctcacccctagaaaaagtttgtggcgtgcggaaggagtcggagggaaccgaaaactcagggtctcgaatttcctaggagcggaggcgatggctgggaagggaggaaaaggattgctcgccgcgaagacgacggcggccaagtcggcggagaaggacaaggggaagaaggcccccatctcacggtcctcccgcgcgggcctccagtttcctgttggacgaatccaccgtcagctgaagcaaaggactcaggcaaatggccgcgttggtgccactgcagccgtctactctgccgccctcctggagacttgactgccgggttctggagctggctgggacgcctgcaagatctgaggtgaagcgtatcacccccccccccctacgttgggccttctccggagacaagaacttgacccccttcttagggggccccattcccaggtgggagggtgttcaaccccccccattcccacaaggtcccccggttccaaacaaagttcccctccccgggtgtgttgggaacaccttttgggggataatggccccccn

SEQ ID NO: 59827 - protein, 73 aa, Zea mays
  misc_feature: Ceres CLONE 1517686
MAGKGGKGLLAAKTTAAKSAEKDKGKKAPISRSSRAGLQFPVGRIHRQLKQRTQANGRVGATAAVYSAALLET

SEQ ID NO: 59828 - DNA, 627 bp, Zea mays
  misc_feature: Ceres CLONE 1517689
tccccgtcggtggcggccgctcttttctagtggatgccccgggctgcaggatttcctctcacccctagaaaaaaattgcgtttgccgtttcccttcttctacggtacacatctccctccacctggcctacgaccaacgtatgaccgttcggaacgcttacttccttctgcaggtgactaagcacagcgatccgtatgactgctctctcctgataaatggctaagcgtatcatttaggacaccttatggatgactacactcgacgctaataggtactgctgggatacagtttctagtattccacctcgcacttcgaagatatatgtctctatgcctcttgctatgacctcatatgttaatcctatgtatgctaggtagaaatttataatggatatgccaactactcctaatttggatggacgaccacatctggctactatacacaggctcggacaaaaaactgctgcttgagaattattactacatcttgccacgccagctctgctaattgtcctagcattctcatgcagcagaactatcaagtgcagatgtctgactcactaggtagacttcttatgctgctctgatgcgactcattcactgccgctagctttcatcttaatcatag

SEQ ID NO: 59829 - DNA, 659 bp, Zea mays
  misc_feature: Ceres CLONE 1517690
  misc_feature: Encodes the peptide sequence at SEQ ID NO. 59830
tccccgcggtggcggccgctctagaactagtggatcccccgggctgcaggaattcgtctcacccctagaaaaaaccgcagctctgaagcgagatagagatcgctcgtattcctatccacggaacaagcagcgaaggatcggagcctatccaatggccgagggcaagagcagctccggcggcgacctgttctccagcggcgagctggtggagggggccgccatgatcgcggtccaccagaagagcgtggacaacgtcgacaacctcgaggtcgcccgcgcggccgccgagatcctgcacgcggcgaccgtttacaggtagcatcgacaataagccggccctgcagtacgtggagaaggtccagggggacctgaaggagatcggagcggtacacgctaccaccccccagcatcttgccgtcgccagtagcgacgacactgcgcccatcacaccgcgtagccggatgcgcccaaggagcccgcggcggttctctgctcccggccgtgaagggacggcatgatgttcgactgaagagttttggacctcgcgtgatctccatgaagggtcgaccacgccttttcgcgttgatggcaacaaagttatgggctcgcagaggcaggcatatccgcccctgtctgtttttgccgtcttgtctcaccta

SEQ ID NO: 59830 - protein, 55 aa, Zea mays
  misc_feature: Ceres CLONE 1517690
MAEGKSSSGGDLFSSGELVEGAAMIAVHQKSVDNVDNLEVARAAAEILHAATVYR

SEQ ID NO: 59831 - DNA, 901 bp, Zea mays
  misc_feature: Ceres CLONE 1517693
  misc_feature: Encodes the peptide sequence at SEQ ID NO. 59832
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
ttatttgtttttttccccccccccctctatttttnnnnnngnnnnnnnnccaaagctggactccccgcggtggcggccgctctagactagtggatcccccgggctgcaggaattcgtctcacccctagaaaaacgccgaattaagttcgtgcacgtacgcacgcaccgggacaccagcaacccccaacagcgccactgtccagtgcgcgcgtcaagcttgcttagctagccgccatggcctccctcgccgccgtctccgtgaagcccgtggccatccagggtctcgccggcagctccatctccggaaggaagctcgccgtcgccaggccgtcgggccgctcctcccggggggcccgcccaaccgtctgtgggggcctagtactggcgatatagagcggtctacttatgacccctgtatgaccccccccccccccccggcgggggggggggggggcgtttcttaccggcttttgacctccaccgttcttccccttttacgactccttgtacacgcagtccggggtcttctacccaaggacgtcttgccgcgggcggccccctctcttcaccccaatcactataacgcttcctcttctccaggcccttcacgggcccacccctctgccctatgccctgtgagtcgaggccccgcctcccccccgtacctttggtctcactcaccgcccaagtctatttgtcggggaccgattcatccacccacaccctttctggatcccttttacccgcccgcccgccgccccccccccaccgcctctccttccccatcttccggcgccccttggctccgcggttactacattttatcacgcctctcccgcctactccgcttctttaggtctccgcgaccttagcactactcccgcctttctgtaattccgcg

SEQ ID NO: 59832 - protein, 52 aa, Zea mays
  misc_feature: Ceres CLONE 1517693
MASLAAVSVKPVAIQGLAGSSISGRKLAVARPSGRSSRGARPTVCGGLVLAI

SEQ ID NO: 59833 - DNA, 673 bp, Zea mays
  misc_feature: Ceres CLONE 1517694
  misc_feature: Translation starting site: 187
agctccccgcggtggcggccgctctagaactagtggatcccccgggctgcaggaattcgtctcacccctagaaaaaaccactcatcaccagctagtaactctagcaaagcacttgccatctaccgaccgccatattccaaacatgcccgacgagatagcaaagcggcaggcacctcctccaggaacatggcccgcacgcagcagttggcagtagtggcgacagccgtggtggccttggtgctgctggcggcggacgacgtcggaggcggccatcagctgcgggcaggtggcgacggccatcgcgccctgcatctcctacgacgagcggccagggctcaaggccctccaccagctgctgcagcagcttcaggagcctcaacaaggccgcccgcaccacccgccgacagccgcgccctctgtaactgcctcgagaacgacgccgccggcgtcagcggcctcaacgccgggtaacaccgccaggatcccctccaaagtgcggcgtcagcatcgcatacaccatgagcacctccggcgactgcctccagggatgacctgaaacctaaacaaccaactacggggggccggcagcccgcccttgaggacgattccatatcaattcccggccgtccgtcggggctccttgcaggattcgggacacggccctgtaccccta

SEQ ID NO: 59834 - DNA, 684 bp, Zea mays
  misc_feature: Ceres CLONE 1517697
  misc_feature: Encodes the peptide sequence at SEQ ID NO. 59835
aaagctggagctccccgcggtggcggccgctctagaactagtggatcccccgggctgcaggaattcgtctcacccctagaaaaacgccggcgacgacgacgacggcgacggcgacgacgggcggctcacggactccgccttcggcaagctcaagggcatgcactacgtgcacgcggcgctgtacgagagcatgcggctgttcccgccggtgcagttcgactccaagttcgcggcgggcgacgacacgctcccggacggcacggcggtggcgaagggcacgcgggtgacctaccacgcctacgccatggggcggatggagtccgtgtggggccccgactgcggcgagttccggcccgagcggtggctccgggacgggcgcttcgtgcccgagagcccgtacaggtaccccgtgttccaggccggcgcgcgcgtgtgcgtgggcaaggagctggccctgatggagatgaaggccgtgatcgtggccgtggtccggggcttcgacatcgaggcgggcggccggagctcccgccggcccaggttcgcgccggggctgacccgccacgttcgcggggcgggctgcccggtgcggttgcccccgggcaaccaccttgcaagcggggcacaagcgcacaaacccggccaatgtggatgaaaaccggatttaaaggaaaaaaaaaaaaaaaa

SEQ ID NO: 59835 - protein, 164 aa, Zea mays
  misc_feature: Ceres CLONE 1517697
  misc_feature: SWISSPROT Homolog: EC 1.14.15.3 Alkane 1-monooxygenase
MHYVHAALYESMRLFPPVQFDSKFAAGDDTLPDGTAVAKGTRVTYHAYAMGRMESVWGPDCGEFRPERWLRDGRFVPESPYRYPVFQAGARVCVGKELALMEMKAVIVAVVRGFDIEAGGRSSRRPRFAPGLTRHVRGAGCPVRLPPGNHLASGAQAHKPGQCG

SEQ ID NO: 59836 - DNA, 648 bp, Zea mays
  misc_feature: Ceres CLONE 1517699
  misc_feature: Encodes the peptide sequence at SEQ ID NO. 59837
atagctggagctccccgcggtggcggccgctctagaactagtggatcccccgggctgcaggaattcgtctcacccctagaaaaagtgctctctcagaggtgggctggcttctcctccccctcttaccaagtcctcctcgggttagggttccttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggctacggcggcggtcgcggcggcggcggctatggtggcgggcgccgtgacggccgttatggcggcggtggcggctacggcggtcggccccagggtggtggccgcggctacggaggccgtggcggctacggcggtcggcccaaggtggtggttggcgctaccgcggcggcggcgccgcttgaaggaatgatgtg

SEQ ID NO: 59837 - protein, 158 aa, Zea mays
  misc_feature: Ceres CLONE 1517699
  misc_feature (10)..(81): Pfam Name: RRM_1 Pfam Description: RNA recognition motif. (a.k.a. RRM, RBD, or RNP domain)
  misc_feature (48)..(141): Pfam Name: GRP Pfam Description: Glycine rich protein family
  misc_feature: SWISSPROT Homolog: EC 5.2.1.8 Peptidylprolyl isomerase
MAAADVEYRCFVGGLAWATSNESLENAFASYGEILDSKVITDRETGRSRGFGFVTFSSENSMLDAIENMNGKELDGRNITVNQAQSRGGGGGGGGYGGGRGGGGYGGGRRDGRYGGGGGYGGRPQGGGRGYGGRGGYGGRPKVVVGATAAAAPLEGMM

SEQ ID NO: 59838 - DNA, 868 bp, Zea mays
  misc_feature: Ceres CLONE 1517702
  misc_feature: Encodes the peptide sequence at SEQ ID NO. 59839
  misc_feature (34)..(34): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
ccttccatatcctatttttttttatttccccgcncnnnnnccaannnnntcaaagctggactccaccgcggtggcggccgctctagactagtggatcccccgggctgcaggaattcgtctcacccctagaaaaagtgctctctcagaggtgggctggcttctcctccccctcttaccaagtcctcttcgggttagggttacttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcctccctctaccgggagacggggaggtcttcgcggcttcagcttcccatacctttctccctccgataaactccttgcttcgacgtttatctaagaaacgttcatcgggcctatgcatcttcgcaccgcccgttatcctttacctgtttaaccgagggcccccaaagcccccatgggcgggctgtctcgtccggctcgacggtctgggccttcctagcccggttcggctctctctagcctggccggcacgggccttaataggacgggattggttcgtttctattttatcagggcgggtgttatttacccccctcgcgtccgccccgcaattcctatttgtgttctcgtgttgtcgtgcgggtggagtggctctgccgggctttactagtaaactctcttgggcctgggctcccggacgtgtccgcggtttctaggtgccggtggtattcgccctaccaatcggccgggcgcgccagtggccctctatgggcgcgggtgtcagtccatcgccggctgcccgatcgtatggcg

SEQ ID NO: 59839 - protein, 182 aa, Zea mays
  misc_feature: Ceres CLONE 1517702
MAAADVEYRCFVGGLAWATSNESLENAFASYGEILDSKVLPLPGDGEVFAASASHTFLPPINSLLRRLSKKRSSGLCIFAPPVILYLFNRGPPKPPWAGCLVRLDGLGLPSPVRLSLAWPARALIGRDWFVSILSGRVLFTPLASAPQFLFVFSCCRAGGVALPGFTSKLSWAWAPGRVRGF

SEQ ID NO: 59840 - DNA, 664 bp, Zea mays
  misc_feature: Ceres CLONE 1517705
  misc_feature (362)..(362): n is a, c, t, g, unknown, or other
aagctggagctccccgcggtggcggccgctctagaactagtggatcccccgggctgcaggaattcgtctcacccctagaaaaataatgattaatagggacagtcgggggcattcgtatttcatagtcagaggtgaaattcttggatttatgaaagacgaacaactgcgaaagcatttgccaaggatgttttcattaatcaagaacgaaagttgggggctcgaagacgatcagataccgtcctagtctcaaccataaacgatgccgaccagggatcagcgggtgttactaataggaccccgctggcaccttatgagaaatcaaagtctttgggttccggggggagtatggtcgcaaggctganacttaaaggaattgacggaagagcaccacaagaaggacggcggggagcacaaggaaggcatcgtggagaagatcaaggacaagatcaccggcgagcacggcgacaagtccggcgaccacaagggaaaagaaggacaagaaaaagaaagaaacacggcgagggccacgaccaccacggcggccccagtaccagcaacagcgaacagcaactgaaatctgggggccccagcacaggggcaacccactgtattgcttgctggatgggagaattcctaccagcctgaatcctgaatgtaagggttt

SEQ ID NO: 59841 - DNA, 672 bp, Zea mays
  misc_feature: Ceres CLONE 1517706
  misc_feature: Encodes the peptide sequence at SEQ ID NO. 59842
  misc_feature (636)..(636): n is a, c, t, g, unknown, or other
  misc_feature (637)..(637): n is a, c, t, g, unknown, or other
aaagctggagctccccgcggtggcggccgctctagaactagtggatcccccgggctgcaggaattcgtctcacccctagaaaaaaaccccaccacaacccagcgccggcagtcgccgtcatcgatcgatcgccggaaaactaacccctaacgatgtctggagccggcgaggaggacaagaagcccgcggagggcggcgcccacatcaaccttaaggtcaagggacaggatggcaatgaggtgttctttcgcataaagaggtccacccagctgaagaagctgatgaacgcttattgtgaccgccagtctgtggacatgaatgccattgcgttcctgtttgatggccgcaggcttcgcggcgagcagacccctgatgaggtgacccaattcggctttagatcccagcattgagtggaatacttgatcgatagatcttttgcctgtgcagctggagatggaggacggcgacgagatcgacgccatgcttcaccagaccggaggcagcgttcctagcaccacctaaaagcctcgttttgctctccgtcctgcgtagtagtaaacaaaagggaaaaagtctttttaaggaacttgtgatgctctggctccttgtgccattgctgagggacatccttagccnnttgttagtagtatggtttggtactttgttctgtca

SEQ ID NO: 59842 - protein, 85 aa, Zea mays
  misc_feature: Ceres CLONE 1517706
MSGAGEEDKKPAEGGAHINLKVKGQDGNEVFFRIKRSTQLKKLMNAYCDRQSVDMNAIAFLFDGRRLRGEQTPDEVTQFGFRSQH

SEQ ID NO: 59843 - DNA, 482 bp, Zea mays
  misc_feature: Ceres CLONE 1517707
  misc_feature (171)..(171): n is a, c, t, g, unknown, or other
  misc_feature (255)..(255): n is a, c, t, g, unknown, or other
aaactggactcccgcggtggcggccgctctgaactagtggatcccccgggctgcggattcgtctcacccctagaaaaaacgcaacctcccactgcattctcgaattccgattcccaatccagcaaacccctaccagccttttgcaactcagagaggacccgatggcaccangcggaaagagcggcgcgagaagcgcaaagagagccgcgcccggcgagaagctctgctgggagaagccgaagcgagaacgctccngcggaaaatcgccggcagaaggcgtgtgacaaaaggggcgaaaggccaaaaaaaactgaaaccttcaaatcttctcttcagggcctaaacaggggcccccggatttgggttttccttcaagggcttggccttatggaaatccttttttaaaaaaatttttcaaaaaaattcccccgggaaaaggggccaaatctcccccttttaaaaaaaaaaacccccccttcccc

SEQ ID NO: 59844 - DNA, 659 bp, Zea mays
  misc_feature: Ceres CLONE 1517710
  misc_feature: Translation starting site: 335
aaagctggagctccccgcggtggcggccgctctagaactagtggatcccccgggctgcaggaattcgtctcacccctagaaaaatagcccctatcacatcgaatgtcttgacctccgttcggggtattgaatgtcctcggattatcaaactaatttctcagccgaggattgagaggttgatcaccggtcgcgaccaaattctcccagaggcgctcttcgagggttaccctagagaggcttgctgatctgctctgcctgattttgcaggacgcacaaaaccatctttcagacatggcgaactcaaaatctctgactgcaaaaatacgacaggccgatgggagttgtgagcttccgagtagttcaggactgcaacggcccacttaactcgtgggctacaaacctcgagcagcttcttgaccttgtcgagaagagctgtcaccagatacacaaggagacgatgatccacaaggcggtattgaaagcttgactgattggcgctggctgtttttgcttcgtaagtaagatactgtaccagtagaaggacggggatactatttgttgctgaactcttgctgcacattatttgaattcttagatctgcactcagatacctactcctgaaaagcagatccggctccctcatcaaactcagttctccg

SEQ ID NO: 59845 - DNA, 855 bp, Zea mays
  misc_feature: Ceres CLONE 1517711-R
  misc_feature (855)..(855): n is a, c, t, g, unknown, or other
attgggtacctcgagcgtctcgtttttttttttttttttcgataaatatgcgccgaaaagggttaattacgtatgatctgatctaatcacggaccgtccacaggttggaccgtccggccatgtccagtaccacaaatggtgctcaacaaccacagatgggaagttcaaaatagttcacaaaaaatggactgaatgcagctagggaagtttcaaaataggatgacaaaagaaaaggaatcagtggtggtgaacaccaaacaagccccaagacaggcctgctcagccgctctggttctgaagaggctgcttcttgtcatcgctgggcagatcaagtgcggctgggattttcattttgccagggtagttgttgtaactggggccatctgaaccaagcatactcctgtcaaccagtaccaaggaccggagctcgcagtttgcaaagtacttgctcacttcttgtgttactgttggatggcactctttgctgtacctgcgcaaggtatggcttaataaaccgctatgggtgacgatggctatctctctctcttctcttgtccatagccagtcaatgaacttcatacccctttctgcgagcgactcaaaggtttctctgacatctggtacccagagaacatcttcgtcactctctatcagcgaaaaatcaatggcagggaagagagcacggtactctgtgatgctcctcctcttgtcacaaggatggacacccaagcgctccctgcaggcctcaacagcaagaaatggtgggcagttcaaacttgaaactgccggaacgtcagcattcttcaccatcagtgggagcacactcacaccattactgcagctttcgccaccaan

SEQ ID NO: 59846 - DNA, 670 bp, Zea mays
  misc_feature: Ceres CLONE 1517711
  misc_feature: Encodes the peptide sequence at SEQ ID NO. 59847
  misc_feature (80)..(80): n is a, c, t, g, unknown, or other
atagctggagctccccgcggtggcggccgctctagaactagtggatcccccgggctgcaggaattcgtctcacccctagnaaactacactccagctccactctcccatggcttcctccgccctgccttccagaaccttgcaccgccgcgcgctcccctcgtctacgccgtgccaccctgcgacggagaccttcgcccccggcgccgtctcccggcggcgagcagccgtgcggctcctctccgccgggttcctgaccgccgtcgcgccgccgccgtcgctcgccgcgaggaggggacgcgttgtcgtgccaccggaggactacgccactgcacccgatggtctcaagtactacgatcttgtcgaagggaagggaccaactgctgagaagggctcaaccgtgctggtccacttcgactgcatttaccgtggcatcaccgcggtgtcgagccgtgagtcgaagctcctggcggggaaacggagcatcgcccagccttacgagttcatcgttgggtcgctgcctgggaaaagacgcaagcgggatttcgcggacaacgcccacgggctgtactcggcgcaggcgggttcgaagcctccggccgccatggacaccataaccgaggggaatgaaggtggggggaaaaaaggaaaatgattgtcccctccagagctg

SEQ ID NO: 59847 - protein, 181 aa, Zea mays
  misc_feature: Ceres CLONE 1517711
MASSALPSRTLHRRALPSSTPCHPATETFAPGAVSRRRAAVRLLSAGFLTAVAPPPSLAARRGRVVVPPEDYATAPDGLKYYDLVEGKGPTAEKGSTVLVHFDCIYRGITAVSSRESKLLAGKRSIAQPYEFIVGSLPGKRRKRDFADNAHGLYSAQAGSKPPAAMDTITEGNEGGGKKGK

SEQ ID NO: 59848 - DNA, 641 bp, Zea mays
  misc_feature: Ceres CLONE 1517712
  misc_feature: Encodes the peptide sequence at SEQ ID NO. 59849
  misc_feature (563)..(563): n is a, c, t, g, unknown, or other
tggagctccccgcggtggcggccgctctagtactagtggatcccccgggctgcaggaattcgtctcacccctagaaaagagctgactcccttccctttcccccggaccagtggcggatgccctacacaggctaccacaggccacagactgggctgacctactgcgcgtgtcgccgtaagggaaacgtcctccaaccggtgcgtcacctcctccgccttcagtatcgcctccagcatgagcgccgcgtgaggtattcggttcaccgtctaggagagagagtcacttctgcctagggagacagggatggagccggtcctgggcatcgtggtgtcaaacaagatgctgaactccatcgtgtttgcgctggaccgccacttgcagtacaagatgtacaaccgctctgacaagcgcacctctaagtccgtggaactcgacgaggctgagtcctgcaacattggcaaccgggttaagatggaccccttcaaggcccttggaccagcaataaacactggcgttgtgactgaaaatcacccctcgacccttaaggataatgttccccccanaaagcaaaagccgtccccgtccaatccttttggaacaaaaaccaccccaaatctccaaaaagcttggtgttcacaaac

SEQ ID NO: 59849 - protein, 112 aa, Zea mays
  misc_feature: Ceres CLONE 1517712
  misc_feature (87)..(87): Xaa is any aa, unknown, or other
MEPVLGIVVSNKMLNSIVFALDRHLQYKMYNRSDKRTSKSVELDEAESCNIGNRVKMDPFKALGPAINTGVVTENHPSTLKDNVPPXKQKPSPSNPFGTKTTPNLQKAWCSQ

SEQ ID NO: 59850 - DNA, 664 bp, Zea mays
  misc_feature: Ceres CLONE 1517716
aaagctggagctccccgcggtggcggccgctctagaactagtggatcccccgggctgcaggaattcgtctcacccctagaaaaacttgttttccgctgcagggtccatctaccaatgaagaggggtatggcgaatcgtaacggattgagcgtcctacagccaaaagcggacgggagttatttaggatgctgacgacattcaattcacaaggcttgacaggtgtgaggaccagcatatcaccgaggcccatgagactacatctggtcaggaacatgctcattgctggcatataataacgctacaacgatgctgctcagtacagacaccaacttgccatgtaggggacctgcaaagagaacgcgatatagtccgatgggtgcaaagcttcaacttgtgacacattgataggggtgaacacacgatcgatatcttgctgaaccacgagaagctgcagcaaatctcgaaggaagaccatgtcaatacgtacgtattgcggaatttctgtgtcgaaccacacgtgatccgatagcctaatcctggatacgtctagacatagtggcactgcttgccgtgattgtactcgtaacctgcaaatgactgctggggaaaataaaagaaaaaaacgagaagttccaagtcaccaaattcccccaaatggagggac

SEQ ID NO: 59851 - DNA, 650 bp, Zea mays
  misc_feature: Ceres CLONE 1517719
  misc_feature (398)..(398): n is a, c, t, g, unknown, or other
aaagctggagctccccgcggtggcggccgctctagaactagtggatcccccgggctgcaggaattcgtctcacccctagaaaaagcaggcacgggaaggcgtacctcttccataaggtaccagagcttctggtgcggcaaaaaaccaatgtacgtggcttggacaacttgatgacctcttgccaacaagaggtcaaaatttggtagttggtgattcgatatcaaaacacttcattagctccaatattatgcatttcactgtttgtgccaatgtgacttctggagtaaaagaagatcgcatgatgatgacaggaatgcatactgtttctgatatcttctgtgttggctgtggatccatcgttttctcccccctgagggtgcggggggggggagcccganatacaaggaaggaaagtttattctggagaagtacaaggtgtcgggccctgacggaagccaatactggattccccaagatcctcccttgggtggaaaccacccccatgatttatgaagcgccagtcacccagtttcaggcctgcttgttcgtcccccccccccgtagcctggaaaaaaaccggggtgttttttgctcttttaggcaacccgggtattgtccccatttgaaataaaccccccgggataaactaa

SEQ ID NO: 59852 - DNA, 667 bp, Zea mays
  misc_feature: Ceres CLONE 1517724
  misc_feature: Encodes the peptide sequence at SEQ ID NO. 59853
  misc_feature (477)..(477): n is a, c, t, g, unknown, or other
aaagctggagctccccgcggtggcggccgctctagaactagtggatcccccgggctgcaggaattcgtctcacccctagaaaaaatagcacacagccaaagccaccagcgctcgtcacctccaatcaacaaattcccaatccgccgcttcccatcccgcgttcgccgctccatttgatcgaattcccgatggcgcccaaggccgagaagaagcccgcggagaagaagccgacggaggagaaggccgagaagaagcccagggcggagaagcgcgtgccgggcaaggagggcggcgagaagaaggggaagaagaaggccaagaagagcgtcgagacgtacaagatctacatcttcaaggtgctcaagcaggtgcacccggacattggtatctcgtccaaggccatgtccatcatgaactccttcatcaacgacatcttcgagaagctggctgccgaggccgccaagctcgcccgctacnaacagaagcccaccatatcttcccgggagatccagacttcggtgcgcctcgtcccttcctggcgagctcgccaagcacgccggtctccgaggggcaccaaggcccgttaccaagtttactttcctctttgaacggccgcccccacggaccgaccgctctggttccgtttccctcgtacttttaaggccca

SEQ ID NO: 59853 - protein, 139 aa, Zea mays
  misc_feature: Ceres CLONE 1517724
  misc_feature (44)..(114): Pfam Name: Histone Pfam Description: Core histone H2A/H2B/H3/H4
  misc_feature (97)..(97): Xaa is any aa, unknown, or other
MAPKAEKKPAEKKPTEEKAEKKPRAEKRVPGKEGGEKKGKKKAKKSVETYKIYIFKVLKQVHPDIGISSKAMSIMNSFINDIFEKLAAEAAKLARYXQKPTISSREIQTSVRLVPSWRARQARRSPRGTKARYQVYFPL

SEQ ID NO: 59854 - DNA, 680 bp, Zea mays
  misc_feature: Ceres CLONE 1517727
  misc_feature: Encodes the peptide sequence at SEQ ID NO. 59855
  misc_feature (680)..(680): n is a, c, t, g, unknown, or other
aaagctggagctccccgcggtggcggccgctctagaactagtggatcccccgggctgcaggaattcgtctcacccctagaaaagttcggacttccgccgcgcttcgccctctcgctccagccgcttcacagcgccgccgctcgcctctccgaccgccgcgagaatgccgttcaagaggttcgtggagatcgggcgcgtggccctggtgaactacggcaaagactatggccgcctcgtcgtcatcgtcgatgtggtcgaccagaacagggcacttgtggacgcccctgatatggtcaggtgccagattaacttcaaacggctctcacttactgacatcaagattgacatcaaacgcgttcccaagaagtcaaccctgatcaaggctatggaggaagctgatgtgaaaacgaagtgggaaaacagctcatggggcaagaagctgattgtcccagaagaggagggctgcgctcagtgactttgacccgttcaagggcatgctggcaagggatcaagaggggtgggtgctatcaggcaagaactccgccaagctgatgaaggcgtccacggctttagtccccttttggggggaaggcatcgttaatttttttggtttccaaggttccatccacactttttgcttttgaaggtggttggcccaaacccccgaaatttttctaatn

SEQ ID NO: 59855 - protein, 103 aa, Zea mays
  misc_feature: Ceres CLONE 1517727
  misc_feature (44)..(100): Pfam Name: Ribosomal_L14e Pfam Description: Ribosomal protein L14
MPFKRFVEIGRVALVNYGKDYGRLVVIVDVVDQNRALVDAPDMVRCQINFKRLSLTDIKIDIKRVPKKSTLIKAMEEADVKTKWENSSWGKKLIVPEEEGCAQ

SEQ ID NO: 59856 - DNA, 658 bp, Zea mays
  misc_feature: Ceres CLONE 1517729
  misc_feature: Encodes the peptide sequence at SEQ ID NO. 59857
aaagctggagctccccgcggtggcggccgctctagaactagtggatcccccgggctgcaggaattcgtctcacccctagaaaaaaccatcacacagcaatccacacaagcacttcgacgtcacacgggcgctgcgcacagacacaccaagcgtcggcaccaatggcttactaccaggaggtggactactgctcggaggaggtgaggtcggtggccccggccggcttcggccgccacggcggcggcgtccagcagcacgtcgtcaaggagaagttcgaggaggtcgacacggtctcacgcgccggcgccaaccaccaccaccaccatggtcaccacggcggccacggcttcgtggtgcgcgagaccagggtcgaagaggacatcaacacctgcaccggcgagttccacgagcgcacggagagcttcctcgccagggctaactgagccgcccggcggccggcatccacgcccgttcgtgcttgcctgcgtgccttatgtatgtctgtggttgactggttgtgcaagatcatcgtacttggctatcgtacgtgcacgcactcagctcctgtacgaattacgacaataagctcgtgacctgaataaaacttcctcgtaatactgatacctacatcacccatgaaaaaaaaaaaaaaacgagg

SEQ ID NO: 59857 - protein, 93 aa, Zea mays
  misc_feature: Ceres CLONE 1517729
MAYYQEVDYCSEEVRSVAPAGFGRHGGGVQQHVVKEKFEEVDTVSRAGANHHHHHGHHGGHGFVVRETRVEEDINTCTGEFHERTESFLARAN

SEQ ID NO: 59858 - DNA, 593 bp, Zea mays
  misc_feature: Ceres CLONE 1517731
  misc_feature (408)..(408): n is a, c, t, g, unknown, or other
  misc_feature (409)..(409): n is a, c, t, g, unknown, or other
  misc_feature (473)..(473): n is a, c, t, g, unknown, or other
  misc_feature (559)..(559): n is a, c, t, g, unknown, or other
  misc_feature (560)..(560): n is a, c, t, g, unknown, or other
  misc_feature (581)..(581): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
aaagctggagctccccgcggtggcggccgctctagaactagtggatcccccgggctgcaggaattcgtctcacccctagaaaaaaccgtgcatggttcgcagcgccaccgccagggtcgcaagcttatagcagtcaacaaatactagtgcccattaccggatcggtcggaagccggccggcggcaaggaaggagtatcccagcgcagcaccgactccacgacttggccatcatccatcgcagtatcgcaccgcagcaacagacaccgaccgaggatggttgttgccgtcgccgcgcggtcgtcgtccgcgaccagcagcagcagcgtgacccgatccagttccgccgccgctgctgctgctgcttagatggtccttggtcatatgtggggtgcttttcatcatggttnngatcatcgttgctttgggtatcaaaatataagtcattagttgcaggtagctaggattaaccccngggcggggggaaaggcgggaaaattttttttttctgggggcccccccccgggcgtggggtgtggtttggtgaagggtgtggatgtnnttttttttttttctttctccncccnnncccccc

SEQ ID NO: 59859 - DNA, 647 bp, Zea mays
  misc_feature: Ceres CLONE 1517732
  misc_feature: Encodes the peptide sequence at SEQ ID NO. 59860
aaagctggagctccccgcggtggcggccgctctagaactagtggatcccccgggctgcaggaattcgtctcacccctagaaaaaaagcctgtaaccaatcgcctccccaccccattcttatctcctctccaccgcttgctatccgtcgcctcgccgcgcgcgcgtactttcggttctcggccactgctcagctctcgctgcagcgatggccctgcaggccccgtcactcatgcgcgcgccggcggcacagcggtccgcgccgccacggccctccttctccgccccgtggtcgctgcggctgccggcgccggcgcggcgccgggtggccacggccgcgcggatcaccatgcgggtcgcgtccaagcaggcctacatctgccgtgactgcgggtacatctacaacgacaggacgccgttcgacaagctggctgacaactacttctgccctgtttgtggagctccgaagagaaggttcagaccctacgagccggcagtctccaagaacgcgaacgccaccgatgccagaaaagctaagaaggaggagctgaagaaagaggagagcatgggggaaagccttgccatatgccatcgacgtcgggatcattgccttggctgggctgtacttctacctcaacaatgtctacagc

SEQ ID NO: 59860 - protein, 147 aa, Zea mays
  misc_feature: Ceres CLONE 1517732
  misc_feature (55)..(90): Pfam Name: Rubredoxin Pfam Description: Rubredoxin
MALQAPSLMRAPAAQRSAPPRPSFSAPWSLRLPAPARRRVATAARITMRVASKQAYICRDCGYIYNDRTPFDKLADNYFCPVCGAPKRRFRPYEPAVSKNANATDARKAKKEELKKEESMGESLAICHRRRDHCLGWAVLLPQQCLQ

SEQ ID NO: 59861 - DNA, 864 bp, Zea mays
  misc_feature: Ceres CLONE 1517734
  misc_feature: Encodes the peptide sequence at SEQ ID NO. 59862
  misc_feature (47)..(47): n is a, c, t, g, unknown, or other
  misc_feature (50)..(50): n is a, c, t, g, unknown, or other
  misc_feature (51)..(51): n is a, c, t, g, unknown, or other
  misc_feature (68)..(68): n is a, c, t, g, unknown, or other
  misc_feature (864)..(864): n is a, c, t, g, unknown, or other
ccctgttttcgagggtcccgtccttttacccttttccctcccaaaanaannaaaagatggactccccncggtggcggccgctctttctctcctcgcatcccccgggctgcaggaattctctccacccctagaaaaagtcggacccggcgatgcagcggcacgtcgcctccggtcggccgtcgggcacggacggctccgacttttcttaccgcatggtcgtcgaatcccggtaccagagggtcgccgagggcagatcccgcctcgcgcgcctcatcctcgtgcaggcgctgcaccctagcgggcggaggcttgcttctattgctgtcgttgtccaaggggttgtgggtgaacaagttcgccgtgcttgttcaagggctgccggcattccctccctaaccgtggggcggcgcaatcaatttttttttccccccccccgcccggggggggggggggggttttccaacattccctgtctccttgaagtagccgcggtgcgtttcccccccgcccccgttgccctttttacctccctccccacctctcctctcttgcgtccctccttcccatgtctttatacccgcttaagaggccatatgcacacgagtttctattgcagcccccttattcgtagtgccagttagtcgttgcttccccatattcgggaacctccttgtctgacaatgtgaggggggggtgtgtttactattaaccgcgtccccccccatctcggccctcgccccacatacttaatagttcactctcttacactcccttgcttttgttcaccttcttccccccacatcttgttttctcgtctcttcgtgtgcattcctttcatgtcttttcgcgttcaccacgcccccn

SEQ ID NO: 59862 - protein, 163 aa, Zea mays
  misc_feature: Ceres CLONE 1517734
MQRHVASGRPSGTDGSDFSYRMVVESRYQRVAEGRSRLARLILVQALHPSGRRLASIAVVVQGVVGEQVRRACSRAAGIPSLTVGRRNQFFFPPPRPGGGGGFSNIPCLLEVAAVRFPPAPVALFTSLPTSPLLRPSFPCLYTRLRGHMHTSFYCSPLIRSAS

SEQ ID NO: 59863 - DNA, 684 bp, Zea mays
  misc_feature: Ceres CLONE 1517738
  misc_feature: Encodes the peptide sequence at SEQ ID NO. 59864
  misc_feature (684)..(684): n is a, c, t, g, unknown, or other
aaagctggagctccccgcggtggcggccgctctagaactagtggatcccccgggctgcaggaattcgtctcacccctagaaaaagccctccctccgcgcccccgatccagatccagatccaggggcttgtcatggcatccaaacgtatcctcaaggaattaaaggacttgcaaaaggaccctccaacatcatgcagtgcaggtcctgctggtgaggatatgttccactggcaggcaaccatcatgggtcctcctgatagtccatatgctggaggtgttttcttggtgaacattcatttcccgccagactaccccttcaagcctccaaaggtatcttttaagacgaaggtcttccatccaaacatcaatagtaatggaagcatatgtcttgacattcttaaggagcagtggagccctgctttgacaatctctaaggttttgctttctatctgctccctgcttactgatcccaacccagacgaccctcttgtccctgagattgctcccatgtacaagacggatcggcctaagtacgaaagcaaagccccgcagcttggacccaaaaattacgcccatgagaagaaaatggttcggccgttacctggcttaaatgcaagaacaattgggggcggtttccccattgaaaaattgttattcgggggaacattattttttcctcctgttn

SEQ ID NO: 59864 - protein, 184 aa, Zea mays
  misc_feature: Ceres CLONE 1517738
  misc_feature (5)..(140): Pfam Name: UQ_con Pfam Description: Ubiquitin-conjugating enzyme
  misc_feature: SWISSPROT Homolog: EC 6.3.2.19 Ubiquitin--protein ligase
MASKRILKELKDLQKDPPTSCSAGPAGEDMFHWQATIMGPPDSPYAGGVFLVNIHFPPDYPFKPPKVSFKTKVFHPNINSNGSICLDILKEQWSPALTISKVLLSICSLLTDPNPDDPLVPEIAPMYKTDRPKYESKAPQLGPKNYAHEKKMVRPLPGLNARTIGGGFPIEKLLFGGTLFFPPV

SEQ ID NO: 59865 - DNA, 673 bp, Zea mays
  misc_feature: Ceres CLONE 1517741
  misc_feature: Encodes the peptide sequence at SEQ ID NO. 59866
ctccccgcggtggcggccgctctagaactagtggatcccccgggctgcaggaattcgtctcacccctagaaaaaatttttcgactttcgagcgcagaaacgagagggccggagcagccgcagtcccggcgatcccgccgccggtcgccctcatacttcctcgtcactgccttcgtttctctttccaacaatcaagatgagccgtggcggtagcgcgggtggtggtcaaagttctctgggttacctctttggaagcggtgagccccccaaaccagcagtggcaccagctgtaagtgctccacctgctgctgcaggtgctccacctgctgagaaaccacctgctgcaaagcctgatggcaccagtcagattgctgcctggggttaccagccaaaccaataaactaccacaggggccgacggtcagaacaccggaaacttccttacggaccgtccttcgaccaaggtccacgctgctcctggcggtggcttcttcccctgggaataccctgtttggggggaacctgatgccgctcaccaagctatcacccccccactgtcgccgcatgccttttttttgaaccgtgaaccggccgtttgcattttcctgggtaccccaaaccctcccgtcccgcgttggggccccgtaaccttgccccctaaaatttcaccgcgtc

SEQ ID NO: 59866 - protein, 67 aa, Zea mays
  misc_feature: Ceres CLONE 1517741
MSRGGSAGGGQSSLGYLFGSGEPPKPAVAPAVSAPPAAAGAPPAEKPPAAKPDGTSQIAAWGYQPNQ

SEQ ID NO: 59867 - DNA, 647 bp, Zea mays
  misc_feature: Ceres CLONE 1517742
  misc_feature: Encodes the peptide sequence at SEQ ID NO. 59868
tggagctccccgcggtggcggccgctctagaactagtggatcccccgggctgcaggaattcgtctcacccctagaaaaactagaaaaagccagttcgtctcccggataagacgataattcgagccgaaaaatatcaccacacagacacacaggtacgcaaggcacagcccaagaccaccgcaccgcacctgcacaccgccagggatggcggcaaccgcgcacctcaccggtgtcctcggcgtgtcgtcgccgcctctcgctccgtcccactgcagctgcagcggcgccaagaagcagagctgctctctgcgtcaggggcggcagcagaggaggcgcctccgcgtcgcccgcgccgtcgaggtggacgcgccttccgccggcgcaccggagccggaggaggcggaggagccgtccgtcgacttcgctttcgtcagcccgcggctgctgccggacgggacgccggacgtgcactaccggacggcgcgcggcgggcagaagctcagggacatcatgctcgacggctacatcgacctctacgggccctacgataagggtctatctcactgctcagggggcggcgtgtgcgggacctgcatcgtcgaggtggttgaaggcaaagaaatgctgtccccgaaaactgatgtgga

SEQ ID NO: 59868 - protein, 147 aa, Zea mays
  misc_feature: Ceres CLONE 1517742
MAATAHLTGVLGVSSPPLAPSHCSCSGAKKQSCSLRQGRQQRRRLRVARAVEVDAPSAGAPEPEEAEEPSVDFAFVSPRLLPDGTPDVHYRTARGGQKLRDIMLDGYIDLYGPYDKGLSHCSGGGVCGTCIVEVVEGKEMLSPKTDV

SEQ ID NO: 59869 - DNA, 669 bp, Zea mays
  misc_feature: Ceres CLONE 1517747
  misc_feature: Encodes the peptide sequence at SEQ ID NO. 59870
aaagctggagctccccgcggtggcggccgctctagaactagtggatcccccgggctgcaggaattcgtctcacccctagaaaaaaccaggcaccagcatagatctcgtgctcgccactattattctgcacagcaacgcatcagccttctggaaccatctcgccgccgccacaccacaatccacaacccgtcgaagcgaagcaagcaatggccggagtcggatcgaaggccctcgccgttgccgccgttctggcggccgtctccttctcggtggccgccgcggccgaggcgcccgcgcccagccccgtctccgccgccgtcgcggcgtcgtcgcccttcgccgcggctctcgtcgcctccgccgccgccttcctcttcgccgccgggcgccactgagccgatggggcctcgtgcctgcaggctacctagcagtacttcccccgccgccgccgccgccgcctagatctatttattggagtgctatccagtagtactagtagtagtgagatttgttcggtgctgtcgtgtcctcctcccattttggtcggatctggcttccttggtgaaaggaagggtttccttataccatggtcccgggggctcggttgtgtgaatcccaatccccccccctttgaaaaaaaaaacttccggctaatctcgttcgcggaat

SEQ ID NO: 59870 - protein, 62 aa, Zea mays
  misc_feature: Ceres CLONE 1517747
MAGVGSKALAVAAVLAAVSFSVAAAAEAPAPSPVSAAVAASSPFAAALVASAAAFLFAAGRH

SEQ ID NO: 59871 - DNA, 648 bp, Zea mays
  misc_feature: Ceres CLONE 1517749
  misc_feature: Encodes the peptide sequence at SEQ ID NO. 59872
atagctggagctccccgcggtggcggccgctctagaactagtggatcccccgggctgcaggaattcgtctcacccctagaaaaacacatcaattgccatcgcgtcgacattctctctgtactcaactgctatcatagggcgcctgattgggctagagccatcgttaaccatatcaatactgccaaggtgtattactctggcgctggctttgagcatagtgtctttctttgaaggtgtaaactcttcggtaactgctgtcgtggttgtccttaccgggctcatcggtgcgaactttgtgctagcagccatggagaaacttggtctgaacgaccccatctccagaagagtagggacagcttccagcgctcaacgactgggagcaggagcgctggcggccaaggaacctgaagcgctccctttctgcgccatcgcttatagtttcacggggattttcggcacgctgatctgcttcggtccggcagtcaggcaaaacctgatattcatagctcggtaaaaaaatgatctcgaatttgaccggtttcatctttaagaaaaaaaaaacagctttgcttcctcccctcccccgtccaaaaaggcagggaaaccaaccccccccaatgtaagggcagggatttaaatatttgtacg

SEQ ID NO: 59872 - protein, 68 aa, Zea mays
  misc_feature: Ceres CLONE 1517749
MEKLGLNDPISRRVGTASSAQRLGAGALAAKEPEALPFCAIAYSFTGIFGTLICFGPAVRQNLIFIAR

SEQ ID NO: 59873 - DNA, 794 bp, Zea mays
  misc_feature: Ceres CLONE 1517750
  misc_feature (79)..(79): n is a, c, t, g, unknown, or other
ccagctggagctcaccgcggtggcggccgctctagactagtggatcccccgggctgcaggaattcgtctcacccctagngagggaggccgggtcccccttcctttcctgttttccccacctcttcctttcccccccacccccactactctctctcgccccaaaaccagatcgccacgaccaagggcagagggacccggagggcctcgtagcaatggcggccggctaccgggacgaggatgattcccaatacctcctcaagggggaccggatcggggactcccgttttcccccagaaacaactagctcgccctcttcaccccccgctcaattataaacttgagttcccattcccccacccggcgttcttttccccccccccccccgggggggggggggggaggtgaaccggtattctccgttcgggtaacttggcgggacgcgaatgccccaggaaagaccccctttgtgccaccccccccgccggccgcactcgccacacgcgctacagtttccgaccgctcccctctcagcaccggtgtgattccgcccgccttacccgacaccgatacgccgataggtggcctaactacccacagttgcacagctgccgcactcccggcgcgtcgaatggtatcatcccgccgccacatgcgttgcgtacaggctcgccttcgcgcggtaagccccgctggcccaccctcgctctgccccaacaacgtgcaccccccgcccgtaccggctcacctgtcatcaccgcgtccagtctcccactgcccgccccctcgcccgccct

SEQ ID NO: 59874 - DNA, 695 bp, Zea mays
  misc_feature: Ceres CLONE 1517759
  misc_feature: Encodes the peptide sequence at SEQ ID NO. 59875
aaagctggagctccccgcggtggcggccgctctagaactagtggatcccccgggctgcaggaattcgtctcacccctagaaaaagttttgtggcgtgcggaaggagtcggagggaaccgaaaactcagggtctcgaatttcctaggagcggaggcgatggctgggaagggaggaaaaggattgctcgccgcgaagacgacggcggccaagtcggcggagaaggacaaggggaagaaggcccccatctcacggtcctcccgcgcgggcctccagtttcctgttggacgaatccaccgtcagctgaagcaaaggactcaggcaaatggccgcgttggggccactgcagccgtctactctgccgccatcctggaggacttgactggcgaggggctggagctggctgggaacgcttgcaaggatctgaaggggaagcgtatcccccctcccccccctacgggtggcctttgccggaaaccaggagctgggacccccctctcaggggcccccctcccgggggggaggggtcattcccccccatcccccgaggccctctgatcagcaagtcccctcaggagggggaagagcaggggaaagccccgttggttggttttaaacctgggccgttctcgggggcgggcccccctgccgagccctctttgcgcaccgggtgggttttttgtctggacgctcgcccg

SEQ ID NO: 59875 - protein, 132 aa, Zea mays
  misc_feature: Ceres CLONE 1517759
  misc_feature (32)..(106): Pfam Name: Histone Pfam Description: Core histone H2A/H2B/H3/H4
MAGKGGKGLLAAKTTAAKSAEKDKGKKAPISRSSRAGLQFPVGRIHRQLKQRTQANGRVGATAAVYSAAILEDLTGEGLELAGNACKDLKGKRIPPPPPTGGLCRKPGAGTPLSGAPLPGGRGHSPPSPEAL

SEQ ID NO: 59876 - DNA, 541 bp, Zea mays
  misc_feature: Ceres CLONE 1517760
  misc_feature: Encodes the peptide sequence at SEQ ID NO. 59877
  misc_feature (409)..(409): n is a, c, t, g, unknown, or other
  misc_feature (410)..(410): n is a, c, t, g, unknown, or other
  misc_feature (415)..(415): n is a, c, t, g, unknown, or other
  misc_feature (416)..(416): n is a, c, t, g, unknown, or other
  misc_feature (418)..(418): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (447)..(447): n is a, c, t, g, unknown, or other
aaagctggagctccccgcggtggcggccgctctagaactagtggatcccccgggctgcaggaattcgtctcacccctagaaaaaatccactctcatcaccagctaagaacagggcttcgtctcaatggaaggcaaaacagggcagctcaggtgctgtttcgtcgccatcgtgctcgtcctgggtcttgtccttgagtcccaccaggctgaagctggaggcaaatggtgctgcgaaaccgccaccggaaaataccattttaatcgctgcgttgactcgggtttggtcgacaatattgggttctgtgcgggggtaaatgcccggttggctttccttttgggaaaacaaaatttgggagggccccttttggccccccgggcccccccccccccggaaaaggccccttttttnnccccnngnggggggggggggggnnnttttgtcgttgnttttttttttttataaaaacccccgtggaaaaaaaaaaggggggaaaaaaaaaatctccccccatttggggttttttttaaacaaaccccccct

SEQ ID NO: 59877 - protein, 112 aa, Zea mays
  misc_feature: Ceres CLONE 1517760
  misc_feature (95)..(95): Xaa is any aa, unknown, or other
  misc_feature (96)..(96): Xaa is any aa, unknown, or other
  misc_feature (98)..(98): Xaa is any aa, unknown, or other
  misc_feature (104)..(104): Xaa is any aa, unknown, or other
  misc_feature (108)..(108): Xaa is any aa, unknown, or other
MEGKTGQLRCCFVAIVLVLGLVLESHQAEAGGKWCCETATGKYHFNRCVDSGLVDNIGFCAGVNARLAFLLGKQNLGGPLLAPRAPPPPEKAPFXXPXGGGGGXFVVXFFFL

SEQ ID NO: 59878 - DNA, 677 bp, Zea mays
  misc_feature: Ceres CLONE 1517762
  misc_feature: Encodes the peptide sequence at SEQ ID NO. 59879
  misc_feature (626)..(626): n is a, c, t, g, unknown, or other
aaagctggagctccccgcggtggcggccgctctagaactagtggatcccccgggctgcaggaattcgtctcacccctagaaaaaaacccaacttctctccctctccctcgcctgcctgccgttccgcgtttgaccaactcccccgcaccgtaaccctagcagcagatcggccatggagagctgggcgacctgggtggggacaagcgtcacctccgccttcttcgcctccctcgagcgctgctcctgcatcaacctctccaccgactacaacgacgacgacgaggaccacgacgaggccaaggaccggcccctcatcctcgccgccgccccacgccacgactccgccgccaagcccgatccagactccgccgccgaggaccaggacgaccagaagcaagagcagccgccgctgccgcccgtatgaatcaaacccgattccttgcttgtactagctgctactgctgttatgtcgccaaataaagtcttgtgtgcctgtgcagtcagtactactgctctgctgctactatcctagtcctagtatattagtatattatccagccctctccgtgaaaatttgaatcgactccaaaatcaaacccccccaatttgagctttggtaaaaaacncccccccattaatcttaacacactccactatcccgccataaatcccgagaa

SEQ ID NO: 59879 - protein, 83 aa, Zea mays
  misc_feature: Ceres CLONE 1517762
MESWATWVGTSVTSAFFASLERCSCINLSTDYNDDDEDHDEAKDRPLILAAAPRHDSAAKPDPDSAAEDQDDQKQEQPPLPPV

SEQ ID NO: 59880 - DNA, 674 bp, Zea mays
  misc_feature: Ceres CLONE 1517764
  misc_feature: Encodes the peptide sequence at SEQ ID NO. 59881
aaagctggagctccccgcggtggcggccgctctagaactagtggatcccccgggctgcaggaattcgtctcacccctagaaaaaatcttgcatctatgtgagccgcccgatcctttccttgcgtgtgttggtcgagatggctacaacagcttacgctcccatggcgagccaggtgatgaagagcagcccggtgcactcgaggccgaggggcctgtcaggcgctgcgctcacgcggccccggccccggttcagcgtcgtcaaggccgccatccagcccgagaaggcaacgtaccaggtggtgcagcccatcaacggcgacccgttcatcggcagcctggagacgcccgtcacctccagcccgctcatcgcgtgatacctctcccaacctgccggcctacccgcaccgcctttgaaccccccctgcttccgggggcgtccaaggtcgggccttcccccacgggctaccctccttcgtcgggggccctttcccggctttcaaccggggcccgttttcccaaaaaaccccccctctcccattggggcccggcccgggaggccccttagggggccccccggggcctcccctgtccattccttcgggggggggggcctccccccagtgtcccgggggaaccccctccttttaaaaaaaggggggaacccctgtccccctg

SEQ ID NO: 59881 - protein, 78 aa, Zea mays
  misc_feature: Ceres CLONE 1517764
MATTAYAPMASQVMKSSPVHSRPRGLSGAALTRPRPRFSVVKAAIQPEKATYQVVQPINGDPFIGSLETPVTSSPLIA

SEQ ID NO: 59882 - DNA, 669 bp, Zea mays
  misc_feature: Ceres CLONE 1517766
  misc_feature: Encodes the peptide sequence at SEQ ID NO. 59883
  misc_feature (326)..(326): n is a, c, t, g, unknown, or other
  misc_feature (328)..(328): n is a, c, t, g, unknown, or other
  misc_feature (340)..(340): n is a, c, t, g, unknown, or other
  misc_feature (368)..(368): n is a, c, t, g, unknown, or other
  misc_feature (369)..(369): n is a, c, t, g, unknown, or other
  misc_feature (370)..(370): n is a, c, t, g, unknown, or other
  misc_feature (371)..(371): n is a, c, t, g, unknown, or other
  misc_feature (372)..(372): n is a, c, t, g, unknown, or other
  misc_feature (373)..(373): n is a, c, t, g, unknown, or other
  misc_feature (377)..(377): n is a, c, t, g, unknown, or other
  misc_feature (379)..(379): n is a, c, t, g, unknown, or other
  misc_feature (380)..(380): n is a, c, t, g, unknown, or other
  misc_feature (381)..(381): n is a, c, t, g, unknown, or other
  misc_feature (382)..(382): n is a, c, t, g, unknown, or other
  misc_feature (385)..(385): n is a, c, t, g, unknown, or other
  misc_feature (386)..(386): n is a, c, t, g, unknown, or other
  misc_feature (387)..(387): n is a, c, t, g, unknown, or other
  misc_feature (388)..(388): n is a, c, t, g, unknown, or other
  misc_feature (646)..(646): n is a, c, t, g, unknown, or other
ctctagaactagtggatcccccgggctgcaggaattcgtctcacccctagaaaaaaagcatctcaagtaatctgagatgcactgctatggaggcacttgttcacccattctttgatgagcttcgagatcctaatactcgccttccaaatggtcgctttttgccaccactattcaatttcaagcctcacgaacttaaaggagtcccatcagacattgtcgcgaaattgattccagaacatgcaaagaagcaatgctcctttcttccattgagaaatgacccccccttgagactttttttttttggttgcaaataggcattttccccngntttttttttccntctccccaaagagaaaagaaaagggggnnnnnncccncnnnnccnnnntttttccctttttttaaaaaaaaaaaaattcccccccccccgggcggggggcgacccccacccgtctcccccctctcctatcacaccgagctcttactccgtaaccccccaccccttaacatacacaatacatccttctccacctatcaccccgccatcttttcacccctccctcccccacatccacaaccctccctcccgccttttccccccaccgagtacccagccccccacatctatccccccctctccaccccntcccgtctccccaccatccccag

SEQ ID NO: 59883 - protein, 75 aa, Zea mays
  misc_feature: Ceres CLONE 1517766
  misc_feature: SWISSPROT Homolog: EC 2.7.11.1 Non-specific serine/threonine protein kinase
MEALVHPFFDELRDPNTRLPNGRFLPPLFNFKPHELKGVPSDIVAKLIPEHAKKQCSFLPLRNDPPLRLFFFGCK

SEQ ID NO: 59884 - DNA, 551 bp, Zea mays
  misc_feature: Ceres CLONE 1517769
  misc_feature: Encodes the peptide sequence at SEQ ID NO. 59885
  misc_feature (396)..(396): n is a, c, t, g, unknown, or other
tccccggcggtggcggccgctctagaactagtggatcccccgggctgcaggaattcgtctcacccctagaaaaagttgtagttgtagtgtaacctagccacacaacgcatccgcggttcatcggcctcgcaggaaacgagcgtcgagcaaaaggtcgaattctcaactctcaagcaccagcaggaatcgagcgagcgagcgagcagtgtccgccccccatggccatggtcgcgtccacctccttcgcgtaccacaagccgcgtttcgcggtggtgtgcaggaagaacagggacggccgggacagggagcgggacggcaaggagcacaagcacctcttcaggtcgtcgagatcacgccgcctccgcggtgcctcggcgtccgctgcttccccaccancatccactgcggcgagagcgtgacgatcgaggggcaggcgtacacgggtgtccgccggtgacgcaccggtaaccagcggcgcaagggggggggaacgaacccgaacgaaaaagggcctttaaggtcttcttccaggggggggaaagctaccccaa

SEQ ID NO: 59885 - protein, 66 aa, Zea mays
  misc_feature: Ceres CLONE 1517769
  misc_feature (60)..(60): Xaa is any aa, unknown, or other
MAMVASTSFAYHKPRFAVVCRKNRDGRDRERDGKEHKHLFRSSRSRRLRGASASAASPPXSTAARA

SEQ ID NO: 59886 - DNA, 662 bp, Zea mays
  misc_feature: Ceres CLONE 1517773
  misc_feature: Encodes the peptide sequence at SEQ ID NO. 59887
  misc_feature (567)..(567): n is a, c, t, g, unknown, or other
  misc_feature (590)..(590): n is a, c, t, g, unknown, or other
ctccccgcggtggcggccgctctagaactagtggatcccccgggctgcaggaattcgtctcacccctagaaaaagcgcaaacatcgaatcgtctcactcgtgtctgccctgctcatactgcttgccctcgccgtatcgtccacccgcaacgcacaggaggattccatggccaacaacaccgggacgttggtgggcggcatccaggacgtgccggggagcgagaacgaccttcacctccaggagctcgcccgcttcgccgtcgatgagcacaacaagaaggccaatgctcttctggggttcgagaagcttgtgaaagccaagacacaagtggttgctggcacgatgtactatctcactattgaagtgaaggatggcgaagtcaagaagctctactaagctaacgtctgggagaagccatgggagaacctcaaggggctgcaggaattcaagcctgttgcagagggtgctatcgcctaaagatgtctccttctccatgtgcgagcctgaagctcatagcaaagttgcagaataaagagccatgctcccttgtgtaatttcatagactancaccctattacggcttggttggntgtgtcctgaatcgaggggaatggaaggggattaattttccttcatctaaaaagaggggttttaatccccct

SEQ ID NO: 59887 - protein, 76 aa, Zea mays
  misc_feature: Ceres CLONE 1517773
  misc_feature (10)..(77): Pfam Name: Cystatin Pfam Description: Cystatin domain
MANNTGTLVGGIQDVPGSENDLHLQELARFAVDEHNKKANALLGFEKLVKAKTQVVAGTMYYLTIEVKDGEVKKLY

SEQ ID NO: 59888 - DNA, 653 bp, Zea mays
  misc_feature: Ceres CLONE 1517777
  misc_feature: Encodes the peptide sequence at SEQ ID NO. 59889
  misc_feature (350)..(350): n is a, c, t, g, unknown, or other
  misc_feature (412)..(412): n is a, c, t, g, unknown, or other
  misc_feature (417)..(417): n is a, c, t, g, unknown, or other
  misc_feature (446)..(446): n is a, c, t, g, unknown, or other
aactctggagctccccgcggtggcggccgctctagaactagtggatcccccgggctgcaggaattcgtctcacccctagaaaaaacgcaggcagaggctgcacagcagcggccaggtccatccatcctctttcgcctcctcgcttcgcttcctcggcggattcctcctccctcggacggccccgtcccctttttcggcgcgcgagctcgcccgagatggccaacgcgacatcgggtgacgctgtgaatgacgagtgcatgctcaagttctgcgagatgcagtcgaagaggctgcagcgcttcctaactttcaagatggacgacaagttcaaggacatcggtgtggaccangtcggggatcgcgctccccgccacgaggagtgcggggggggcctcccctataatgactgccnatccnggatctatgatttccactttgtcactgcngaaaatgtccggaaaaccagatcttctaatcctaggggccccctcctcctccacgtgaaaagaagaaggtttaagccaaattccacaaaaaattcggagggggcctcctggatttcaggggaactgccggcaactgtggcagggtgaataaggctgataaaaaaaaggaaaggcctcgctaggctccggatattgcatcaggggatc

SEQ ID NO: 59889 - protein, 125 aa, Zea mays
  misc_feature: Ceres CLONE 1517777
  misc_feature (45)..(45): Xaa is any aa, unknown, or other
  misc_feature (66)..(66): Xaa is any aa, unknown, or other
  misc_feature (68)..(68): Xaa is any aa, unknown, or other
MANATSGDAVNDECMLKFCEMQSKRLQRFLTFKMDDKFKDIGVDXVGDRAPRHEECGGGLPYNDCXSXIYDFHFVTAENVRKTRSSNPRGPLLLHVKRRRFKPNSTKNSEGASWISGELPATVAG

SEQ ID NO: 59890 - DNA, 668 bp, Zea mays
  misc_feature: Ceres CLONE 1517778
  misc_feature (559)..(559): n is a, c, t, g, unknown, or other
ccccgcggtggcggccgctctagaactagtggatcccccgggctgcaggaattcgtctcacccctagaaaaaaacccactcctgcacgttttctccacttaaattcccccctgagaaaataagacccgtacgttgctcactccatcatactacccctcgcctggctacctgaccgatggagaatctctagcagcagccggaggcgccgtcgccgtcgccttacctcacgacgccgtgtcggcttgtcatcaggtacaggccactgcaggagaggacgacgcaggataaagacgacctcgctgcggggatacaggcttcatctcatgatgcttcatgacgctctgctgctgctggatctgcaacatgtgctgccagtaggcacgcctctagctgtcagatatctctcagtctccggaggctatacgtaccacatacgatgacagaactatcctgctccagcttctgcttcgtgttctgcagcacagatctgcttgacagtattctatcgcccagagctgcattaacacctgatatgattgtctgatgtgatattaatcanggagatctacctcaccttttattagtgctatgaataattctgtcgctgtaccgtagctatagcaagcattccctattgtatcacctgaaatttgaaggggattttaccg

SEQ ID NO: 59891 - DNA, 663 bp, Zea mays
  misc_feature: Ceres CLONE 1517779
  misc_feature (348)..(348): n is a, c, t, g, unknown, or other
  misc_feature (443)..(443): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (584)..(584): n is a, c, t, g, unknown, or other
  misc_feature (596)..(596): n is a, c, t, g, unknown, or other
  misc_feature (599)..(599): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (623)..(623): n is a, c, t, g, unknown, or other
ggagctccccgcggtggcggccgctctagaactagtggatcccccgggctgcaggaattcgtctcacccctagaaaaagtcggcgtccacgacatcggggaccagcggccatgcgtcccctctcctgttgcgctctcgtccgtctccacaatttgtgcagaccaaagacaaagtaagagtgtgctgaaagaagaaattgaccttaaggtggaaccaaacgaaggcgaagtggatctagaaagaagcatttaacgactggccgcaccagaccaaaccgtagcagaactcaactgaaggcaaccgcggtcgcaatgagtcagcaggaatgcagtctatcagatgatgaanagcagaaggaatcccttctcagagagtgaaatacgaaactggtgctttcaaatattttaagatctgatttacatgcattagcatggatatttccnatgcgaccttaatcctgatatgtggtttttgcatttttttttacaacaatgttgccaatggttgatctatgaatccatttttggtggtgnnnnnnnnnnnnnnnnnnnnnnnnnnnnnnnnnnnnnnnnnnnnnnnnnnanaaaaaaaaaaanaanaaannnnnnnnnnnnnnncccccnaaaaaaaaaaaaacccggaacggttgagggtaccccattt

SEQ ID NO: 59892 - DNA, 656 bp, Zea mays
  misc_feature: Ceres CLONE 1517780
  misc_feature: Encodes the peptide sequence at SEQ ID NO. 59893
ccccgcggtggcggccgctctagaactagtggatcccccgggctgcaggaattcgtctcacccctagaaaaactctccccgcgatgctctccctctctctcgcgcgcgcggcgagcgactcgggtagtcggctacggccggcgcccctacgcgagcttcccagctcttcggcaggcccttctccgtcgacgagcacccaggatagatcctgagactccagacctaagcgatggtgggattcagcacccttggacccaagaccacgaacctggtggtggctgggggcctgtcggccttcgtgctcggtgtctactactagatcgtgacagccgtgtgaggcacggacgatgtgcaggtggagatcgacaagttggaggagatgaagaagaaggacgctgccagaaactccagcagaggaggatcatagacacggagcccttcccgtctctgtagtgaactgaacctggatctgcaggctgacgtgatacggtagtcaagtcgcccagtagaccaagaacatgcgtgcctctactgtgcaataagtaatgtgtggtactctttatcacatagagcttgccagcttgtgttataaagagagatgatcccttgaatgtttttgccctaaaataatagtggtcgcaatgcctatcatgccc

SEQ ID NO: 59893 - protein, 29 aa, Zea mays
  misc_feature: Ceres CLONE 1517780
MVGFSTLGPKTTNLVVAGGLSAFVLGVYY

SEQ ID NO: 59894 - DNA, 648 bp, Zea mays
  misc_feature: Ceres CLONE 1517782
  misc_feature: Encodes the peptide sequence at SEQ ID NO. 59895
aagctggagctccccgcggtggcggccgctctagaactagtggatcccccgggctgcaggaattcgtctcacccctagaaaaagccaaaaggcaaaagctccccaacgaagtgcgagcgacccacgtccacacgacacgaaccaccaccaccaaccagcagccgcaccacgcacccagcgcaaagcgatggcgtcgctcaccatgatggcgtccttcgccgccgtggcggtggccgcgccctcgcgccgcggcaccttcgccgtggtcaggtccgccaaggtcgaccgctgccaggagcccgccacgctagcagcaaccgaggccaggcccgccgccgacagacgccgcgccgtcatgctcgcggctgctgcggcggccgtggcagccatcggcggcgccggcgccgcaatggcgggccccaagaacgggacccccgaggcgaagaagaagaacacggccatctgcgtcaccatgcccaccgacaaggtctgccacaactgaacacgcccgcgttgcagctgcagggccgagtaggcgtgacataattaatgtacgtgccagagtgttgttgtccctattgttggttccagctttaaatgcatgcctgactgtgagccgcttaattgctttctgaacgcctcggagct

SEQ ID NO: 59895 - protein, 104 aa, Zea mays
  misc_feature: Ceres CLONE 1517782
MASLTMMASFAAVAVAAPSRRGTFAVVRSAKVDRCQEPATLAATEARPAADRRRAVMLAAAAAAVAAIGGAGAAMAGPKNGTPEAKKKNTAICVTMPTDKVCHN

SEQ ID NO: 59896 - DNA, 671 bp, Zea mays
  misc_feature: Ceres CLONE 1517783
  misc_feature: Encodes the peptide sequence at SEQ ID NO. 59897
tggagctccccgcggtggcggccgctctagaactagtggatcccccgggctgcaggaattcgtctcacccctagaaaaataggccggggcgagcggcctgatcaaaaagaaaggaaacgggtaaattatgagtcactgagtgaataaaacagggtcgatgcgatatttgttgcagctagagggagtgagtttacacatactttcatttctatacactgtatttctgtgtaccggatacggcataccatatcctcccaatctcaactgggaggacgcgtacgcgtctgcggggctcctctccgagctcattccgtccactgcccttccccctcgatgaagaccagcatatacaggacgccatgatggcgccggtgctcacgtctccgatggtgcagccgccgccgccgccgccgccgcatcatgtgcacgacgaaatggaggcgccggacagctgctccaacgtgtcgactgacggggaccgcgccgctacaaccgcccccgccgccgtcggtcaagagaacgggctgcccagtgcggtcgcctactagctagctgcatctgcttgtccgccgactgttttgcatcatcactttcttaccaggcataactgtggcaaacccaacagctagcctacatctaaacaggctaggaatggattatacccttcgtct

SEQ ID NO: 59897 - protein, 62 aa, Zea mays
  misc_feature: Ceres CLONE 1517783
MMAPVLTSPMVQPPPPPPPHHVHDEMEAPDSCSNVSTDGDRAATTAPAAVGQENGLPSAVAY

SEQ ID NO: 59898 - DNA, 655 bp, Zea mays
  misc_feature: Ceres CLONE 1517787
  misc_feature: Encodes the peptide sequence at SEQ ID NO. 59899
  misc_feature (458)..(458): n is a, c, t, g, unknown, or other
ggagctccccgcggtggcggccgctctagaactagtggatcccccgggctgcaggaattcgtctcacccctagaaaaatcgcacgcactcctcatcttatcccccgcctcctccggtcctcccgccgctgttgctcacttctgagtcccgacgcacgagctcccaagagctagccatggcgtccaccaccctctcctccgccttcaccctcctatcccgcccctccacctccccgtgccccgccgcctcgctcccgaggtcctcccacgccgcgccccacatccgccggggccgccgcgccgtcgccgtcgcgtgcaccgccaccgagtcccccaagatcctggagctcggggacgccatcgccgggctcacgctcgaggaggcccgcagcctcgtcgaccacctccaggagcggctcggcgtcaccgccgcggccttcgcgccggccgccgtcgtcncggcgcccggggcgggcggcgggaccgcggccgaagaggaggcccccgtcgagaagacggagttcgacgtgatgatcaaataaggtgcccaccagcgcgcgtatcgcccctatcggggggggtgggcgcgatcaacaggactcgggcttaaagaggcccaggaccattatccaggggcccccccaaaagggccaggg

SEQ ID NO: 59899 - protein, 121 aa, Zea mays
  misc_feature: Ceres CLONE 1517787
  misc_feature (95)..(95): Xaa is any aa, unknown, or other
MASTTLSSAFTLLSRPSTSPCPAASLPRSSHAAPHIRRGRRAVAVACTATESPKILELGDAIAGLTLEEARSLVDHLQERLGVTAAAFAPAAVVXAPGAGGGTAAEEEAPVEKTEFDVMIK

SEQ ID NO: 59900 - DNA, 653 bp, Zea mays
  misc_feature: Ceres CLONE 1517788
  misc_feature (579)..(579): n is a, c, t, g, unknown, or other
tggagctccccgcggtggcggccgctctagaactagtggatcccccgggctgcaggaattcgtctcacccctataaaaaataactctcgtccatctacacgcatacatagttacttctactgctcgacgacaaacatggctcagcctgccaatatcggacagtggggtggataccccggcgatcgtcggtatctgagaggctactccggactcgcctgaccgacgtgaaggtctcggcggacaacgctgctgcatccgctccatctccttcatctacctcggagccgatggcacgccgtacgaggaggggacatggggtttccgccatgctggcacggagtacaacattgatctgtgcaggttccacgagagcttgacggacatctccgggaccacgggcccaacctacaacattgatgatctggtcaagtctctcaaatttgtcaccaacaaacgtacttacggaccgtacggcagggacgagggcaccccgttccgtgtcaaggtgatgaacaacggccacgtcgctggcttctttggccgctctggagatgcctggacgcgatcgggctctacgtncaccgcgactaataactaatacgatggatcggatcatctgcatgcatgcatatgcactatgctgctttgctaac

SEQ ID NO: 59901 - DNA, 650 bp, Zea mays
  misc_feature: Ceres CLONE 1517792
  misc_feature: Encodes the peptide sequence at SEQ ID NO. 59902
tggcggccgctctagaactagtggatcccccgggctgcaggaattcgtctcacccctagaaaaaaccgctatctaggctagtctacagctagtacacgacccacggcaatcgtcgtcgtggtcgtggcggattggagttgacagttgcgataccactagtactagctcgctcgctcgttctcagaactgatcgctgtgaggagtatgccgtcgctgtggccaacgaggaagaagcgggcgcgaggctcggcggtccggtcgtggtcgcgccgccgcgggagcaagaaatcatcgtcgtcgtcgtcgctgggggcgctgtggcggcggatggtcgggccacgcagggggacccggacccggaggcggagccgtgcccgggggaaaaacccggggctgctctcgcgcgccgcgcgggtgctctcctgcggccgccgctcctactgatcgatgcctcccggcgcggacgggccggcgggcatcgaatcgtccgaatcgaaatctggcgtgacttgcgcgcgtgaactttgctctatttccttcgggggggggttgtttacatgcccgcgaaggctggctgtttcccggggcggggtccgacccgggggggggggtaaaatggactcggggtgggggggagaaaccttccggaa

SEQ ID NO: 59902 - protein, 79 aa, Zea mays
  misc_feature: Ceres CLONE 1517792
MPSLWPTRKKRARGSAVRSWSRRRGSKKSSSSSSLGALWRRMVGPRRGTRTRRRSRARGKNPGLLSRAARVLSCGRRSY

SEQ ID NO: 59903 - DNA, 654 bp, Zea mays
  misc_feature: Ceres CLONE 1517793
  misc_feature: Encodes the peptide sequence at SEQ ID NO. 59904
  misc_feature (485)..(485): n is a, c, t, g, unknown, or other
  misc_feature (512)..(512): n is a, c, t, g, unknown, or other
  misc_feature (545)..(545): n is a, c, t, g, unknown, or other
tggagctccccgcggtggcggccgctctagaactagtggatcccccgggctgcaggaattcgtctcacccctagaaaaatcgaatcgtctcactcgtgtctgccctgctcatactgcttgccctcgccgtatcgtccacccgcaacgcacaggaggattccatggccaacaacaccgggacgttggtgggcggcatccaggacgtgccggggagcgagaacgaccttcacctccaggagctcgcccgcttcgccgtcgatgagcacaacaagaaggccaatgctcttctggggttcgagaagcttgtgaaggccaagacacaagtggttgctggcacgatgtactatctcactattgaagtgaaggatggcgaagtcaagaagctctacgaagctaaggtatgggagaagccatgggagaagttcaaggagctgcaggaattcaaacctggttgaagagggtgctagcgcctaaggatgtctccnttctccatgtgcgagcctgaagctcanagcaaagttgcagaataaggagccatgctcccnttgtgtaatttcataagactacaaccctattaaggctttgtttgggttgtgtcctgtatccgagggaatttgaaggtgattaattttccttctatctaaataagagggt

SEQ ID NO: 59904 - protein, 97 aa, Zea mays; identical to SEQ ID NO: 59373
  misc_feature: Ceres CLONE 1517793
  misc_feature (10)..(98): Pfam Name: Cystatin Pfam Description: Cystatin domain

SEQ ID NO: 59905 - DNA, 662 bp, Zea mays
  misc_feature: Ceres CLONE 1517794
ggagctccccgcggtggcggccgctctagaatagtggatcccccgggctgcaggaattcgtctcacccctagaaaaataggcggcttatctgcactctccagttccttgccagtagccacagtctgtactagcagtctcatggatatgagaagatgggtggtagtagacatggctcgcacgcattctgcggaagcggtgtccctggtggccgctgtgctgctgctgggagaggaagtgagtacctaggaggggagctttgcatgaaaccccagtgatatcggccatggagggttgctttgcctaagcatcgcgacatagcgtacgagccctcagcttcttgttgtgacggtgtccttaagctgactagcgcgtgagatcgctccggagattggcacggatcttggatttgagagacgaacggtactggggctgtcagaggcctcagaggcctacacttctcggactgttcgatgaaagtgagctgtgagcattccatactcagtgagtacctctcttgactgctcgaatgtgaattacctctgtatcacgcgtgagaacgcgtaactgattgatccagcaggcattcttgcgttgccgacggatgaatgaggaaacttcaacgcgaatactgtatgcactctattagagagggtcgatgaca

SEQ ID NO: 59906 - DNA, 674 bp, Zea mays
  misc_feature: Ceres CLONE 1517795
  misc_feature: Encodes the peptide sequence at SEQ ID NO. 59907
ctccccgcggtggcggccgctctagaactagtggatcccccgggctgcaggaattcgtctcacccctagaaaatttcttcctcccttcttacagccgccgccgccgcatcccagcctccatcaccgtttccgtctcgttgccatgggtaaggtgcacggatcgttggcgcgcgccgggaaggtccgcgggcagacccccaaggtggcgaagcaggacaagaagaagaagccccgcggccgcgcgcacaagaggatgcagtacaaccgccgcttcgtcaccgccgtcgtcggcttcggcaagaagcgcgggcccaactcctccgagaagtaggcgccgctcggctcgtaccggttcctcatccttcctgctctccgtatgcttatgctcttgatggtactagtttcgttgttcgcaagcagaggaagaaccttctgtagattcggttttgttgtccatgtgctcagatgggaacttgagattgtatgaatttgagatatggtgatatgagctgatgatttttattatgcttattgttgctcctctgagctgttatttttgaacgctatccaaataaatttgaaacaaaaaaaaaaaaaaaacgagacgctcgaggtacccaattcgccctatagtgagtcgtattacgcgcgctcacttggccgtcggttttaaa

SEQ ID NO: 59907 - protein, 62 aa, Zea mays; identical to SEQ ID NO: 6893
  misc_feature: Ceres CLONE 1517795
  misc_feature (3)..(61): Pfam Name: Ribosomal_S30 Pfam Description: Ribosomal protein S30

SEQ ID NO: 59908 - DNA, 651 bp, Zea mays
  misc_feature: Ceres CLONE 1517796
  misc_feature: Translation starting site: 362
aaactggagctccccgcggtggcggccgctctagaatagtggatcccccgggctgcaggaattcgtctcacccctagaaaaagcatctcgcccgccgttcgcgaccttgtacatctcctcgcacctcgcccattcgcttcaccaagggtttaagaccggcggcgatggcggatgaatctggcgcagctgctcacacatgtaacgcgtgcggcggagttcgcctcgaagcacggctgctcctactacgaggaggtaatggagaagaacgagctgtacgtcgttcagcccccccccgtcgagaagtgacgggagctctccaagcagctcttttacacccgcctcgcaagcctaccaggtcgctatgactcaatctggacggagcttgattgtagtcaagcatgtctggaataccaggaaggacctcacggttgaggaccttggcattgccagaccgtttggagtagagctctatgcatggttctgcggaggcgagattgtctgcagaggtttcaccttgaccggctataaggtctagatgatttccactggtcaagacctgctttataattgatactcttagctgaatgcttgtcgaacgacgacgatggtccctgccttggctcacaattttgtatctttggaagagtttag

SEQ ID NO: 59909 - DNA, 673 bp, Zea mays
  misc_feature: Ceres CLONE 1517797
  misc_feature (564)..(564): n is a, c, t, g, unknown, or other
aagctggagctccccgcggtggcggccgctctagaactagtggatcccccgggctgcaggaattcgtctcacccctagaaaaagcagaggccgccacgcgctctcgtcccttctcaacccctccttctcctccgctccccccgcgcggcgcggaagagagaccaaaggggacggcagccaggaaggaagaggaggcttcgagatttttgcggaacccccacgccacccccctctgcacaccaccacaaccttctcctcatagcctgcctctcgcgtagggtttgcgcgcgccaccgtctccactccaatcccagcaccacccgtcctaccgccgccgcattcggagctctgcatctgcctgcagcccgattcgccaatcgccaccgagcctcgagaagcctcgccgtaccggtttggggatttctggtttccctttctcactgttactgttgctgggatctgaggagtgtttgtattggtgctaattgtttctgccgatgtgcgcgtgattatccaggctgagtggtattggtgatgtcggctgatagaatttggggtgatggntaaaagggggaatcgtttttttattaaagaggggggaaccttggggaagtcatacttcccgggcattggaaatggggcatccctggacgaagactgcgtccctcgaaat

SEQ ID NO: 59910 - DNA, 652 bp, Zea mays
  misc_feature: Ceres CLONE 1517800
  misc_feature: Encodes the peptide sequence at SEQ ID NO. 59911
  misc_feature (429)..(429): n is a, c, t, g, unknown, or other
  misc_feature (430)..(430): n is a, c, t, g, unknown, or other
tccccgcggtggcggccgctctagaactagtggatcccccgggctgcaggaattcgtctcacccctagaaaaagcacggcgcacaccatggccgctgccttagcttcgcttctccacctcgcgaccccgacccagactcgctccactcacctcgccgtccgcctccccagcgcccagctgccgcgctggccgtcggggtcacgcatcgccgccgcgcagccgccgcgggcgtacaaggtgacgatcgagcacggcggcgagtcgcgggtggtggaggtggaggaggacgagacgatcctgtcccgcgcgctggacgagggcctggacgtgccgcacgactgcaagctcggcgtgtgcatgacgtgcccggcgcggctggtctccgggacggtggaccagagcgacggcatgctcagtgacgacgcgtcnncgcggggggtacgcgctgctatgcggcgcgtacccgcgcctcgactgcaccatccgcgtcatccccgaggacgagctgctcaaagtccagctcggcaccggcgaacgactgacgccccgccgatgacccgcaggcatcaaccctcggcggggaaaggatgctggccccggggaactgtaccccattgttgactaagtaacccctaggggaagagcttttttc

SEQ ID NO: 59911 - protein, 177 aa, Zea mays
  misc_feature: Ceres CLONE 1517800
  misc_feature (53)..(128): Pfam Name: Fer2 Pfam Description: 2Fe-2S iron-sulfur cluster binding domain
  misc_feature: SWISSPROT Homolog: EC 1.14.12.7 Phthalate 4,5-dioxygenase
  misc_feature (115)..(115): Xaa is any aa, unknown, or other
MAAALASLLHLATPTQTRSTHLAVRLPSAQLPRWPSGSRIAAAQPPRAYKVTIEHGGESRVVEVEEDETILSRALDEGLDVPHDCKLGVCMTCPARLVSGTVDQSDGMLSDDASXRGVRAAMRRVPAPRLHHPRHPRGRAAQSPARHRRTTDAPPMTRRHQPSAGKGCWPRGTVPHC

SEQ ID NO: 59912 - DNA, 656 bp, Zea mays
  misc_feature: Ceres CLONE 1517801
  misc_feature: Encodes the peptide sequence at SEQ ID NO. 59913
  misc_feature (342)..(342): n is a, c, t, g, unknown, or other
  misc_feature (496)..(496): n is a, c, t, g, unknown, or other
  misc_feature (539)..(539): n is a, c, t, g, unknown, or other
  misc_feature (574)..(574): n is a, c, t, g, unknown, or other
  misc_feature (575)..(575): n is a, c, t, g, unknown, or other
  misc_feature (585)..(585): n is a, c, t, g, unknown, or other
gcggtggcggccgctctagaactagtggatcccccgggctgcaggaattcgtctcacccctagaaaaagggttgtggcctcctatccttgcacgcacacgcaaacgcatcccatcctgtcctcgcgttactactagttagttagagagacagagaggatcgatctgctggcggcgtctaagctggagaaaggcggcgccaccgccgagggcgacgagataggcatcgacccagcggcggagactccggagcagcgcaacaagttcctggtcctccgcctgtacgaggcgctcaacgcccgggaccacgccgccgtgcagtcgctgctggcgcccgacctggnagtggtggttccatggcccgcccaagcaccagcagcacatgatgcgcctcctgacaaccaccaccaccaccaccaccggcagcttccgcttcgtgccccgctccgtggacgccctcgccgcctcgtccggcaccgtgatcgccgagggccacgnagaggggttgctactgggtgcacgcctggaccgtgggacccgnattggggtgatcaccccagctcccgtgagtacttnncacaccgacntcaccgtcacccgcctcggccgccgccgtcgccgccaaaatggcgtcttggcagagcccgccgcccccgac

SEQ ID NO: 59913 - protein, 92 aa, Zea mays
  misc_feature: Ceres CLONE 1517801
  misc_feature (39)..(39): Xaa is any aa, unknown, or other
  misc_feature (65)..(65): Xaa is any aa, unknown, or other
  misc_feature (69)..(69): Xaa is any aa, unknown, or other
MMRLLTTTTTTTTGSFRFVPRSVDALAASSGTVIAEGHXEGLLLGARLDRGTRIGVITPAPVSTXHTDXTVTRLGRRRRRQNGVLAEPAAPD

SEQ ID NO: 59914 - DNA, 685 bp, Zea mays
  misc_feature: Ceres CLONE 1517810
  misc_feature: Encodes the peptide sequence at SEQ ID NO. 59915
  misc_feature (515)..(515): n is a, c, t, g, unknown, or other
ctccccgcggtggcggccgctctagaactagtggatcccccgggctgcaggaattcgtctcacccctagaaaaagacgcgagaaggcagggggagagaaaatggcgtatttgtcccgcacagccgccgccgtcgccgtcgccgtgaggtcggcggtccgctccgcacctctcactggccgcgtcctcggagcgccactgccttcccttgcctcgccttccgctgcccggtccgcccgaatcctccgcaggacggcggccgcggcgtcggcggggctggagactctaatgccgctgcacatcgcggtggcggccgcgcggcttaagtcctgcatcgccgtcgactcctcgtgctggagctcgctctcgcaaggtttaaacaagcgcatctgatcatggctaggagctgagcacagaagagaagtgaggacaacgagttagaacgaagtcatctcttttgcagatatttgtaacatgtactacttttggttggtgctctatgtgtttgctcatgtcntcaaatggagcatgcaaaaattgtcccttggaaccttgcttgggctcctatttttcaggttgggtcatggagctatgcttgaaggaaaaaaacttggaccttataataaaaaaaaaacactttcagttaaaaaaaaaaaaaaaaaaacgaaaaaccttggagggtcccca

SEQ ID NO: 59915 - protein, 96 aa, Zea mays
  misc_feature: Ceres CLONE 1517810
MAYLSRTAAAVAVAVRSAVRSAPLTGRVLGAPLPSLASPSAARSARILRRTAAAASAGLETLMPLHIAVAAARLKSCIAVDSSCWSSLSQGLNKRI

SEQ ID NO: 59916 - DNA, 643 bp, Zea mays
  misc_feature: Ceres CLONE 1517812
  misc_feature: Translation starting site: 468
ctccccgcggtggcggccgctctagaactagtggatcccccgggctgcaggaattcgtctcacccctagaaaaaaccaccactcatcaccaccagctgccattgccatctactgacctgtgacctccgcatttccaaacagcccgagcgagcgagctaacagagcggcggcaggcacctccctcctcaaggaacatggcccgcacgcagcagttggcagtactggcggcggccgtggtggccttgtgctgtcctggcgggcggcgacatcggaggcggccatcacctgcgggcaggtggcgtcggccatcgcgccctgcatctcctacacgcgcgggcagggctcggggccctccgccggctgctgcagcggcgtcaggagcctcaacaacgccgcccgcaccaccggcgagcggcgcgccgcctgctactgcctcaagaacgccgccgccggcgtcagcggcctcaatgccggtgacgccgccagcatcccctccaagtgcggcgtcaggatctgctagaccatcagcacctccaccgactgactccagggtgaagtgaacccgtaacgacgacgacagcgccggcagccgcctgaacacgatccatatctatcccgccgtcatcgggggcctgcggttcaa

SEQ ID NO: 59917 - DNA, 665 bp, Zea mays
  misc_feature: Ceres CLONE 1517813
  misc_feature: Encodes the peptide sequence at SEQ ID NO. 59918
  misc_feature (211)..(211): n is a, c, t, g, unknown, or other
  misc_feature (485)..(485): n is a, c, t, g, unknown, or other
  misc_feature (502)..(502): n is a, c, t, g, unknown, or other
  misc_feature (547)..(547): n is a, c, t, g, unknown, or other
  misc_feature (552)..(552): n is a, c, t, g, unknown, or other
  misc_feature (602)..(602): n is a, c, t, g, unknown, or other
  misc_feature (605)..(605): n is a, c, t, g, unknown, or other
  misc_feature (623)..(623): n is a, c, t, g, unknown, or other
ctccccgcggtggcggccgctctagaactagtggatcccccgggctgcaggaattcgtctcacccctagaaaaagcgcacctccctttccccaactcgatctcgcacctagggtttcgtctcgccgctctcgtcctccgcgaagatgccgaagaacaagggtaagggaggcaagaaccggaagcgaggaaagaacgaggctgacgacgacnagcgcgagctcgtcttcaaggaagacgggcaggagtacgcgcaggtgacccggatgctcggcaacgggcggtgcgaggccatctgcgtcgatggcacgcgccgcctctgccatatccggggtaagatgcacaagaaggtctggatcgcggctggggacatcgtcctcgtcggcctccgcgactaccaggacgacaaggccgacgttatcctcaagtacatgaacgacgaggcgcgcctgctcaaggcctacggggagcttcctgacacgctcangctcaacgagggcgtcnaacgtcgatgggccccgaggaagggcgaggagggcagcgactacntccangttcgaggacgagggacatcgacagatctaagaaatctgttcctgcttancgntacctggtattgtaaccntgacgcggtcttctgctttctgctggcgggtacttttatggt

SEQ ID NO: 59918 - protein, 173 aa, Zea mays
  misc_feature: Ceres CLONE 1517813
  misc_feature (30)..(94): Pfam Name: eIF-1a Pfam Description: Translation initiation factor 1A / IF-1
  misc_feature (23)..(23): Xaa is any aa, unknown, or other
  misc_feature (114)..(114): Xaa is any aa, unknown, or other
  misc_feature (120)..(120): Xaa is any aa, unknown, or other
  misc_feature (135)..(135): Xaa is any aa, unknown, or other
  misc_feature (136)..(136): Xaa is any aa, unknown, or other
  misc_feature (153)..(153): Xaa is any aa, unknown, or other
  misc_feature (154)..(154): Xaa is any aa, unknown, or other
  misc_feature (160)..(160): Xaa is any aa, unknown, or other
MPKNKGKGGKNRKRGKNEADDDXRELVFKEDGQEYAQVTRMLGNGRCEAICVDGTRRLCHIRGKMHKKVWIAAGDIVLVGLRDYQDDKADVILKYMNDEARLLKAYGELPDTLXLNEGVXRRWAPRKGEEGSDYXXVRGRGTSTDLRNLFLLXXTWYCNXDAVFCFLLAGTFM

SEQ ID NO: 59919 - DNA, 541 bp, Zea mays
  misc_feature: Ceres CLONE 1517814
  misc_feature (541)..(541): n is a, c, t, g, unknown, or other
ggagctccccgcggtggcggccgctctagaactagtggatcccccgggctgcaggaattcgtctcacccctagaaaaatccccccactacccggacttttcgggggcgcactaccatctccttgaccgtccgaagatggtgaagttcctcaagcccggctaaggccgttatcctcctccagagccggatagcggacggaagcagtagtcggcgcgtataaatgaggctaccgtgatagatcctacaggcatgactagttccgggctcgctcagtacccgggaaggagtccccagagactccgccatgatattgccatgaaagccgctggaggaggttcatcaggttcgtgaatttcacgtccctaagggcccaaccgttacatccttgacttcggactttggggaaggaaccaatgggggagggccaaacctctctttgccccagggaaaaaaaaagtccaaatccgcccagggcctccaaaggtgcccctccaggagaaaggtgtttaaaaaagaaaaaaaaatgttttttctttttcan

SEQ ID NO: 59920 - DNA, 902 bp, Zea mays
  misc_feature: Ceres CLONE 1517814-R
cctcgagcgtctcgtttgtctaggtttttttgagctctggatctatctttattaaacaaaaactttggaataatgatctttccaaagcgtatactgacataaagctgataatttgtaattatctccttgagagttcaagagtcaggcctgggcatttgtaaggctacacaagaaattatatgaagtgctagttcatagcgtttagacaagtaacgacccctcacaacagggacgacatggaggaaagatacacctctcgaggtggatgcctttgcggtcttgtgatcagcgagctgcttaacagcataaaagagcctttgttgcaatggaggaatgccttatttctcttcaatacgctcggtgatcctgtcaatcgagtcagtgggttcaatgtgtggcccgatctctttcacactgagaattttgaccttaatcatggttccacccctaagtctggggaccaaatgaagagtacactgctttgggatgttgtagtcagccagcgtgcgtccaggctccacctgcttgccaggcaatatcagtcgctgttgatcttggggaatcccttcctagacctggattatcgtcttgagcataataaacgggatcccttctagaacaacatgagggaggtggtcttaatctgttcaggttctttccaagagattagaaaaattttctgcggctcatgggggattcgccaggtatttaaagaggccgtgaaccaaaattggagactttcgcgttttgatgccccaataaataggggaaaaagaaaattcccgttttgcgctaaacaggtttattttcacggggtgtaagaggagaaagtcgggctatgacggaggagagaagatactgggttacaattatgggagtacatactgagaatgctaatgaaa

SEQ ID NO: 59921 - DNA, 628 bp, Zea mays
  misc_feature: Ceres CLONE 1517920
  misc_feature: Encodes the peptide sequence at SEQ ID NO. 59922
aaagctggagctccccgcggtggcggccgctctagaactagtggatcccccgggctgcaggaattcgtctcacccctagaaaaaacgacatctcgtgtctctgttgggagcttcttcaacatctcgtctctctcatcctccgacgccatccgctcccgccccggccgagccgcgcgttgtgtatggattccaaaagcaatcatacaggggctatggcgaggccttacaaacctaagaatatccacgaaggcagaaccgcattctcgcgtcggcttgcttttaactgaatccagcccaccgcttctcgcacgtcgccatggacgcggtcgattctgtggtggatcccctccgcgacttcgccaaggacagcgtccgcctcgtcaagcgctgccacaagcctgaccgcaaggagttcaccaaggtggcagcgcggacggcgatagggttcgtcgtcatgggcttcgtcggcttcttcgtcaagctcatcttcattcccatcaacaacattatcgtcggttccggctaggctcagggcgcgactagcatgggagtagtgcgatacttttgagagcaagggatagcgaggatcttggtctttggaatagtattgttaatgacattttttttc

SEQ ID NO: 59922 - protein, 69 aa, Zea mays; identical to SEQ ID NO: 55155
  misc_feature: Ceres CLONE 1517920
  misc_feature (10)..(66): Pfam Name: SecE Pfam Description: SecE/Sec61-gamma subunits of protein translocation complex

SEQ ID NO: 59923 - DNA, 657 bp, Zea mays
  misc_feature: Ceres CLONE 1517923
  misc_feature: Encodes the peptide sequence at SEQ ID NO. 59924
ggagctccccgcggtggcggccgctctagaactagtggatcccccgggctgcaggaattcgtctcacccctagaaaaaatacgccgccatattcgcaagccaccgcaaccgaagcgcgccttcaccgccgcccccgcacccgccacctctgcgatccccgcaaggtcgcaaacatgtctaccgtgctccagcgcccgacccccggcacggtccagtgcttcagccgcaagaagacagctgtggccgtcacctacaccaagccggggcgcgggctgatcaaggtgaacggcgtcccgattgaactcatcaaggcggagatgctccgcctcaaggccttcgagcccatcctgctggcggggcgctccaggttcaaggacatcgacatgaggatccgcgtccgaggcggctggaagacgtcacatatctacgccatccgccaagccgtcgccaaggggctcgtcgcctactaccagaagtacgtcgactaggccgcctagaaggaggtcaagtacatcttcacccggtacgaccgcacccttcacgtcgccgaccccatgcgctgcgagccgaaaaagtcagaggtcgtggcgcccgcgccagtttcagaggtcctactgttgagcgctcggctgcccgctcatgacggacagtgcctgt

SEQ ID NO: 59924 - protein, 104 aa, Zea mays
  misc_feature: Ceres CLONE 1517923
  misc_feature (17)..(105): Pfam Name: Ribosomal_S9 Pfam Description: Ribosomal protein S9/S16
MSTVLQRPTPGTVQCFSRKKTAVAVTYTKPGRGLIKVNGVPIELIKAEMLRLKAFEPILLAGRSRFKDIDMRIRVRGGWKTSHIYAIRQAVAKGLVAYYQKYVD

SEQ ID NO: 59925 - DNA, 885 bp, Zea mays
  misc_feature: Ceres CLONE 1517929
  misc_feature (1)..(1): n is a, c, t, g, unknown, or other
  misc_feature (2)..(2): n is a, c, t, g, unknown, or other
  misc_feature (21)..(21): n is a, c, t, g, unknown, or other
  misc_feature (43)..(43): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (281)..(281): n is a, c, t, g, unknown, or other
  misc_feature (291)..(291): n is a, c, t, g, unknown, or other
  misc_feature (296)..(296): n is a, c, t, g, unknown, or other
  misc_feature (306)..(306): n is a, c, t, g, unknown, or other
  misc_feature (344)..(344): n is a, c, t, g, unknown, or other
  misc_feature (345)..(345): n is a, c, t, g, unknown, or other
  misc_feature (350)..(350): n is a, c, t, g, unknown, or other
  misc_feature (403)..(403): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (425)..(425): n is a, c, t, g, unknown, or other
  misc_feature (435)..(435): n is a, c, t, g, unknown, or other
  misc_feature (452)..(452): n is a, c, t, g, unknown, or other
  misc_feature (455)..(455): n is a, c, t, g, unknown, or other
  misc_feature (458)..(458): n is a, c, t, g, unknown, or other
  misc_feature (498)..(498): n is a, c, t, g, unknown, or other
  misc_feature (519)..(519): n is a, c, t, g, unknown, or other
  misc_feature (526)..(526): n is a, c, t, g, unknown, or other
  misc_feature (527)..(527): n is a, c, t, g, unknown, or other
  misc_feature (530)..(530): n is a, c, t, g, unknown, or other
  misc_feature (532)..(532): n is a, c, t, g, unknown, or other
  misc_feature (535)..(535): n is a, c, t, g, unknown, or other
  misc_feature (561)..(561): n is a, c, t, g, unknown, or other
  misc_feature (579)..(579): n is a, c, t, g, unknown, or other
  misc_feature (587)..(587): n is a, c, t, g, unknown, or other
  misc_feature (599)..(599): n is a, c, t, g, unknown, or other
  misc_feature (625)..(625): n is a, c, t, g, unknown, or other
  misc_feature (631)..(631): n is a, c, t, g, unknown, or other
  misc_feature (636)..(636): n is a, c, t, g, unknown, or other
  misc_feature (664)..(664): n is a, c, t, g, unknown, or other
  misc_feature (678)..(678): n is a, c, t, g, unknown, or other
  misc_feature (685)..(685): n is a, c, t, g, unknown, or other
  misc_feature (721)..(721): n is a, c, t, g, unknown, or other
  misc_feature (741)..(741): n is a, c, t, g, unknown, or other
  misc_feature (751)..(751): n is a, c, t, g, unknown, or other
  misc_feature (770)..(770): n is a, c, t, g, unknown, or other
  misc_feature (794)..(794): n is a, c, t, g, unknown, or other
  misc_feature (800)..(800): n is a, c, t, g, unknown, or other
  misc_feature (801)..(801): n is a, c, t, g, unknown, or other
  misc_feature (828)..(828): n is a, c, t, g, unknown, or other
  misc_feature (868)..(868): n is a, c, t, g, unknown, or other
  misc_feature (879)..(879): n is a, c, t, g, unknown, or other
nngggggcggtgggataattncgggccaaagggtgagtgtctntctcnnnnngggggnnnnnggaaaagtggggctccccgcggtggcggccgctctagaactagtggatcccccgggctgcaggaattcgtctcacccctagaaaaaggtggccaacgcctgcggcaactgcccgaccccaacgcccccggtcgagccaccgccgccgcctcctgctgctacccctcccccttcgtgcagcgggaagtgcccgctgaacgcgctctagttcggcgtgtgngccgatgtgntcggnctccctctangctaagctggccaggggcctgccgagccttggtgtacnnttttngtggggccttgggtgatttgttggcgggggttgggggttctgggggggcgggnggaggggggggagggnnnnggntgaacggcgnttccgggggccgccccncanctngtgagggggcgccgctcgtttaatcctgcgtggtgagtgntagttgtgtgttgtggcaccnaaaagcnnccntnaanggcgagctgccagacccccccgcgcngacgcctgtgccgcaggnagcgagcnaaccaaccgcanaccgcccaccatcttcgtaggcgccntacatncacanctgcacgatcctaacacggaccacaganctcgaacccggccnagcgagncaggcaagactctaaccagtaccacaagcggagtcnccggacagacaaacaaaccncacgcccgcntacaacaccaacaatgggnaccaggcggccaccaccacggacnggaccnntctcacccgcgaactccgcagacaaanagagagaaaaacgtcccttctctcgccccaagacacagcncccaagacaanaaagtg

SEQ ID NO: 59926 - DNA, 624 bp, Zea mays
  misc_feature: Ceres CLONE 1517935
  misc_feature: Encodes the peptide sequence at SEQ ID NO. 59927
agtggatcccccgggctgcaggaattcgtctcacccctagaaaaagcctccgctcgccaccatcgtgtaggttaggctaggttcgaccagctagcggaaatggtggccttcaggttccatcagtaccaggtggtggggcgcgcgctgccgacgcccggcgatgagcaccccaagatctaccgcatgaagctctgggccaccaacgaggtccgcgccaagagcaagttctggtacttcttgaggaagttgaagaaggttaagaagagcaacggccaggtcctggccatcaacgagatctttgagcgtaacccgacgacaatcaagaactacggcatctggctgcgctaccagagcagaaccggataccacaacatgtacaaggagtaccgcgacacgaccctgaatggcgctgtggagcagatgtacaacgagatggcctctcgccaccgcgtgaggtccccctgcatccagatcatcaagactgcgacggtgcacttcaagctctgcaagaggggacacactaaacagttccacaacagtgagatcaagttcccgctcgtgcaccgcaagggccaggccgcccaccaggaagctgaagaacccgttccaggcttccaaggccca

SEQ ID NO: 59927 - protein, 175 aa, Zea mays
  misc_feature: Ceres CLONE 1517935
  misc_feature (5)..(172): Pfam Name: Ribosomal_L18ae Pfam Description: Ribosomal L18ae protein family
MVAFRFHQYQVVGRALPTPGDEHPKIYRMKLWATNEVRAKSKFWYFLRKLKKVKKSNGQVLAINEIFERNPTTIKNYGIWLRYQSRTGYHNMYKEYRDTTLNGAVEQMYNEMASRHRVRSPCIQIIKTATVHFKLCKRGHTKQFHNSEIKFPLVHRKGQAAHQEAEEPVPGFQGP

SEQ ID NO: 59928 - DNA, 636 bp, Zea mays
  misc_feature: Ceres CLONE 1517945
  misc_feature: Encodes the peptide sequence at SEQ ID NO. 59929
caaagctggagctccccgcggtggcggccgctctagaactagtggatcccccgggctgcaggaattcgtctcacccctagaaaaaatccactctcaccatcaccagctaataacaagtcttcttctcaataatgaaacgaaaaacagggcagctcaggtgctgttacgtcgccatcgtgctcgtcctgggtcttgtccttaagcagtcccagcaggctgaatctagatgcaaatggagctgcgaaaccgccaccggaaaataccattttaatcgctgcgttgactcgcgttgggtctacaatattgggttctgtgcgactaatgccggttgcatcattatgaaagacagatgtggaggtcgatggccagcgactgctcgtgatgcgcttactctggatgtcatttgattaattataagcaagaacatcaagttaagaaacgacgaccagaccactgtcgtccagcgattgattatttgtgaacttgtaactcgtcttattatttcaactttccaatcaaccccttcatgtaatcgtgtcctccccttcacagcttgtcgactgttgagtaatcaaatctatatatcaaataaagacggcaaccctacgtgtaacaaacacatagaaaacgacacgc

SEQ ID NO: 59929 - protein, 91 aa, Zea mays
  misc_feature: Ceres CLONE 1517945
MKRKTGQLRCCYVAIVLVLGLVLKQSQQAESRCKWSCETATGKYHFNRCVDSRWVYNIGFCATNAGCIIMKDRCGGRWPATARDALTLDVI

SEQ ID NO: 59930 - DNA, 648 bp, Zea mays
  misc_feature: Ceres CLONE 1517946
  misc_feature (484)..(484): n is a, c, t, g, unknown, or other
ggagctccccgcggtggcggccgctctagaactagtggatcccccgggctgcaggaattcgtctcacccctagaaaaagtgctttcttagaggtgggttggcttctcctccccctccggttcgggttcgagttcgtgtaggttatccagggttccctttgcgggggcctaggtttacgacaagttgggctcggatgatcgataccggctgctttttcggcggactcgactgagccttggacgatcactccctccaaacagccttcagcacctagggggagattttttactttttgaccatcctcgatcatgagacttttaggacccgcgttcttcggctacaagccttctcccggatgacgctatgcgataaaacgttatggcatgaacgcaaggggctggaggaagccactcaggtgcacacgccagtccccggcggccccggccgctgcttggtgggtaagtggtggccgtggaggaagagnataagggctggcaaacgccattattggatggcggctacggcggtggccgcggctacaaagaccgccggtgctacctttgccgaggcagcagctacgagcaaggtaaccgtggcggctgctacggctattcctatgggaactgaacgatctgaccggtgaggacg

SEQ ID NO: 59931 - DNA, 647 bp, Zea mays
  misc_feature: Ceres CLONE 1517948
  misc_feature: Encodes the peptide sequence at SEQ ID NO. 59932
aaagctggagctccccgcggtggcggccgctctagaactagtggatcccccgggctgcaggaattcgtctcacccctagaaaaaagcagcctcccgaatccccaaagcctccgacccccttcctctctccctccgccgccgctgcgcacgcagggaacaagcgacatgggcgtctacaccttcgtgtgccgcaacaacggcggcgagtggaccgccaagcagcactccggcgagatcgaggcttccgccgctaccccatacgagctgcagcgccgcctcgtcgccgctgcctccgcggccgactctgcctacggcgtccagtcgtccttctccatggtcacccccagctccgccgtgttccaggtgatcgtcggtgctgttggtggtggtgcaatgatggtgagcggaggtggcggcggtgctgctgcatctggtggtgctgctgccgaggctcccaaggaggagaagaaggaagaggagaaggaagagagcgacgacgacatgggattctccctgttcgactagagttgtgtgtgtcatctggatctcagaagtggtggtttggtcctgttgccgtagttaattttgctgtcctgtctgtgaacctgaagacccctggtaattgtacaagccacctgttccagtta

SEQ ID NO: 59932 - protein, 119 aa, Zea mays; identical to SEQ ID NO: 5034
  misc_feature: Ceres CLONE 1517948
  misc_feature (25)..(118): Pfam Name: Ribosomal_60s Pfam Description: 60s Acidic ribosomal protein

SEQ ID NO: 59933 - DNA, 660 bp, Zea mays
  misc_feature: Ceres CLONE 1517950
  misc_feature: Encodes the peptide sequence at SEQ ID NO. 59934
  misc_feature (327)..(327): n is a, c, t, g, unknown, or other
ctccccgcggtggcggccgctctagaactagtggatcccccgggctgcaggaattcgtctcacccctagaaaaaaacccatgtgcgtttagcatcaattcatcagctagaagttcgaaatgggggtcaagtttttagtccttctcggtgttgtcctggcctctcttgtcttccaggacgtggcatttgctagagagctcactgaggccaataatgaggatgagggaaagaacatgaaacaaggaggaatgactgaattaaaggatgagaaatggggaggtggatataatggaggatatggatatgaggtggggggattggtggttgnatatggaaaaccgggctatggtggtggatatgggtgggaggatacaggcccaaatatggcaggggctacaggtccggatatggatacggtggcgggtatggtggaggatacggtggcggttatggtgggggatatggtggcggtggtggctatggagaaggtggaggctttggaggtgggcatgggtggtggtccctatcctgttggtgcagggcaccatggcggcggagggcacccatgtggatggaattaagaaacatgtgctcaaaaagtttctctatgtccgataaccaaaaatggggacaaaaatgttgaatgccacatgtaggtccg

SEQ ID NO: 59934 - protein, 153 aa, Zea mays
  misc_feature: Ceres CLONE 1517950
  misc_feature (1)..(154): Pfam Name: GRP Pfam Description: Glycine rich protein family
  misc_feature (70)..(70): Xaa is any aa, unknown, or other
MGVKFLVLLGVVLASLVFQDVAFARELTEANNEDEGKNMKQGGMTELKDEKWGGGYNGGYGYEVGGLVVXYGKPGYGGGYGWEDTGPNMAGATGPDMDTVAGMVEDTVAVMVGDMVAVVAMEKVEALEVGMGGGPYPVGAGHHGGGGHPCGWN

SEQ ID NO: 59935 - DNA, 641 bp, Zea mays
  misc_feature: Ceres CLONE 1517954
  misc_feature: Encodes the peptide sequence at SEQ ID NO. 59936
aaagctggagctccccgcggtggcggccgctctagaactagtggatcccccgggctgcaggaattcgtctcacccctagaaaaactcctccactcttctccttcactgtcgcagccgccccttgtaaaaccttctagggctgctgctgctgcgcccatggccggggaaggcaagacgccgtccctcgccgaggagtattcccttccaccacaggaggttccggtggaaaaggcagctgaggacaagccctctagtggtactgagtctgaagctgctccctcaaccaatgatgagactcctccatctgtagaagacaaaaatggaacttctgaactacaagatgctgctgagaatccagatgcagagcaaactaacactgctgcagaagatacacctgctgtagaggaagccagtgagactacctcaggacgaagatgctgcaaaacctgagatcatgatcgaaacagctcccgcagatgtttcgtttcccaacaacgaaccaccacaagggattgtttcacacgctatgttgaatatcacaggtgtgtggctgctcaaggtgaggatgcacctgaatgtgataagttcgcccagtactatcgatccctgtgcccaggtgaatgggttgatctctggaacta

SEQ ID NO: 59936 - protein, 97 aa, Zea mays
  misc_feature: Ceres CLONE 1517954
  misc_feature: SWISSPROT Homolog: EC 2.7.11.1 Non-specific serine/threonine protein kinase
MAGEGKTPSLAEEYSLPPQEVPVEKAAEDKPSSGTESEAAPSTNDETPPSVEDKNGTSELQDAAENPDAEQTNTAAEDTPAVEEASETTSGRRCCKT

SEQ ID NO: 59937 - DNA, 659 bp, Zea mays
  misc_feature: Ceres CLONE 1517957
  misc_feature: Translation starting site: 427
ggagctccccgcggtggcggccgctctagaactagtggatcccccgggctgcaggaattcgtctcacccctagaaaaaatcggaccccccgcggagacgacaagaggcgcatttccccgagcgcgtttagataaaagttacctacctggtgcacaccgccgtggcggccgccgtgaacatccgtgagcgatactcctaggggcaggccgcggccccagttggccctcctgcctcctctggcgcgcgaccccctgccaccttttcttctgccatgcagccaggctctccctgctccgtgcgacgcgccgcttccgagacacataccacctccgcggacgagttgatacaggacctgtgatccaactgctactccggtgacgacaatgacgccgtcatcttgtaccgtagcggcggcgtctcccgctgatggttgacgtcctggtctgtgtgcgccatccccgcatgactgtgctcgcaccgatcctgcacctcgatgggatcagctgcacctgctggaccacgtgccgctgccctctcttaaatgcaagcaggacagcagcttgccttggcactctggctatcctgaaaaaaaaaaataactgggagcacgactcaagcgctcactggttcaggctctagaagcgagccctttacttcct

SEQ ID NO: 59938 - DNA, 896 bp, Zea mays
  misc_feature: Ceres CLONE 1517957-R
tcctcgagcgtctcgtttttttttttttttttgccaacccagaaggcagagttatcttccatcggtctttctatacatttggaactacatcgcttctacatacatagtgcacgtaaccttcactttgtgatgcatatatatattccagcacacaatacttgcggcaataatagtactcaaatcattgcatattaggttctccgatcaaatagatctctttgtgaggcatacacaggactctcctaaagttctccataagcgtttgattcatgatccatgcgtatgttcttttctttaacgtctgaatgtgtgctgccaactgtttcctgcttatcattaacgagaacgaagtggtagaccaaccaacccgagtatcctaccccaactagctccacaatcttggggagcagcggaaccccggctcatggcgtcgatgaacaccgacgtcagccatagggcgacgacggcgccgccgccgtacaagaggaccgtgggcttgtccttcaaacgcgtcccacttggctttgaggtccctcgaatcaactcatccccggatgtctctaatcttgtgcctggaacacggttcttttcaaccgaggaggaagagcctcggtgcatctttgggaattcaaactgggcaaaacttcttcgctcctaggaaagaagggcagcaccgcagaatcctagggtagccccacctccccccaagaaacgcccccggaataatccgattggtccccatgccacattttcctccacactaagctcacacctgtatgcgctatcagcccccccacccctttttcttgtaaacgaaaaatattagcggggccttataaaattttccccgtatatagcgtttataccgaaatttttttctccccccctcggggtaa

SEQ ID NO: 59939 - DNA, 642 bp, Zea mays
  misc_feature: Ceres CLONE 1517961
  misc_feature: Encodes the peptide sequence at SEQ ID NO. 59940
  misc_feature (642)..(642): n is a, c, t, g, unknown, or other
acccgcggtggcggccgctctagaactagtggatcccccgggctgcaggaattcgtctcacccctagaaaaagtccccgtctcaccgcactgccttgccccctactctgcctcgcttagcttagccgccgctgctacgcactctcgccgtccttgttcccgcgtcgctctgctcgcgatggcgtcccgcgttgcagtgctgctcgtggccgtggcggccgtgctgttcgccgcggcgtcggcgcatgagatggacctgggcgtgccgcccgcgccggcgcccgacacgggcgcggcagcgggggcctgcggcgtctgtcctggccgtggcttgctctgccgtcttcttcatcctcgtcgccggtggcctcgtgcagtatgcgctgccatcgacgtggtggctaactgctggttcggggtcaggcggagacctggtcgatcgttttcgccttacttagtagtagaagtagcagtcatgggctgtgttgattgtgtccctgtctccccctggtggacgttgtgatcatgagctattgcttattcatttagtaccctactgcattgttcgacgtataccttgagttgagacgtgcggtgtatgaataacgacgatggatctcggtcgtcaatcgtcattaggatn

SEQ ID NO: 59940 - protein, 114 aa, Zea mays
  misc_feature: Ceres CLONE 1517961
MASRVAVLLVAVAAVLFAAASAHEMDLGVPPAPAPDTGAAAGACGVCPGRGLLCRLLHPRRRWPRAVCAAIDVVANCWFGVRRRPGRSFSPYLVVEVAVMGCVDCVPVSPWWTL

SEQ ID NO: 59941 - DNA, 633 bp, Zea mays
  misc_feature: Ceres CLONE 1517968
  misc_feature: Encodes the peptide sequence at SEQ ID NO. 59942
aaagctggagctccccgcggtggcggccgctctagaactagtggatcccccgggctgcaggaattcgtctcacccctagaaaaatttttacacctgctaaactgatcgaggctaacccatcttggaggactgatatcgttccatcatccaatgtggatgatattgggtcttcgccagttgaagttgccaaagcttttatggaagcgcacacctcagcttctgtacacgagtccaaaaagcgtcatattcagagctctcagtcatggagttgcggctgacaattcgacatcagaagttttccctacaataactactgattcttctgtaaaatggcctgcctcaattgttcacggtggtcccaactatcttacaccacatagtaataaaggaaggactctgtctcagcctctttctcgcacaccatacaatagctcagttattcgaagatatattaagaacagcaggcatggtgatatacacaataatggacagacacaatttcccactccattttctattggaagcaagagaatactagaggataaacaggccgcatgtggtggtatagcgcatccatcatcttccaggggacagatagatgtttttggccctattccaagagaaagtacgact

SEQ ID NO: 59942 - protein, 161 aa, Zea mays
  misc_feature: Ceres CLONE 1517968
MWMILGLRQLKLPKLLWKRTPQLLYTSPKSVIFRALSHGVAADNSTSEVFPTITTDSSVKWPASIVHGGPNYLTPHSNKGRTLSQPLSRTPYNSSVIRRYIKNSRHGDIHNNGQTQFPTPFSIGSKRILEDKQAACGGIAHPSSSRGQIDVFGPIPRESTT

SEQ ID NO: 59943 - DNA, 571 bp, Zea mays
  misc_feature: Ceres CLONE 1517975
ggagctccccgcggtggcggccgctctagaactagtggatcccccgggctgcaggaattcgtctcacccctagaaaagaacgagctaataaaaaagccgaagcggctgccagtaaatctgaagccgacacgaagacgacaccttcagaggaggaagctgctactcctagcgcggtgaacggggctcaggcctctctagagaacctcttgagtagagccaaagtgatcagtgcggatttctcgtgggagaagttcagcacacagtttgccgacgtgacgacccctctaacctcatcactagagaaggacccaacaaggcacagatagccactgtgcgaggccaggaaaaagcgaagaagctggcaccgcggattgctgttgtgaagccagcaacgcagaatgcgaagcagccggatcccaaaacagaagtgagagcactgtttgggtggcctcttcaaacaagaaacggtgtatgtggaatgatgactaaaaccaggaacggccatttatccccctacgggaattcccttcctttgggtttttttttgggtggcccaaggcccttgggggac

SEQ ID NO: 59944 - DNA, 657 bp, Zea mays
  misc_feature: Ceres CLONE 1517980
  misc_feature: Encodes the peptide sequence at SEQ ID NO. 59945
ggagctccccgcggtggcggccgctctagaactagtggatcccccgggctgcaggaattcgtctcacccctagaaaaaatctacccggtgtaagagggctgctaacacggtcgttacgtgagcctcctttattttaagcgctactacttcctcgacttctccgcgtgggggctcggtcactctgataccaatgtcatcaaggtttaccccgtttgtccggctagtctcgggaggtactctgtggcgcggtgttacttcccgacatgaagttgactacaggctcacgctgctgcacccgtgacggaaacggctcgtcgtactggatcattcaaccctaggttctgtttgatgttgagctgtctttattgtccatgctcgcggacatccgcaccaaagtctggctgataccagaatgcgggaactggagaagcttggtctgtaagtttctgaattacatcgcatgcatctagccggactcggatgcgtagaattgatcaatgtctcacgtctagctagctgtctaacatagtggctactgctactgctacagtctccaattgcttcggggacatctctccttgccattactgcagctttgcactgaatgagatgagcgattaataaagtatacatacatttatacgattaaggtcccaa

SEQ ID NO: 59945 - protein, 32 aa, Zea mays
  misc_feature: Ceres CLONE 1517980
MLADIRTKVWLIPECGNWRSLVCKFLNYIACI

SEQ ID NO: 59946 - DNA, 569 bp, Zea mays
  misc_feature: Ceres CLONE 1517985
  misc_feature: Encodes the peptide sequence at SEQ ID NO. 59947
atagctggagctccccgcggtggcggccgctctagaactagtggatcccccgggctgcaggaattcgtctcacccctagaaaaagcgcaaacatcgaatcgtctcactcgtgtctgccctgctcatactgcttgccctcgccgtatcgtccacccgcaacgcacaggaggattccatggccaacaacaccgggacgttggtgggcggcatccaggacgtgccggggagcgagaacgaccttcacctccaggagctcgcccgcttcgccgtcgatgagcacaacaagaaggccaatgctcttctggggttcgagaagcttgtgaaggccaagacacaagtggttgctggcacgatgtactatctcactattgaagtgaaggatggcgaagtcaaagaagctctacgaaagctaaggtctgggaaaaagccatgggaagaaacctcaagggggccttgcaggaaattccaaaaccctgttttaaaaaaaagggggcctaaccccctaaagaaagctcccctttccccggggggaacccttaaccctcaaaagaaaattttcaaaaaaaaag

SEQ ID NO: 59947 - protein, 131 aa, Zea mays
  misc_feature: Ceres CLONE 1517985
  misc_feature (10)..(99): Pfam Name: Cystatin Pfam Description: Cystatin domain
MANNTGTLVGGIQDVPGSENDLHLQELARFAVDEHNKKANALLGFEKLVKAKTQVVAGTMYYLTIEVKDGEVKEALRKLRSGKKPWEETSRGPCRKFQNPVLKKRGPNPLKKAPLSPGGTLNPQKKIFKKK

SEQ ID NO: 59948 - DNA, 657 bp, Zea mays
  misc_feature: Ceres CLONE 1517989
  misc_feature: Encodes the peptide sequence at SEQ ID NO. 59949
  misc_feature (657)..(657): n is a, c, t, g, unknown, or other
ggagctcaccgcggtggcggccgctctagaactagtggatcccccgggctgcaggaattcgtctcacccctagaaaaaagagcaccaaggaccttcggcgcccgttcaggatccacatcttcccgagcgagttcttggttgacctcttcccccttcggaccacctccaaggctcttggtgtagcttgccactctcaccaatcaagttttcatgtctgatctcgacattcagatcccaactgccttcgatcccttcgctgaggccaatgctggggactctggtgcggcagcagggtcaaaggactacgttcacttgcgcatccagcagcgtaatggtcgcaagagcctgactaccgtccagggattgaagaaggagttcagctacagcaagatcctcagagatccccccaaagagttctgctgcaatggtacagtggtccatgacccagaccttggacaggtcattctgctccagggcgatcagaggaagaacgtctcgaatttcctcgtccaggccggcattgtgaaaaacgaccacatcaagattcatggtttctgagcaacccccgggtccttagcaaaccaaccctgcatgcaagtgcccccttattattattcatattcacacctggacccacaccccaccccgactctccan

SEQ ID NO: 59949 - protein, 115 aa, Zea mays
  misc_feature: Ceres CLONE 1517989
  misc_feature (27)..(108): Pfam Name: SUI1 Pfam Description: Translation initiation factor SUI1
MSDLDIQIPTAFDPFAEANAGDSGAAAGSKDYVHLRIQQRNGRKSLTTVQGLKKEFSYSKILRDPPKEFCCNGTVVHDPDLGQVILLQGDQRKNVSNFLVQAGIVKNDHIKIHGF

SEQ ID NO: 59950 - DNA, 628 bp, Zea mays
  misc_feature: Ceres CLONE 1517990
  misc_feature (628)..(628): n is a, c, t, g, unknown, or other
ccccgcggtggcggccgctctagaactagtggatcccccgggctgcaggaattcgtctcacccctagaaaaaatacatgtccatcacaggctgccccgctcttcaggtagacgaaaatctaccgatctcctgtggtgtccgcggcgaagattttctgggcgcgtgaacggcggagaagtcctgggcaagggaggggcgaatcgccaccggaaggtgctcctggataaccttgacggtatcacaaaacccgcaatcctgcatgctggcccgcatggtgggagtgaagggcatgtccaggttcatgtaccaaggagaggcgccttctcctccacatgttcctggagaatccgatacgtcacgctgatacttacactgagcacgatcaccgcactacagttgcacccctggaaggactatatcctgtccctcgcccgggacgcaccctctatggcttccgtggctagactagagctggcgcacatcgatggcgtccctgcgatgtctattgattttgcgattcatgattatcgcctcgctgaaggaaatgctggttactgtgacactacatcaaacatgttgtgcctgtcagaagaaatggccattgcgacttgctgattattcaatcatn

SEQ ID NO: 59951 - DNA, 647 bp, Zea mays
  misc_feature: Ceres CLONE 1517997
  misc_feature: Encodes the peptide sequence at SEQ ID NO. 59952
atagctggagctccccgcggtggcggccgctctagaactagtggatcccccgggctgcaggaattcgtctcacccctagaaaaagccatcagaatcagaccaccacacgcccgaggcccgactgctagcgcctgagcccaagacccatggccatggccgccgccaccgtcgcagcgtcactgcccgtggcgcaagggctcaggaagcccctctgcgccggcagcaacgcgccgtcgctccgggccgtcgcgggcgcgccccgtcgtctgtcggccaggaccaggatggccgtcgtccgggcgtccgcgcaaaagcagcactcggccaaggagtgggcggccgcagctgccgtggcagcagctctggtgctgccggaggtcccggaggccgcaccggagatctccccgtcgctcaagaacttcctcctcaacatcgtctcccgtggggtcgtgctcgtcgccatcgtcggcgccgtcgtcgccgtctctaacttcgatcccgtcaggcggtgctgagctgcatgcgacattgtgcgtcgccgtattgtacctatgtactgagatctctccccccgtgtgcttcccaatgaaaacagtgtttaatgcgtgaatgtgtaaatctcatttcatgccatctgtatgcatgag

SEQ ID NO: 59952 - protein, 122 aa, Zea mays
  misc_feature: Ceres CLONE 1517997
MAMAAATVAASLPVAQGLRKPLCAGSNAPSLRAVAGAPRRLSARTRMAVVRASAQKQHSAKEWAAAAAVAAALVLPEVPEAAPEISPSLKNFLLNIVSRGVVLVAIVGAVVAVSNFDPVRRC

SEQ ID NO: 59953 - DNA, 638 bp, Zea mays
  misc_feature: Ceres CLONE 1517998
  misc_feature: Encodes the peptide sequence at SEQ ID NO. 59954
aaagctggagctccccgcggtggcggccgctctagaactagtggatcccccgggctgcaggaattcgtctcacccctagaaaaaattccccgccgcctcgcgcccccgctcgcttcacttctctaggtgcgcaccgatcagaaggtgcctgcctcctcctcgtcggcgaaaagatggcggtgccgctgctgacgaagaagatcgtgaagaagcgggtcaagcagttcaagaggccccacctcgaccgctacaagtgccttaagccaagctggcgcaggccaaagggtattgattcccgtgtcaggaggaagttcaagggatgcaccttgatgcccaacattggttatggttctgacaagtcgaccaggcactacctccccagcaagttcaagaagtttgtggtccacaacgtttctgagctggagttgctcatgatgcacaacaggacctactgcgctgaaattgctcacaacgtgtccaccaagaagcgcaaggagatcgtggagcgtgctgcacagctcgacattgtggtcaccaacaagcttgctaggctccgcagccaggaggacgagtagtctggtttcttgtcttaacgacgaactggatgttgccattcctttctgtagggaactactttg

SEQ ID NO: 59954 - protein, 133 aa, Zea mays; identical to SEQ ID NO: 13146
  misc_feature: Ceres CLONE 1517998
  misc_feature (14)..(123): Pfam Name: Ribosomal_L32e Pfam Description: Ribosomal protein L32

SEQ ID NO: 59955 - DNA, 639 bp, Zea mays
  misc_feature: Ceres CLONE 1518000
  misc_feature: Encodes the peptide sequence at SEQ ID NO. 59956
tccccgcggtggcggccgctctagaactagtggatcccccgggctgcaggaattcgtctcacccctagaaaaagaagcttatcgcttatcatccgcgcctctacatttcttctctctctgctcctccggctccgcctccgcctgatccatccaagacggggatcgccatgtcggactccgaggagcaccacttcaaatctaaggccgacgctggggcgtccaagacctacccgcagcaagctggcaccgtccgtaaaaacggcttcatcgtcatcaagaaccgtccctgcaacgatgtggaggtttctacctccaagactggtaagcatggccacgccaaatgccactttgtcgccgtagacatattcaatgggaaaaagcttgaacatattgttccttcatcacacaactgtgacattccgcatgtgaaccgtactgagtatcagctgattgatatttctgaggatggatttgtgacccttcttacttcagatggccactctaaggatgatcttagactcccaactgatgagactcttgtggcccagattaaggaagggttcgaaagctggaaggatcttgttgtgacatccagtctgcgatgggggaggagcacatctgctcgctgaaagatgttgg

SEQ ID NO: 59956 - protein, 153 aa, Zea mays
  misc_feature: Ceres CLONE 1518000
  misc_feature (86)..(153): Pfam Name: eIF-5a Pfam Description: Eukaryotic initiation factor 5A hypusine, DNA-binding OB fold
MSDSEEHHFKSKADAGASKTYPQQAGTVRKNGFIVIKNRPCNDVEVSTSKTGKHGHAKCHFVAVDIFNGKKLEHIVPSSHNCDIPHVNRTEYQLIDISEDGFVTLLTSDGHSKDDLRLPTDETLVAQIKEGFESWKDLVVTSSLRWGRSTSAR

SEQ ID NO: 59957 - DNA, 619 bp, Zea mays
  misc_feature: Ceres CLONE 1518004
  misc_feature: Encodes the peptide sequence at SEQ ID NO. 59958
cccccgggctgcaggaattcgtctcacccctagaaaaagccccgccttatccttccctcatcccccgtacaaaaacgcgctccctcccgcccgcccgccgctcaagccacctacaccaccaccccgccggccacactcgtctttctcacgagccacaggcacaggcaggctctcgagctcagtccacccagcgcaggggatggcgtcgtcgttcgccgtggcaacggtcccgtcgctggcggccccggcggccaagaagcggtccggcggcgtcacgtacgtggagggcatgaacgcctacagcggcctcaaggggctcaacaaggtgaacatgctcggggtgcgcaagaccgccgactactccttcgccaaggtcgtggcgtcgctcagccccgcgggcaggaagcggcgcggcggcgcgttcggcgcccagatgaacgccgccgccgagatcttcaggatcgccgccaccatgaacggactcgtgctcgtcggcgtcgccgtcggggttcgtgctgctccgggtggaaggccgccgtcgaggagcccgaagtagggtgcgtgggcctggccaatgttaggcttgcccccccgggcccgcagtctgctttaaaaaacc

SEQ ID NO: 59958 - protein, 118 aa, Zea mays
  misc_feature: Ceres CLONE 1518004
  misc_feature (79)..(109): Pfam Name: PetM Pfam Description: PetM family of cytochrome b6f complex subunit 7
MASSFAVATVPSLAAPAAKKRSGGVTYVEGMNAYSGLKGLNKVNMLGVRKTADYSFAKVVASLSPAGRKRRGGAFGAQMNAAAEIFRIAATMNGLVLVGVAVGVRAAPGGRPPSRSPK

SEQ ID NO: 59959 - DNA, 655 bp, Zea mays
  misc_feature: Ceres CLONE 1518006
  misc_feature: Encodes the peptide sequence at SEQ ID NO. 59960
gcggtggcggccgctctagaactagtggatcccccgggctgcaggaattcgtctcacccctagaaaaactggtcatctccggtttcctcgtttcctttcctcttcgtcccagtgacgtcagtacgtcacccatcggcacccgcgccgctgacccccgccaccgtgtcacgatcaggtccccgctcgcacgcctagcgcgatggcgcacccgatgtacggctccggaccgctccgatccaggaacgcggcgagctcggacgaaatccagctgcggatcgacccggtgcacggggacctcgacgaggagatcgacgggctgcactccacggtcctcatgctcataggggtggcccaggagataaattctgaaaccaagttccagaatgatattcttcatgaactgcaaatgacccttgcaaaagctcatgctgcgatgaagaacaaacatgcggagattgaacaagagcatcatccagcagggctcaaaccatgttctctatgttgtcctcttttcactgttttgtctctttattgtctacctctgtgcaaattcctcttaaaatatacttcccgtaccttgctgggccaattctcaagacacccattgacttgtatgccacccctcacccccaaaaaaaaaaacccttttcgtact

SEQ ID NO: 59960 - protein, 152 aa, Zea mays
  misc_feature: Ceres CLONE 1518006
MAHPMYGSGPLRSRNAASSDEIQLRIDPVHGDLDEEIDGLHSTVLMLIGVAQEINSETKFQNDILHELQMTLAKAHAAMKNKHAEIEQEHHPAGLKPCSLCCPLFTVLSLYCLPLCKFLLKYTSRTLLGQFSRHPLTCMPPLTPKKKNPFRT

SEQ ID NO: 59961 - DNA, 827 bp, Zea mays
  misc_feature: Ceres CLONE 1518011
  misc_feature: Encodes the peptide sequence at SEQ ID NO. 59962
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (47)..(47): n is a, c, t, g, unknown, or other
  misc_feature (49)..(49): n is a, c, t, g, unknown, or other
ggagggaaaagtgagatgtttaagaagaaaaaaaaannnnnnnnggngnccctttcaaaactgggactccccgcggtggcggccgctctagaactagtggatcccccgggctgcaggaattcgtctcacccctagaaaaatcttccgtctccaaatcctcctagcgaattcaccacagcttctcaccaccgcgaccttcgatggcacccaaggcggacaagaagccggcggcgaagaagcctgcagaggagcccgcgacagagaaggcggagaaggctccggcggggaagaagaccaaggccgagaagcgcctcacggcgggcaagtccgccagtaaggagggcggcgagtgccagaaggggaaaaagaaagcgaagaagcccgtgagagacctacgcgatctcccgcgttcaaggagcgtgaaacagggagcaccccgaacaatcagccatctacgcccacaggacatgatccccccaccccacttccttgcttagaagaaagcatcttcctaataatcctctcagagtctgatttccagcccaagaaatgggcgccgcctaattaccaaacaagcctcaccctgctgctactctccgcttgtaaaaatccaaaaaccccccatggggcccccctccgtcccttccctcggttttaagcttttcccctccccctcgccccctcccctcccaagcagcaccccctaggacccggtgcatgacaggaataaaacctgcgaatctatacaaggctataacaaaccaacacaaagaactagcggcgaggggggcacggggacaaaacacagggcgtcgtccatcttagtt

SEQ ID NO: 59962 - protein, 98 aa, Zea mays
  misc_feature: Ceres CLONE 1518011
MAPKADKKPAAKKPAEEPATEKAEKAPAGKKTKAEKRLTAGKSASKEGGECQKGKKKAKKPVRDLRDLPRSRSVKQGAPRTISHLRPQDMIPPPHFLA

SEQ ID NO: 59963 - DNA, 629 bp, Zea mays
  misc_feature: Ceres CLONE 1518012
  misc_feature: Encodes the peptide sequence at SEQ ID NO. 59964
atagctggagctccccgcggtggcggccgctctagaactagtggatcccccgggctgcaggaattcgtctcacccctagaaaaaaaattccccgaaccaaatcactcccaccgtctccacagcaaccagcacacatttccctttggcggatcgaaggaaggaaggaggagatgggtggcggcatggaggtgcacaaaaaccggtggatcgaagagtggaacgccggccgggagaacctcgagttcaacttccgctggacccgccgcagcctcgccgtcgtcggcctcttcggcctcgctgtccccatcctcgtctacaagggcatcgtccgcgaattcggttggatccagcatatgcaggacgaggatgcaggtcggccatacaggaagttcctgtaagcggcgtccaggagctgcaagatacgtcgattcctcgaccggggctgcgaggaggggagtttccgttcagtttgtgtcggtattgttttagtctgaatctgatgaagcaatttggaatgctgaattattgtgcctgatccaatgaataaggtgtaatgactcgtctttttcattactgaaaaaaaaaaaaaaacgagacgctcgaggtacccattccgccctatagtgagt

SEQ ID NO: 59964 - protein, 75 aa, Zea mays; identical to SEQ ID NO: 41067
  misc_feature: Ceres CLONE 1518012

SEQ ID NO: 59965 - DNA, 642 bp, Zea mays
  misc_feature: Ceres CLONE 1518013
  misc_feature: Encodes the peptide sequence at SEQ ID NO. 59966
tggagctccccgcggtggcggccgctctagaactagtggatcccccgggctgcaggaattcgtctcacccctagaaaaaattataattagaacacccctcgtccgatgtccgactgcatgcgcttgaatggaagacacagggacatggttgccgcctctgtccgagcggcgctgcccgtggcacaaggcctcccgaagcccctctgcgccggcatcaacgctcctttccttcggggcgtcccggctgcgctccgacgtcggttggttatgaggaggatggtcgtcgtccgggtgtccgagcaaaagcagctctcggccatggagtgggcgcgagccgatgccatggcagctgcactggtgctgccagaggtcgcggaggtcgcgctaggcatctccacatctgtcaagaacttcctcctcaacaacctctctcgtgttgtagtgctctgatccatcaccggcgacgaagaccccgtctgttatttcgattgcgtaaagaggggttgaactccatgcatcgatttgtgtcgttgtcatggaccaatgtacgaagatgtccccacccttgggcttcgccaagaataccgggtgaaatggctggatgtgtaaatttcttattcaagccatcgggaaggtatgaaa

SEQ ID NO: 59966 - protein, 114 aa, Zea mays
  misc_feature: Ceres CLONE 1518013
MSDCMRLNGRHRDMVAASVRAALPVAQGLPKPLCAGINAPFLRGVPAALRRRLVMRRMVVVRVSEQKQLSAMEWARADAMAAALVLPEVAEVALGISTSVKNFLLNNLSRVVVL

SEQ ID NO: 59967 - DNA, 663 bp, Zea mays
  misc_feature: Ceres CLONE 1518015
  misc_feature: Encodes the peptide sequence at SEQ ID NO. 59968
ctggagctccccgcggtggcggccgctctagaactagtggatcccccgggctgcaggaattcgtctcacccctagaaaaaaccagtaccacaccactccgcgctagctgaggacggtacagcggcccagaggtgcgacgtacgacgacgacgacgcaggcgccacacatgggatcccagctctccgccgccgtgccccggttccacggcctccggggctacgccgcgcccaggtccgcggtggcagcgctgccgtccgtgagggtgggcaggaagaggtcgtcgtcacagggcatccgctgcgactacatcggctccgccaccgacctgatcatggtgacgacgaccacactgatgctgttcgcggggcggttcgggctggcgccgtcggcgaaccgcaaggcgacggcggagctgaagctggaggcgcgcgactccggcctgcagacgggtgacaccgccgggttcgccctcgccgacacgctggactgcggcgccgtcagccacatccacggcgtcggcatcgtgctcgggctcatgaacaccggcgccctcgaccagatcatcggctagatccctacgtcgtcgttgttaagatcagactcagcatcctcgatcgcgccgacggccggcaagtggctgcaggtggtgactttgtcacggg

SEQ ID NO: 59968 - protein, 134 aa, Zea mays
  misc_feature: Ceres CLONE 1518015
  misc_feature (49)..(129): Pfam Name: PSI_PSAK Pfam Description: Photosystem I psaG / psaK
MGSQLSAAVPRFHGLRGYAAPRSAVAALPSVRVGRKRSSSQGIRCDYIGSATDLIMVTTTTLMLFAGRFGLAPSANRKATAELKLEARDSGLQTGDTAGFALADTLDCGAVSHIHGVGIVLGLMNTGALDQIIG

SEQ ID NO: 59969 - DNA, 632 bp, Zea mays
  misc_feature: Ceres CLONE 1518021
  misc_feature: Encodes the peptide sequence at SEQ ID NO. 59970
aaagctggagctccccgcggtggcggccgctctagaactagtggatcccccgggctgcaggaattcgtctcacccctagaaaaaacatgcactagctcctcctctcttgcccaccagcgactcccgtagctggaactcgctcgtcaaaaggaaaaggaaacacttcgcttcagctcgttgacagacgacgactcagagcaaaatgggtatactggtgattacggtggacctagactgctgtcgctgcagagccaagatcaccaaggtcctggactgtctcaaagaggagttctgcatcgagaaagtggagttcgatgacaagaaggagaagaaggtggtggtggtgcgtgggaagttcgacgccgacaagctctgcaagaaggtgtggtccaaggccgggaagatcgtgaaggggattgtcatcgctgaggtgtggccaataccagccccgcccaaggagtgcaagcctgaggcaccgaaatgttgcgactgtgagaagtgcaagccccagccaagcctgagccacggaaatggtgcgactgtgagaagggcaagcccaagcccaggcctgagcccccaaaatgttggcactggggaaaagggcaaccccagcccgagccctcccaaaaaaa

SEQ ID NO: 59970 - protein, 143 aa, Zea mays
  misc_feature: Ceres CLONE 1518021
MGILVITVDLDCCRCRAKITKVLDCLKEEFCIEKVEFDDKKEKKVVVVRGKFDADKLCKKVWSKAGKIVKGIVIAEVWPIPAPPKECKPEAPKCCDCEKCKPQPSLSHGNGATVRRASPSPGLSPQNVGTGEKGNPSPSPPKK

SEQ ID NO: 59971 - DNA, 592 bp, Zea mays
  misc_feature: Ceres CLONE 1518022
  misc_feature: Encodes the peptide sequence at SEQ ID NO. 59972
ctggagctccccgcggtggcggccgctctagaactagtggatcccccgggctgcaggaattcgtctcacccctagaaaaactatcttcgcatctggcacgagcagccaagcatataaatgtagagtggcgagcgacgaccggcctgggtcaccctttcggccgagagtagccgatgtggtcgtcgtcttcgtcgctgctccccgccggctggcgtgatcgcgatgaggcagtggtggtggtggtgcctgctgctgctggcggcgtggtgctgcgccgcggccgcgcattcgccgcctgcggcggacccgctgctgagcaagtgccatggggacttcgggaagctgacagactgcatggactacgcgacgggtcacgctgcgtctccctcgtccacctgctgcggcgacgccggcgacacggagtatgcgcgccccgagtgcctctgctacatcatacagcaggtgcacacggtgcgcaaccaggtgaagtcgctctgccgtgcctttctaccgactcatgtgctcacccgcagctgcattctccccaagtccaacgtctcggtcttgaataacttgtttgaactgaacccgg

SEQ ID NO: 59972 - protein, 123 aa, Zea mays
  misc_feature: Ceres CLONE 1518022
MRQWWWWCLLLLAAWCCAAAAHSPPAADPLLSKCHGDFGKLTDCMDYATGHAASPSSTCCGDAGDTEYARPECLCYIIQQVHTVRNQVKSLCRAFLPTHVLTRSCILPKSNVSVLNNLFELNP

SEQ ID NO: 59973 - DNA, 919 bp, Zea mays
  misc_feature: Ceres CLONE 1518029-R
aattgggtacatcgagcgtctcgtttttttttttttttttgatcaaattcatgttggcgtggtgcgctatacagataccagattattctgcagttgcactacttgtcccgattaaccacactttgatcggatacatgacaagcacacacgcacgcacacggctgtctgtagaatacatcctcgacgaccgctcagaagaagttggggtcgtatccgttgctggaggtggcgaggatgtagtaggcgacgatgtggccgagcgagccccacgcgaggacgtcgacgaggttgaagcccacggggtcgttggacttgagcagggccgcgaactccttggcgcgctcgtcgccagcgttgaagagcgtcttggcgttctgcgcgggcacctgacttgccaccatcctcccgctggaagttgaaaaataacgaatcgggcccaggaagaagcgactcgacccatggctccaggttggacacccaaaggccgaaacttaaacttctgggacgcggccgcccctgggaaccaacccctgccgggggccacggcccccccgcccggaaaaaaaaacaatctttgcccccgggcctcgggaaaaaacgggggccctaggggcgaaaagcccccggcccccacctgaaagtggggggggggaaaaagcaccccgcccggagcgggcgggggttaaattttgggcgggcccaaaggcgcaatttttgtggccccccccgggagttaaaaaaagtctcttgcctccgccggggggggccctttttattccttgggagaaaaaaaaaaaaatttttttttttttttggggcggtccccaaaaatatctctccgttccttcccggggggggaaccaaaaatgtattcccggggggacccccgccaggcgggtttgggagcctcccgcccccc

SEQ ID NO: 59974 - DNA, 816 bp, Zea mays
  misc_feature: Ceres CLONE 1518032
  misc_feature: Encodes the peptide sequence at SEQ ID NO. 59975
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (34)..(34): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
ttttttttttttttttttttnnnngggnnnncgncccnnnnaggcaggnnnggagatagctggggctccccgcggtggcggccgctctagaactagtggatcccccgggctgcaggaattcgtctcacccctagaaaaaagatcggaggagagcactggcttgtatccctctctcgtctctccagcgacggcagcgggcgagggttacgcgaaggcgaagcggagtagtggaagcagaggcggcagccatggccgtgatggagaagctcaagatctttgtcgttaaggagcccgtagtcccggcctcctgcctcatcgctggagtcggtctctttcttccagcagttggccggccaatcctggattcatgggagaccggggaaccagttcctcccccccgtccaaaggatggggttgtttggtgtccccggctaggaggggggggggggaacttgaattggttttttacatgccccacgttggcccccccttgttccttccccgcggatttctttcctgggcgactcagtatttgttccggccttctcccctcgcacgccccgcgtgtcttgggaccggtgctgaactgggtggtcccctggggggaatgattccgtctgggactctcgatatccatatcacctgttatggtggggtgatgcgcccgcccagcgcttccccccctccccgcccgcgattgtttgtcttgcctccttgcgttctttggtctgggggaggcctccttgtgtgtccgttcccggtctcccccccccgccgcggcctgcccgctgcggggcgtcccggcttgtccggctc

SEQ ID NO: 59975 - protein, 120 aa, Zea mays
  misc_feature: Ceres CLONE 1518032
MAVMEKLKIFVVKEPVVPASCLIAGVGLFLPAVGRPILDSWETGEPVPPPRPKDGVVWCPRLGGGGGNLNWFFTCPTLAPPCSFPADFFPGRLSICSGLLPSHAPRVLGPVLNWVVPWGE

SEQ ID NO: 59976 - DNA, 823 bp, Zea mays
  misc_feature: Ceres CLONE 1518037
  misc_feature (631)..(631): n is a, c, t, g, unknown, or other
tttttatttttatttttaaaatttatattataattaatatatatattattataataaaaactggagctccccgcggtggcggccgctctagaactagtggatcccccgggctgcaggaattcgtctcacccctagaaaaatccactctcatcaccagctaagaacaggggttcgtctcaatggaaggcaaaacagggcagctcatgtgctgtgtcggcgacatcgtgctcgtcatgggactgggtcttgagggccaccaaagatgaaactcgaggcaaaaggaggtaccgaacccgcccctgggaataaccattttaaacccccagcggatgactccgggatggggcccacaaaaattatgagttttatttcatgggaaatgcctgattttgcgccgttataggaaacataaaaaattttagtagatgactttttggtctagtgtactttgcccacttatggcgcggagtgtgcaccgagaccaagcatatgtctgccatatagtgtccgccgacaaccccattgacccctttaaagaaacaacagtagcgggccaagaagttcgaccctgcccgcctcccgcggcagcggggtggtgaatttgttgttttgacactttggtgggggcgtnctcgtacttttgttacttttttatcgagaacctccccccccaaaaagcgcccacccctataaataaaaaagaaatataaaaaagacgctggttggaagtgggtgaagcgtctctcttcgagtgtctttcaccttagtaggcgactcttctggtgttagtggccgtagaaaaacaaaatagggcggtttctta

SEQ ID NO: 59977 - DNA, 607 bp, Zea mays
  misc_feature: Ceres CLONE 1518038
  misc_feature: Encodes the peptide sequence at SEQ ID NO. 59978
gctctagaactagtggatcccccgggctgcaggaattcgtctcacccctagaaaaactcctccactccctcccccccgcctccactaccccactcccaggcgccgcacaggtacgtcgccggcggcgatgacgacgcgcttcaagaagaaccgcaagaagcgcggccacgtgtccgccgggcacggccgcatcggcaagcacaggaagcatcccggaggtcgcggtaacgccggtggcatgcaccaccaccgcatcctcttcgacaagtaccatcccggctacttcggtaaggtcggcatgcgctacttccacaagctccgcaacaagttctactgccccgcggtcaacatcgagcgcctctggtcgatggtgcccgccgaaaaagcggcggaagccggcggcgacaaggccccgcacatcgacgtcacgcagttcgggctacttcaaggtgctcggggaagggggtgctgccgcccaagcccatcgttctcaaggccaagctcatctccaaggtcgcccgagaagaagatcaaggccggccggcgggcgcccgtcgtgcttccccgcccaagtgtttcacccccttattcgccttcttgggttttt

SEQ ID NO: 59978 - protein, 160 aa, Zea mays
  misc_feature: Ceres CLONE 1518038
MTTRFKKNRKKRGHVSAGHGRIGKHRKHPGGRGNAGGMHHHRILFDKYHPGYFGKVGMRYFHKLRNKFYCPAVNIERLWSMVPAEKAAEAGGDKAPHIDVTQFGLLQGARGRGCCRPSPSFSRPSSSPRSPEKKIKAGRRAPVVLPRPSVSPPYSPSWVF

SEQ ID NO: 59979 - DNA, 630 bp, Zea mays
  misc_feature: Ceres CLONE 1518039
atagctggagctccccgcggtggcggccgctctagaactagtggatcccccgggctgcaggaattcgtctcacccctagaaaaaacgttgcttgctcccaagatcaagcgtctcccgactccaacactctaactcacgggacacgatcgccatggacgccacatcgaccgccgacgccgtgctgtccccgccgtccgtggccggactccgcctggcgcacatctcccggccgggcgcacgtgtcgttcctcacggcgcccgcgccgatcctgtcgtacgtggcggcgcactcggagctgatcctcgacctggtgatcagcctgagcacggtgcgtgtcgctcttcctgagccgcttcgtcttcttctacttccagcgcgacaacgtcgcgaaccatgcgcccgcgcataacctcaagacgcacttcgacgccggcgactatcacgccaatgagctcgcggacctgctcaagtccaacgacccagtgggcgtcaacctagtcgacaacctcccctggggctcgctcggccacatcggctcctactacatcgtcaccacctccagcaacggatacgaccccgacttcttctgacccgtcgtcgaagatgtattctacaaacagtcgtgtgcg

SEQ ID NO: 59980 - DNA, 632 bp, Zea mays
  misc_feature: Ceres CLONE 1518044
  misc_feature: Encodes the peptide sequence at SEQ ID NO. 59981
atagctggagctccccgcggtggcggccgctctagaactagtggatcccccgggctgcaggaattcgtctcacccctagaaaaagtgctttcttagaggtgggttggcttctcctccccctccggttcgggttcgggttcgtgaggttctccggggttcgggttcgtgggtgagcggatcgagatggcggcgtccgatgttgagtaccgctgcttcgtctgcggcctcgcctgggccacggacgaccactccctcctcaacgccttcatcacctacggcgaggtcctcgagtccaagatcatcctcgatcgggagacgcagaagtcccgcggcttcggcttcgtcaccttctccacggaggaggcgatgcggaacgccatctagggcatgaacagcaaggagctggacggccgctacatcaccgtcaacgaggcccagtcccgcggcggccgtggaggcggcgcctgtgggtacggtggtggccgtggaggctgcggctacggcggtggcgggcgccgtgatggcggtggcggctacagcggtggcggcggctactgtggcggcggcggctacggtggtggtggcggcggctactgcggtggcaaccgtggcggcggctactgcaactccga

SEQ ID NO: 59981 - protein, 66 aa, Zea mays
  misc_feature: Ceres CLONE 1518044
  misc_feature (10)..(67): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAASDVEYRCFVCGLAWATDDHSLLNAFITYGEVLESKIILDRETQKSRGFGFVTFSTEEAMRNAI

SEQ ID NO: 59982 - DNA, 626 bp, Zea mays
  misc_feature: Ceres CLONE 1518045
  misc_feature: Encodes the peptide sequence at SEQ ID NO. 59983
tccccgcggtggcggccgctctagaactagtggatcccccgggctgcaggaattcgtctcacccctagaaaaaaaccccaccgcaacacagcgccggcaaccgccgccatcgatcgatcgcccggaaactgacctctaccgatgtctggagccggcgaggaggataacaaggccgcggagggcggcgcccacatcaaccttaacgccaagggacaggatggcaatgaggtgttctttcgcataaagaggtccacccaactgaagaagctgatgaacgcctattgcgaccgccagtctgtggacatgaatgccattgcattcctgtttgatggccgcacgcttcgcggcgagcagacccctgatgagctggagatggaggacggctacgagatcgactccatgcttcaccagaccggaggcagcgttcctagcaccagctacaagcagcagctgcggagcctcggtttgctctccgccctgcgtagcactaaacagaagggaaaaagtctttttaccgaacttgtgatgctctggctgcttgtgccattgctgaaggacatccttaggctttatttagtggtatggtctggtactttgttctgttcaaaaaaaaaaaaaaacgagac

SEQ ID NO: 59983 - protein, 161 aa, Zea mays
  misc_feature: Ceres CLONE 1518045
  misc_feature (20)..(91): Pfam Name: ubiquitin Pfam Description: Ubiquitin family
MSGAGEEDNKAAEGGAHINLNAKGQDGNEVFFRIKRSTQLKKLMNAYCDRQSVDMNAIAFLFDGRTLRGEQTPDELEMEDGYEIDSMLHQTGGSVPSTSYKQQLRSLGLLSALRSTKQKGKSLFTELVMLWLLVPLLKDILRLYLVVWSGTLFCSKKKKNE

SEQ ID NO: 59984 - DNA, 667 bp, Zea mays
  misc_feature: Ceres CLONE 1518047
  misc_feature (501)..(501): n is a, c, t, g, unknown, or other
  misc_feature (503)..(503): n is a, c, t, g, unknown, or other
  misc_feature (533)..(533): n is a, c, t, g, unknown, or other
  misc_feature (547)..(547): n is a, c, t, g, unknown, or other
  misc_feature (548)..(548): n is a, c, t, g, unknown, or other
  misc_feature (591)..(591): n is a, c, t, g, unknown, or other
  misc_feature (656)..(656): n is a, c, t, g, unknown, or other
  misc_feature (657)..(657): n is a, c, t, g, unknown, or other
aagctggagctccccgcggtggcggccgctctattctagtggatcccccgggctgcaggaattcgtctcacccctagaaaaattttttctctccacgtagcgagctcctctatccttagtaggcaacagaccaccctgtgtctggatacttgcttaatagggtggccgctgatcgccccccatcgtgatcatgtccgggaacaaccgccgcgagatctgctaatacctcttccatgagggggtcttgttctccaagaaggactacaacctgggccagcaccccaaccttgatgtgtccaacttggaggtgattaaactcatgctgaccttcgagtcgaactgagtatgtgatggaaatcttctcctggccgcactactagggggacctctgcaaccatgggattgagcacctccgcaggttcctcaacctgactatagaggttgtgactgattacctcaagaagacttcctggtccccggctcacaccttcgactctggancncgtggtgtaccctacgggtgccctcctccnttatgaatgggaanngtctagggttgcgtgaagaggatggtgcccacaccaggtcccngcacgaacgtccaggttaactttgcctcgtttataaaagatggtggctcccggcaaaatttcccnnccctttgttt

SEQ ID NO: 59985 - DNA, 599 bp, Zea mays
  misc_feature: Ceres CLONE 1518053
  misc_feature: Encodes the peptide sequence at SEQ ID NO. 59986
  misc_feature (303)..(303): n is a, c, t, g, unknown, or other
  misc_feature (561)..(561): n is a, c, t, g, unknown, or other
acccgcggtggcggccgctctagaactagtggatcccccgggctgcaggaattcgtctcacccctagaaaaaattcgttgcagtagtcgcagctgacggacgactgaaccaccgacagacaacatggccgcctccgcctccaccgtctccggcctcgccggcgcctccctggccagccgcccggcgttctccaccagcttcacgcggggcagccgggtgtcggcgaggaaccccctgatgagcaggaacctggagaggaatggcaggatcacctgcatgacgtttccccgggactggctgcgngaagggacctgaagcgtcatccggctttcggggctccatccggcttgggaaatggggccccctttccaaaggggcccccgggaattaaagggaaaaaacccttcccaggggggtttttttttctttctcccgcaaccaatcgaataaaaaaaaaaatggggtggccaatatattttttttcttaacaaacccccaccagacaacgatgaccgcttcccccacctcccaagcaaaaattttttctgtttttagagagtnttttgaggaaataatatatagcgtaaccaccccccccc

SEQ ID NO: 59986 - protein, 63 aa, Zea mays
  misc_feature: Ceres CLONE 1518053
MAASASTVSGLAGASLASRPAFSTSFTRGSRVSARNPLMSRNLERNGRITCMTFPRDWLREGT

SEQ ID NO: 59987 - DNA, 853 bp, Zea mays
  misc_feature: Ceres CLONE 1518055
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (25)..(25): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (40)..(40): n is a, c, t, g, unknown, or other
  misc_feature (41)..(41): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
ttttttnnnnnntnnnnnngggggntnnngggnnnnnncnnttaannnnnnaaatctgaggctccccgcggtggcggccgctctagaactagtggatcccccgggctgcaggaattcgtctcacccctagaaaatcccccccttctccttccggtcctccccccgagactcttctattcatataggcgggtaggcgtccgaggcctcgtttgttctcgggttctcgtctccaagggtgctactccgtccgcgcttggtctgctctcgtccttccggaggccgcggcgcaacatggtgaagatcaagccgaaggccttgctcgcgcaaagcaaggtgattaacggccccggccaaatcagcgtgggccccgatctttttcttctatgatcctcgggcggcctggtcgtgttctttttttttcccccccccctcagggggggggggggggggggggaccccctaatcacatcctacgcccctcgtgggggccgacgtggtaaagttgaattccccctctctctcatggggggtgggggggggagattactttctctttccctacgccccacccgccccccgttggggcggggaaaaaaacttttttcataccagagtggtttcgccagtggcccacaccatttgccattctcgggggacaagagggggtgggcggaatgcgttgtcgggcgaaaaacgggataacgcacgccaaaggccacgacaagaattatccgcgcggggtgtggggtctggtgcttcccgtacttccgttatcgtcccttccttgttatagaataagatgtggcggatgggggccggtgggcgtctctgttctccgttgcctccatctcct

SEQ ID NO: 59988 - DNA, 637 bp, Zea mays
  misc_feature: Ceres CLONE 1518056
  misc_feature: Translation starting site: 137
agtggatcccccgggctgcaggaattcgtctcacccctagaaaaagacctgcaggcaaccatctactacagtactcaacgagccgagagcagcacaatctgcacgcagcaagataggagcagcagcatcggcagcgatgggggcctccatgatctcctcgtcagctctggcagtggcgcctcagggccagccgcccctcggacgccgcgcctcctccttcgacgacctctgctccgacaagaagatcaagaccgactaaccctaccggatagggggtggcctgaccgtcgacgtttacgcctaccggagaaagggcaatggcaagggcgtgtattggttggtctgacgagcacggcgcgcacgtcgatggatgcagaccactcaaaaaggaggatgaatggtctccccaccggtaacatatacgctcggggcaccactgggctactgatatgggccgtccccctcgctcgaattctcagaggttggggccctcctcctctaaaaccccagagcccttcccgggctaaggatatccaatgccctgctccttcatggactttccaccatgtttataacactggcgaggtaggcgcctagttctattgaccacatgggatggatccaatctttcttttat

SEQ ID NO: 59989 - DNA, 644 bp, Zea mays
  misc_feature: Ceres CLONE 1518059
  misc_feature: Encodes the peptide sequence at SEQ ID NO. 59990
atagctggagctccccgcggtggcggccgctctagaactagtggatcccccgggctgcaggaattcgtctcacccctagaaaaaatcttcttatcccaaacacaacacactactaccctacccgtccgcctctctcgaaggcgcagcaccagcgagcatgtcgcctgtcaccgcactcctggcgggcacggtggtgccgccggcctcggccccggccccgtcgccggcgaggcacgcccgccattactccgtcggcttctccccgctccacggcggcgggcgcgcggcgctggcggtggagtgctcgtcgcggccgcagaagaaggggaccaagcaccacatgaagacgcggcccaagaagacgcagccgtgggacatcaagcgccgccccacgcagtacccgccgctgccgccgctcccgccggactggacgctcgtcgcctccggcgccacggtcgacgtggaggaggcggaggccccggcacccgccgcgactctcgtcctcgacgtggccgcggccgccgactgaggccgccgcggcgtgtcgccaaagttgttcccttgaacctccgcataagctgtttttctttgagatttattttataataacaatggctgcccagattttgtgattataaattaag

SEQ ID NO: 59990 - protein, 123 aa, Zea mays; identical to SEQ ID NO: 57690
  misc_feature: Ceres CLONE 1518059

SEQ ID NO: 59991 - DNA, 630 bp, Zea mays
  misc_feature: Ceres CLONE 1518060
  misc_feature: Encodes the peptide sequence at SEQ ID NO. 59992
tagctggagctccccgcggtggcggccgctctagaactagtggatcccccgggctgcaggaattcgtctcacccctagaaaaactctccgtgctttctcagacgcgggttggcttctcctcccccaccggttcgtgttcaggttctggttcgtgggcgagagggaagagatggcggcgtcggacgttgagtaccgttgcttcgttggcgggctcgcctgggccaccgacgaccactccctcaacatcgccttcagcacctactgcgaggtcctcgagtcgaagatcatcctggatcgggagacgcagaggtcccgcggcttcggcttcgtcaccttctcctcggaggacacgatgcgcagcgccatcgagggcatgaacggcaaggagctcgacggccgcaacatcaccgttaacgaggcccagtcccgcggcagccgcagacgcggcggtggccgatacggtggccggcgccgtgatggatgcggctacggccgtggcggtggcggctacagaggtggtcgtggatgctaccgcggcggcggtgggggatacggtggtggaaaccgcggcggcggctacggcaacaacgacgggaactggaggaactgagcggtggggtccgctgaggc

SEQ ID NO: 59992 - protein, 146 aa, Zea mays
  misc_feature: Ceres CLONE 1518060
  misc_feature (10)..(81): Pfam Name: RRM_1 Pfam Description: RNA recognition motif. (a.k.a. RRM, RBD, or RNP domain)
  misc_feature (48)..(141): Pfam Name: GRP Pfam Description: Glycine rich protein family
  misc_feature: SWISSPROT Homolog: EC 5.2.1.8 Peptidylprolyl isomerase
MAASDVEYRCFVGGLAWATDDHSLNIAFSTYCEVLESKIILDRETQRSRGFGFVTFSSEDTMRSAIEGMNGKELDGRNITVNEAQSRGSRRRGGGRYGGRRRDGCGYGRGGGGYRGGRGCYRGGGGGYGGGNRGGGYGNNDGNWRN

SEQ ID NO: 59993 - DNA, 895 bp, Zea mays
  misc_feature: Ceres CLONE 1518062
  misc_feature: Pfam Name: Elf1 Pfam Description: Transcription elongation factor Elf1 like
  misc_feature (9)..(9): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
ttttttttnttttnnnngggggcgtcttctccnnnnnnnnnnnnnnnnnnntaaagctggagctccaccgcggtggcggccgctctagaactagtggatcccccgggctgcaggaattcgtctcacccctagaaaaacagccccatctcaatcctagtcgagcttcttcccctcctcgaggaagaaaagaagctgaaccatggggaagagaaggtcagctgctgagccacctcctaagaagcggatgagaatgcttgacactgtcggttcctgcccagtctgtaacaatgggaaggagtgtccactgccgaattgacatggcgaacctggttggcgaaatattcttgtaagatacaggctaggtaatattttataaaatcgtggttttatgtgggctaagtgagagtgattggaacttccttgtgtttttttttggtctttcctcagagcgggggggggggggggggggcttatcttctctttataggacgatccgagataggagcgggtgtggggggggctgagggcacgctaggggggggatagaggggggggggggtagaggggtgggtgctggttggtggtggagaggcagagaggacagaacccgagcgccccaacttagaacagataacacgaaagtttatttaaccccacccgtatataacagttctacccccccggtatttttatcctttatcgcacacggtacgccgggcggcgcggagggggaggcgcgccggccgcgacgcacgccgccacgacgccgacccctgggcatagtaggcgggtgtgggggcgaggtacttaccacacctacaccatgcccccttccttcccttggttgactctttgtggtgggcgagttagaggggatgagtgggaattctggtag

SEQ ID NO: 59994 - DNA, 657 bp, Zea mays
  misc_feature: Ceres CLONE 1518067
  misc_feature: Encodes the peptide sequence at SEQ ID NO. 59995
ggagctccccgcggtggcggccgctctagaactagtggatcccccgggctgcaggaattcgtctcacccctagaaaaacttcgtcggttgttccgcgttgcgggtcctcgacgcacacctctgccgtggccgacccgctcaccgatgagtagatcgcgacagttcgaggaggtcttcactctcttcaataaggatggtgactgctgcgtcactaccaatgagcttggaacggtgatgcgctcccttggccagaaccctaccgaggcagagctgctggacatgatcgacgaggtcgatgccgatggcaatgtgaccatcgacttcccggagttcctgaacctgatggcgaggaagatgaaggacacggactctcaggaggaactcaaggaggtcttccgcgtgttcgacaaggacctgaccggtttcatctcggctgcctagctgcgccatgtcatgaccaaccttgacgagaagctgaccgacgacgacgtctacaagatgatccgtgaggacgacgtctacggccacagccagatcaactacgacgacgtcatcaaggttatgatggccaagtgaggatcggtccccgacgaataagtatctatggattgaagcatattatcaggcacacgagctgtactttgtcatgtcactttg

SEQ ID NO: 59995 - protein, 98 aa, Zea mays
  misc_feature: Ceres CLONE 1518067
  misc_feature (42)..(70): Pfam Name: efhand Pfam Description: EF hand
  misc_feature: SWISSPROT Homolog: EC 2.7.11.1 Non-specific serine/threonine protein kinase
MSRSRQFEEVFTLFNKDGDCCVTTNELGTVMRSLGQNPTEAELLDMIDEVDADGNVTIDFPEFLNLMARKMKDTDSQEELKEVFRVFDKDLTGFISAA

SEQ ID NO: 59996 - DNA, 638 bp, Zea mays
  misc_feature: Ceres CLONE 1518068
  misc_feature: Encodes the peptide sequence at SEQ ID NO. 59997
  misc_feature (305)..(305): n is a, c, t, g, unknown, or other
aagctggagctccccgcggtggcggccgctctagaactagtggatcccccgggctgcaggaattcgtctcacccctagaaaaacttgccgccagccagcccattaaccctcgttcctgtcgcgcagccacgacctccacttcacatctcccccggcggcggcgcggtcagttgaacaatggcggactccaaggccacctcggcggtcaccctccgcacccgcaagttcatgaccaaccgcctcctggcccgcaagcaattcgtgcttgaggtgatccaccccggccgcgccaacgtctccaaggnggagttgaaggagaggcttgccaaggcgtacgaggtgaaggacccaaacaccatctttgtcttcaagttccgcacccacttcggaggaggaaagtccactggtttcggcctcatctacgacaacctcgaggctgccaagaagttcgagccgaaataccgcctcatcaggaatggtcttgctactaaggttgagaagtcccgcaagcaaatgaaagagcggaagaacacggccaagaagatccgcggtgtcaagaagaccaaagctggtgacgccaagaagaagtaaacgttcgtttacatttgaattactgttccggggctctgggtgggcta

SEQ ID NO: 59997 - protein, 137 aa, Zea mays
  misc_feature: Ceres CLONE 1518068
  misc_feature (28)..(111): Pfam Name: Ribosomal_S24e Pfam Description: Ribosomal protein S24e
  misc_feature (43)..(43): Xaa is any aa, unknown, or other
MADSKATSAVTLRTRKFMTNRLLARKQFVLEVIHPGRANVSKXELKERLAKAYEVKDPNTIFVFKFRTHFGGGKSTGFGLIYDNLEAAKKFEPKYRLIRNGLATKVEKSRKQMKERKNTAKKIRGVKKTKAGDAKKK

SEQ ID NO: 59998 - DNA, 790 bp, Zea mays
  misc_feature: Ceres CLONE 1518069
  misc_feature: Encodes the peptide sequence at SEQ ID NO. 59999
  misc_feature (20)..(20): n is a, c, t, g, unknown, or other
  misc_feature (28)..(28): n is a, c, t, g, unknown, or other
  misc_feature (29)..(29): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (36)..(36): n is a, c, t, g, unknown, or other
  misc_feature (37)..(37): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (597)..(597): n is a, c, t, g, unknown, or other
  misc_feature (699)..(699): n is a, c, t, g, unknown, or other
  misc_feature (714)..(714): n is a, c, t, g, unknown, or other
  misc_feature (790)..(790): n is a, c, t, g, unknown, or other
ctttttttcttcattctttntatccctnncannncnncccgaannnnnnncaaagctggggctccccgcggtggcggccgctctagaactagtggatcccccgggctgcaggaattcgtctcacccctagaaaaaaccgcgctcacgagcattctagaagccgaacaaaattcgaagacgaggagcagctacactgcggacggacttctggcatggagggccagttccagggtggcagggaggaggtcatccaagcatggtacgtggacgacagtgaagaggaccagaggcttcctcatcatcgcgagcccaaagaattgatccctctcgacaaactttcccagctaggaatattaagctggggcctacctgctgatgattgggagaatgatgagaacctcaagaaaattcgtgaagtccggggttactccttgggggggggcatttccgaagcccgccccgaatacgttgcccattttacgaggtcaaagataaaggaatttctttgaagaacccgttgctcccttgatgaaagagaaaccgactttcgcccgcggaggggggcgggcttccctccgcaagccgggggggtcccanacagcacccagcgggaacccggaggcgccccgtctccctcaaaggggggtaatgcaaccctcttcttcccagggaggtaccggtgtatacacctgccgtgtncagcggggggtggtnctgtcagcccccgttgttagtggccagttgcgaggcccatcttttgggtgtggaagctccgagacagagcgagttn

SEQ ID NO: 59999 - protein, 98 aa, Zea mays
  misc_feature: Ceres CLONE 1518069
MEGQFQGGREEVIQAWYVDDSEEDQRLPHHREPKELIPLDKLSQLGILSWGLPADDWENDENLKKIREVRGYSLGGGISEARPEYVAHFTRSKIKEFL

SEQ ID NO: 60000 - DNA, 737 bp, Zea mays
  misc_feature: Ceres CLONE 1518081
  misc_feature (36)..(36): n is a, c, t, g, unknown, or other
  misc_feature (43)..(43): n is a, c, t, g, unknown, or other
ttttttttttttttttttttttttttttttctttgngggcggnaaaaaatattttcaaactggagctccccgcggtggcggccgctctagaactagtggatcccccgggctgcaggaattcgtctcacccctagaaaaaacccctggatctatgattctatgaaccagaggggagacgagtggtcgcagcatctggaccgtctccaactcgccagtactcagccgccgcaatcagggacagggagctcgagcgcgcgccccacctgcgccgacgcgatgcaggccaaggtttcctgcttccctcgactccgctgcgttcttctttccatgatgatgcgatgaagccgtgtcccaccgcgctttgcggagctagtatttttctcggttcttcgccgtgagactgtggggtgggcaagaagaggacaatccctacggaggtggtgggcgttgggtcgcccccatcccgctttggaccccccccccccggcccgccgtctgtcccctggccgccaagggggtcacggaattacctctgtcggggagttcccaggctagcaaagagagaccactactggcgtggttaccccagaggaaccaaggcccccaaatagtcaaccctatacaatacttcgacaacgcgtaggttatttcggtaccaccccgagcggatataaagagaggctgcggcgagatgggggcccctcctctgtgggtgtcgttgagtgagcagcccccac

SEQ ID NO: 60001 - DNA, 597 bp, Zea mays
  misc_feature: Ceres CLONE 1518082
  misc_feature: Encodes the peptide sequence at SEQ ID NO. 60002
  misc_feature (544)..(544): n is a, c, t, g, unknown, or other
ataagctggagctccccgcggtggcggccgctctagaactagtggatcccccgggctgcaggaattcgtctcacccctagaaaaatcctccatctcatcacacagagccctttacgacaggacgcgctctcctgatgaatttgccctaaggaaagggttgttcgtttgaaaattgtgcttcttcgatggcggcggatgaaaatgatcgctgtgctgcgatccggggtgcccttgctcttcactttcgctttgctggctgccaagtcgaaggcctaggctgactaagctgggttccgggtcatgattttggattctgatgcgaagtaatcgttgcctccccgcagaagctgagagccaaacagtgtatttaggctaagttgcagccttactacaaccacttttatctcacccggtttccgcccccccaaataagccttttgggaggaaacctcccttttttgaaccttggcttgcgagcggagcaaaaacgggcccctaaaaaaaaaccgtcattttcctttttgggtccaaaataaaatttccncccccctttggggcaaaaagaactaccgcggcgcgggggaataaaattattgg

SEQ ID NO: 60002 - protein, 31 aa, Zea mays
  misc_feature: Ceres CLONE 1518082
MAADENDRCAAIRGALALHFRFAGCQVEGLG

SEQ ID NO: 60003 - DNA, 663 bp, Zea mays
  misc_feature: Ceres CLONE 1518083
  misc_feature: Encodes the peptide sequence at SEQ ID NO. 60004
  misc_feature (497)..(497): n is a, c, t, g, unknown, or other
  misc_feature (546)..(546): n is a, c, t, g, unknown, or other
acaagctggagctccccgcggtggcggccgctctagaactagtggatcccccgggctgcaggaattcgtctcacccctagaaaaaaaaacaaaacaagctcaaacaacgtgtcctggtacagctatagcttcctcgctccgatcccttgcaacaaatcgaacgccatggctcctcgcgctaagaactctctagtggcggagggtgacgtgagcgtgcagaaggtgaagaagatcgagcctgtctacgactacgacctagtcaccagaccctgggtgttcggcaacccgagagtggtgacggtgctggcaaggccgccgccgggtgccggggtttctgtcgcctcaggccagaagaagctgttccagagggcgctgtcagagcaagagatcatcaacgactacatcgccagaaagaagaagcagtttgccggggagatcccatatagtaccctagggtgtttacatatatagtttgagaagagataaaaaaacctacnatttaacccctccctatatatatctatatatgtactcagagagtacatncgttaattatatgggttggggtatggaatttataccctatttcccatttccgaggggttaacccgtcaaaaatcccccgttttagggttgggaaaaagcccttagtaagaaagccgc

SEQ ID NO: 60004 - protein, 101 aa, Zea mays
  misc_feature: Ceres CLONE 1518083
MAPRAKNSLVAEGDVSVQKVKKIEPVYDYDLVTRPWVFGNPRVVTVLARPPPGAGVSVASGQKKLFQRALSEQEIINDYIARKKKQFAGEIPYSTLGCLHI

SEQ ID NO: 60005 - DNA, 647 bp, Zea mays
  misc_feature: Ceres CLONE 1518090
  misc_feature: Encodes the peptide sequence at SEQ ID NO. 60006
  misc_feature (647)..(647): n is a, c, t, g, unknown, or other
ggagctccccgcggtggcggccgctctagaactagtggatcccccgggctgcaggaattcgtctcacccctagaaaaaaggcttgctgatggtggtgtggtcctgccagacaggacttctttgcgtcttactgcgattgaagacgcagaatataaggaagacaaaactcccggccgccgccaccacttgctcgcctttgccccttccccttctgtcacccttcgtccgtagcagaccaggaacgcccaaggcgctagcgtctccaagatggtgctgcaaaacgacattgacttactcaatccaccggcagagcttgagaagctaaagcacaagaagaagcggctagtccagtcccccaactccttcttcatggatgtcaagtgccagggctgtttcagcataaccactgtgttcagccactcccagactgtggttgtgtgcccaggctgccaaactgttctctgccaaccaaccggtgggaaggccaggctcaccgaggggtgctccttccgtcgcaagggcgattaggtcctgcttctcttaacgtgagaagagataaatttggtgttttgcaactttctcaggatatgtgctgtgctcggtgaggattttgttaattattatggctgttagcgtggcctgacaan

SEQ ID NO: 60006 - protein, 86 aa, Zea mays; identical to SEQ ID NO: 44315
  misc_feature: Ceres CLONE 1518090
  misc_feature (30)..(84): Pfam Name: Ribosomal_S27e Pfam Description: Ribosomal protein S27

SEQ ID NO: 60007 - DNA, 638 bp, Zea mays
  misc_feature: Ceres CLONE 1518097
  misc_feature: Translation starting site: 376
  misc_feature: SWISSPROT Homolog: EC 2.7.11.1 Non-specific serine/threonine protein kinase
  misc_feature (580)..(580): n is a, c, t, g, unknown, or other
cgcggtggcggccgctctagaactagtggatcccccgggctgcaggaattcgtctcacccctagaaaaaaaaatttcaagtcgtcaaacattttgctggactcagaattcagtccacacctttcagatgctggacttgcaagctttattcctgatgctgaattccaggcagcagaacagagtgccggatacactgccccagaagtggacatgaccggtcagtacaccctcaagagtgatgtctacagctttggagttgtcatgcttgaactattgataggacgtatgaccatttgacagctctagacccaggtcagagcagtcacttgtgcggtgggcaacaccccagctgcatgacatcgacgcattggacaggatggtcgatcctgcactcaagggtctatacccagccaaatctctatcccgatttgctgatgtccttgccctgtgtgtccagcctgaaccagaattcaggccaccaatgtcagaggtggtgcaagcattggttcgacttgtgcagagggccaacatgacgaagaggatgcttgatggagatacttctcggcgagcagatgacctgnaccaagatttcatatgacaagctgaacctctgtcagatagtatatatttcgttcgacc

SEQ ID NO: 60008 - DNA, 620 bp, Zea mays
  misc_feature: Ceres CLONE 1518109
  misc_feature: Encodes the peptide sequence at SEQ ID NO. 60009
  misc_feature (585)..(585): n is a, c, t, g, unknown, or other
  misc_feature (597)..(597): n is a, c, t, g, unknown, or other
  misc_feature (614)..(614): n is a, c, t, g, unknown, or other
ggatcccccgggctgcaggaattcgtctcacccctagaaaaatttatttttacggtgctcatctttgtcttgcagaaggaggagccctttgccttccccaagaaggcacaagagccgttctccttctcctaggaggcgcaagagtccgtctccatcacaaaagcgttacagaagaaagagaagtccgagtgtcactagctctccagtcgctgcatctcagagttcccaccttgggttggtagagaataagaatgttattgatacacaaaggctagaagaagaaaagaaaaggtgggaagtatctgcttttctatgcagtctacattatttattctacaaacccagctattcactgttgcaccctttctgtaactcttccgtgatgctaacaatgaaattctactaatctagttgctgtttgcaccggaatatatcacaaggtcagctctatttgataatctgttgaccatctgttttcctgagtacatacgtgcaatattatttttggattttgcaagtactacaaacataaatatgatttgagcatctgactgccggatgtgaatcacgtaggttatatgagancattgtggcttnaaggtgcagtgcaattncagtag

SEQ ID NO: 60009 - protein, 43 aa, Zea mays
  misc_feature: Ceres CLONE 1518109
GSPGLQEFVSPLEKFIFTVLIFVLQKEEPFAFPKKAQEPFSFS

SEQ ID NO: 60010 - DNA, 693 bp, Zea mays
  misc_feature: Ceres CLONE 1518117
  misc_feature: Encodes the peptide sequence at SEQ ID NO. 60011
  misc_feature (693)..(693): n is a, c, t, g, unknown, or other
gctctgaactagtggatcccccgggctgcaggaattcgtctcacccctagaaaaaaaacacctatgggcctaggatgaacattgatgatggccgtgttgttagcaacttcattgctcacgctgtgcgcggtgagcccctgactgtcccgaggccaccaaaacccactaggaatttttgttatgatgccgatatggttgacgcccttatttagccttctaaccccatcttacccggttcgatttatttggggcatttacgtgaattcaatcaggaagtacatttgtttcccctcgttcgggcgttccatcatccggaaatggggggttgtacacccacttacacacacccctctttccaccccccgtggcccaatgaaaccccgccatattccccccatgccacaagtaacttgccctcgttatggaatagttcgaagaacccacattgcgtggccgggcctacgccgtgttacccgcatgatgaatatcttccctggcaactggtccggaccagtgcttttagccaagaatcacaacgttacccgctctttccttcgaaagctggcgcgtaggcaaataaacgcggggggggctgcgaaattttacgataatatagagtggagaggagagacgtctcaattagagcgaggaatacaggagaggtgcgaggaaaggtgggcggaagataaagcn

SEQ ID NO: 60011 - protein, 45 aa, Zea mays
  misc_feature: Ceres CLONE 1518117
  misc_feature: SWISSPROT Homolog: EC 4.1.1.35 UDP-glucuronate decarboxylase
MNIDDGRVVSNFIAHAVRGEPLTVPRPPKPTRNFCYDADMVDALI

SEQ ID NO: 60012 - DNA, 681 bp, Zea mays
  misc_feature: Ceres CLONE 1518118
  misc_feature: Encodes the peptide sequence at SEQ ID NO. 60013
  misc_feature (553)..(553): n is a, c, t, g, unknown, or other
  misc_feature (619)..(619): n is a, c, t, g, unknown, or other
gctcttgaactagtggatcccccgggctgcaggaattcgtctcacccctagaaaaagcgcaaacatcgaatcgtctcactcgtgtctgccctgctcatactgcttgccctcgccgtatcgtccacccgcaacgcacaggaggattccatggccaacaacaccgggacgttggtgggcggcatccaggacgtgccggggagcgagaacgaccttcacctccaggagctcgcccgcttcgccgtcgatgaacacaacaagaaggccaatgctcttctggggttcgagaagcttgtgaaggccaagacacaagtggttgctggcacgatgtactatctcactatcgaagtgaagggaggggaagttaaaaaactctacaaagctaaggtccggggaaaaggccgtgggaaaaccttcaaggggctgcaggaaattcaaggcctggttgaaaagggtgctaggcgccccaagggagggcccccttttcccctgggggaagacccgacacgcccaagacaaaatttgccaaaatcagggaacccagggcccccttggngatatttcgctaaggacctccacacccttctaaagggcttcgctttgggattggggtgcgtgtttnccgggggaatatgaaaggggggagtacgttttccctcttaattcagaccaaaaagggcgttt

SEQ ID NO: 60013 - protein, 161 aa, Zea mays
  misc_feature: Ceres CLONE 1518118
  misc_feature (10)..(102): Pfam Name: Cystatin Pfam Description: Cystatin domain
  misc_feature (136)..(136): Xaa is any aa, unknown, or other
  misc_feature (158)..(158): Xaa is any aa, unknown, or other
MANNTGTLVGGIQDVPGSENDLHLQELARFAVDEHNKKANALLGFEKLVKAKTQVVAGTMYYLTIEVKGGEVKKLYKAKVRGKGRGKTFKGLQEIQGLVEKGARRPKGGPPFPLGEDPTRPRQNLPKSGNPGPPWXYFAKDLHTLLKGFALGLGCVFXGGI

SEQ ID NO: 60014 - DNA, 674 bp, Zea mays
  misc_feature: Ceres CLONE 1518122
  misc_feature: Encodes the peptide sequence at SEQ ID NO. 60015
agtggatcccccgggctgcaggaattcgtctcacccctagaaaaaaaagccatcggaggagcaactggacgaccatggcctcgccgctgctcaagtcacactctcagctcgccgccgccgccgccctgcactccgtgaggagagccgaccgctgccctgcgacactacacctgggcaagttccatgaccacgggctcaggtccggccgttctaagagatccggttcagcgagggtgggcgccttcccgtcgctggacgtggtgccgctgatggtgacgatggtggagcacgtggacatgtcgcgggactacgtcgtgaccaagtccatctggcatctcagcgacgtaccccctcaagagcgtctataccttctaccccatgttcaccgtctggggagtctgctttcttccccgtcctgaagggaccctttctacgacagcgaagacgtacaggaacccaggttggcgaccggaaccgtgcccttggtactacccaccgggaaaaaagaacctggaaggccctccgccaaagggaaggaaccttgcttccgggaaggaaaccttcctccaaggaaaaatttgaacctaaaggggtttgggggggccctccaggggaactttggaaagaaaacccgaagccaaagggaggaaaccccccttcccccaaaaggtggg

SEQ ID NO: 60015 - protein, 114 aa, Zea mays
  misc_feature: Ceres CLONE 1518122
MASPLLKSHSQLAAAAALHSVRRADRCPATLHLGKFHDHGLRSGRSKRSGSARVGAFPSLDVVPLMVTMVEHVDMSRDYVVTKSIWHLSDVPPQERLYLLPHVHRLGSLLSSPS

SEQ ID NO: 60016 - DNA, 625 bp, Zea mays
  misc_feature: Ceres CLONE 1518126
  misc_feature: SWISSPROT Homolog: EC 6.3.2.19 Ubiquitin--protein ligase
gctctagaactagtggatcccccgggctgcaggaattcgtctcacccctagaaaaagacgtggacgcaccgtctcaggcgcgtgggtgatgatcccctcgctcgctccctcttattcccaaggcgaggagcggagcggagactacgggccttctgcttgtttctccgctttgagagatgtcctccccgagcaagcgccgcgagatggaccttatgatgctgatgatgatcgacttcacggtggagatggtgaacgacgggatgctggacttctgcgtctaaatcaagggcgcggtcgaaagtatctagctgggtggtgtctggagtgctctgctagaactgcctgatgcgtagccttacgtatccccgtccatcgatttcatgaactggatttatcactgggatagtctcgagatgtcggaggatgtctgcttgtatgtcatagagctaacgtgtagcccatgtgtccgatctcatgagtgatcctgaagtctacattccagttgcgtagtaggacccatgctctcttgtgcaatgcctgaggatgctgccctctgatgatgcgtgtgctgtctgtgtatccaagaaagtgaccgagattgtgttcctttgctacacccacgacg

SEQ ID NO: 60017 - DNA, 772 bp, Zea mays
  misc_feature: Ceres CLONE 1518142
  misc_feature: Encodes the peptide sequence at SEQ ID NO. 60018
gctctagaactagtggatcccccgggctgcaggaattcgtctcacccctagaaaaaggcgacctgttctccagcggcaagctggtggcggtggccgcccgtgtcggtgttccagcagaagagcgtggagaacacgtcaaccagccgggaagggcgcctggccccgcctgcccaacctccttggccccggggttccccgtttacgggtaatcctcccaccaaacaaccccggcccggggccattacgttccaaatagagccccaatgggtttaccctgaagggggtttcttcgtgggggagccacgacaggggtgaggggggaccccgtgcggccgccagttttttttgtgtagaggtggtcggcccccaaattaaaccgggcagaatggtttcccccctctctatgccggggggggggggttgttgcctcttttttgtataaaataattaatttttcttttcagcatagtcgtttcattccctcgcatcatcttgttacggtcacccaaattcccttgccttagggggagcaaaaacccgggagggaagccgaaggggtgaggcgccgccgaggcggggctccccttactattaaccgctgttctctcccgctttcgtggtggtggggggtggtgggcaccgttgttcggtgttatttgctttgtgttgtgggggtgggtcgtcgcttttgcgtgggtatttggtgtgtgcctcggcctaatcgagaacgattatgcagatgtttggaaggtgaatgagagggcggtagtgt

SEQ ID NO: 60018 - protein, 68 aa, Zea mays
  misc_feature: Ceres CLONE 1518142
SRTSGSPGLQEFVSPLEKGDLFSSGKLVAVAARVGVPAEERGEHVNQPGRAPGPACPTSLAPGFPVYG

SEQ ID NO: 60019 - DNA, 788 bp, Zea mays
  misc_feature: Ceres CLONE 1518155
  misc_feature: Encodes the peptide sequence at SEQ ID NO. 60020
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (28)..(28): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
ggggggggggggggggnnnnntgggggngcatcggggggggggggcccccccccnnnnnnnnnnnntttttnnnnnntttaagatggtactccccgcggtggcggccgctctagaactagtggatcccccgggctgcaggaattcgtctcacccctagaaaaaagtgttctcgactcgaccgccgccgtcccagttcgcttcgcgtcacccagagctcgtcggcctccgtccccgcgagaagcgagagcatggacacccaggtgaagcttgctgttgtggtgaaggtgatgggcaggaccggctccaggggtcaggtgacccaggtcaaaatgaagttcttggatgaccaaaaacggtctccttcatggaggaaaagtccaggggcccctgtttcgggagggggaaaatcccccccctgggttgaagttctgaaaagggaaggcccgggaagggtttgcccttgaaaacccccgggggggcccctgggggaaagaaaatattcggggtgaaaatttttggagtgcagaggggagttggtgcgaaaaattttgcccccgggggggaacacttttttaaaaaaagaaacgcggggttttgtggaaagattttcccccctccccccgcggggagaattgccccaaccgtttttttttttttttttccgcagacgcccccccccgagcgcccgggggagaaaaaagcgcgagcttctctgtgctcaaaaaaacaaccaaaaggcctgtgacaaccctgggggggtgcccccccccaatagatagaaactcct

SEQ ID NO: 60020 - protein, 71 aa, Zea mays
  misc_feature: Ceres CLONE 1518155
  misc_feature (1)..(71): Pfam Name: Ribosomal_S28e Pfam Description: Ribosomal protein S28e
MDTQVKLAVVVKVMGRTGSRGQVTQVKMKFLDDQKRSPSWRKSPGAPVSGGGKSPPWVEVLKREGPGRVCP

SEQ ID NO: 60021 - DNA, 649 bp, Zea mays
  misc_feature: Ceres CLONE 1518159
  misc_feature: Encodes the peptide sequence at SEQ ID NO. 60022
tggcggccgctctagaactagtggatcccccgggctgcaggaattcgtctcacccctagaaaaacatacatgtgtaatgtgtaatagatatatatacaaaactgccgaggcgccgacaatactttgcaatggaaaagcaccttcatcatgatcaaaactgtcggcagttccgtcggcgctgatgcgtccaaggtggacaaaccctggctgggtctgggccaggaacaggaaggaagcgacggtcgtcaagcaagacaggatatgtgatcgatcagtagagattacattcgttcgtgcgcgcgtcgtcgtatcttcaagttaagggaaagaataatccaaccgtccgttaattgctcggcttaaatacactgctctactacgtagtactggaattgctaccaccaccaccatgcactactgaagtgaccaagttaagctaggaattgttacataagccggccggtcggccgttcattcacgagattgtttcgctgctggagatgcgcatgcaggctcgcagcatcttcactggtccgcttgaccgcgtattgtgttcgcgcaacgaatggtgcacattccggtacgttttcatttgtctccgacctgtacagtgtgtgtaagcatgtgtttttgcacgggatattccgct

SEQ ID NO: 60022 - protein, 39 aa, Zea mays
  misc_feature: Ceres CLONE 1518159
MRMQARSIFTGPLDRVLCSRNEWCTFRYVFICLRPVQCV

SEQ ID NO: 60023 - DNA, 669 bp, Zea mays
  misc_feature: Ceres CLONE 1518163
  misc_feature: Encodes the peptide sequence at SEQ ID NO. 60024
  misc_feature (188)..(188): n is a, c, t, g, unknown, or other
  misc_feature (471)..(471): n is a, c, t, g, unknown, or other
  misc_feature (591)..(591): n is a, c, t, g, unknown, or other
ggagctccccgcggtggcggccgctctatttctagtggatcccccgggctgcaggaattcgtctcacccctagaaaatccataattaattattgccctttcagttcgccatcggcagccgagcaccatgagctccacaggcggcgacgatggcgccaagaagtcttggccggaagtggtcgggctcancctggaagaagccaagagggtgatcctgtgcgacaagcccgacgccgacatcgtcgtgctgcccgtcggcacgccggtgaccatggatttccgccccaaccgcgttcgcatcttcatcaaccccgtcgcggaggcaccccccctcggctgagaatcaggttttttttttcccccccccggagaaggggggggggggatgtccctcgccgaaaaatggaatgtgtatacctgcagttccaatgaatttgctacgtaaaaagaggggcaaccgccgggtgtgccncgaatgagggggtatcaaaaaaggccactcccttccccggataaaaatttggaaaaaatggccccaaccggtcgcgcgccccccggctatggcaaaagaaattacatcaaacgcgggaancaaaaaacagaccgccgcgagaaaccctagcctctccccagttcccccccccttccccgcgaaaataaaaaccccctc

SEQ ID NO: 60024 - protein, 70 aa, Zea mays
  misc_feature: Ceres CLONE 1518163
  misc_feature (11)..(70): Pfam Name: potato_inhibit Pfam Description: Potato inhibitor I family
  misc_feature (21)..(21): Xaa is any aa, unknown, or other
MSSTGGDDGAKKSWPEVVGLXLEEAKRVILCDKPDADIVVLPVGTPVTMDFRPNRVRIFINPVAEAPPLG

SEQ ID NO: 60025 - DNA, 670 bp, Zea mays
  misc_feature: Ceres CLONE 1518165
  misc_feature: Encodes the peptide sequence at SEQ ID NO. 60026
acccgcggtggcggccgctctagaactagtggatcccccgggctgcaggaattcgtctcacccctagaaaaattccagtcatcgagagcgcggctgcggcggcgagggaacacatcctttctcgcatcatggccacctctacggagccggagggcgcgccgcccgcggctaaggggcctaaaggagaggccaacacgaaggggagcaacgaacatggagaggtcggcgcaggcagcggcggcggctcgcagaagcggaagaggaaggaggtcttcatctacggcaactacaggaactactatggctaccggattgatcgcaatgttggtgaagatcctcgccttgaggcgttcaagaaacagtggtttgagaagaaggattgtctcgatattggatgcaaccagggtttggtaacgattggcttagccatgaaatttaaatgtcaaagcattcttggcgttgatattgattcaggtttaattgagactgctaagtggaatctgcaaaggataatgcggcaggaataggtggctacaaaaaacgtcaaagctcaaaaatcttcgggattcccctcagaactctcccaaaaaaattggcatcctgagtttatcaaatgggaacaaagccccaaaaacttttttaaaattgtccccttttcaacctgaaaaaa

SEQ ID NO: 60026 - protein, 132 aa, Zea mays
  misc_feature: Ceres CLONE 1518165
MATSTEPEGAPPAAKGPKGEANTKGSNEHGEVGAGSGGGSQKRKRKEVFIYGNYRNYYGYRIDRNVGEDPRLEAFKKQWFEKKDCLDIGCNQGLVTIGLAMKFKCQSILGVDIDSGLIETAKWNLQRIMRQE

SEQ ID NO: 60027 - DNA, 665 bp, Zea mays
  misc_feature: Ceres CLONE 1518167
  misc_feature: Encodes the peptide sequence at SEQ ID NO. 60028
  misc_feature (537)..(537): n is a, c, t, g, unknown, or other
aaagctggagctccccgcggtggcggccgctctagaactagtggatcccccgggctgcaggaattcgtctcacccctagaaaaaaatctggccatctatgaggggggtcattcatccgcagagaccggctcccagctcaagtcacccccgaaacgcaggctaaccgaggagccatggcgacagctcctcaggggccgatgggggtggacttcgaggcgctgagctacatcaccagcctgctgtacgccttccaagcattcgactccgacaacaacagctatggtgacggcgcccgaactcccgagcctgctggcgtctctcggcctggccaaatcgcaagcccaagcgcgcgagatgctggctcgcgccgacgccgaccgagatcgacgactcatcgtcgatgaattcatgcacgtgatgaacgctgcgatctcacactgggagcactcggcgcggtgctacatgtcgcgctcgccaccctggatccatcagcaggccctctgatcagcacagacgatctcgcccagtcgctcagangacctcgggcgcaatgactcctaggatggcgccgaattggttggaggccgggaaaaggaaagggggacgggcccttaaccctttgaggaggcgagggctccttgcccaaacgccgcttgggttccaaa

SEQ ID NO: 60028 - protein, 74 aa, Zea mays
  misc_feature: Ceres CLONE 1518167
MVTAPELPSLLASLGLAKSQAQAREMLARADADRDRRLIVDEFMHVMNAAISHWEHSARCYMSRSPPWIHQQAL

SEQ ID NO: 60029 - DNA, 586 bp, Zea mays
  misc_feature: Ceres CLONE 1518168
  misc_feature: Encodes the peptide sequence at SEQ ID NO. 60030
  misc_feature (435)..(435): n is a, c, t, g, unknown, or other
  misc_feature (505)..(505): n is a, c, t, g, unknown, or other
tggcggccgctctagaactagtggatcccccgggctgcaggaattcgtctcacccctagaaaaaaaaaccctagctagcgccgccgccgctgcagactcctccttttcgatcccttcacaaagcgccgccgtcgccccatcgaacatggctccgaagaaggataaggccccgcccccgtcgtcgaagcccgccaagtccggcggtggcaagcagaagaagaagaagtggagcaagggaaagctaaaggagaaggtgaacaacgcggtgctgttcgaccaggctacctacgacaagctgctctctgaggtgcccaagtacaagcagatcaccccctccatcctatccgagcgcctcaggatcaatggctccctggctcggagggctatcaaggacctgatggcgcgtggcctcatccggttggtctcggttcactncagccagcagatctacaccaggggcacaaatacctaaggatgggatttcccttgtttgccctctctgtangagctcgtcttctttaaaacagttgccatctcttgtcaagattttgcgtatgctatggttaaataaattttcccccggggg

SEQ ID NO: 60030 - protein, 108 aa, Zea mays
  misc_feature: Ceres CLONE 1518168
  misc_feature (1)..(106): Pfam Name: Ribosomal_S25 Pfam Description: S25 ribosomal protein
  misc_feature (97)..(97): Xaa is any aa, unknown, or other
MAPKKDKAPPPSSKPAKSGGGKQKKKKWSKGKLKEKVNNAVLFDQATYDKLLSEVPKYKQITPSILSERLRINGSLARRAIKDLMARGLIRLVSVHXSQQIYTRGTNT

SEQ ID NO: 60031 - DNA, 587 bp, Zea mays
  misc_feature: Ceres CLONE 1518169
  misc_feature: Encodes the peptide sequence at SEQ ID NO. 60032
  misc_feature (397)..(397): n is a, c, t, g, unknown, or other
  misc_feature (496)..(496): n is a, c, t, g, unknown, or other
  misc_feature (504)..(504): n is a, c, t, g, unknown, or other
  misc_feature (506)..(506): n is a, c, t, g, unknown, or other
cgcggtggcggccgctctagaactagtggatcccccgggctgcaggaattcgtctcacccctagaaaaaaaatcactcccaccgtctccacagcaaccagcacacatttccctttggcggatcgaaggaaggaaggaggagatgggtggcggcatggaggtgcacaaaaaccggtggatcgaagagtggaacgccggccgggagaacctcgagttcaacttccgctggacccgccgcagcctcgccgtcgtcggcctcttcggcctcgctgtccccatcctcgtctacaagggcatcgtccgcgaattccatatgcaggacgaggatgcaggtcggccatacaggaagttcctgtaagaggcgtccagggctgcaggatacgtcgattcctcgaccngggctgagaggaggggagtttcattcagtttgtgtcggtattgttttagtctgaatctgatgaagcattttggaatgctgaattattgtgcctgatccnaatgaatnanggtgtattgactcgtcttttcaattactgaaacgggacatgtttgaattattttggcacttgtatggaaaatagcagcgtt

SEQ ID NO: 60032 - protein, 71 aa, Zea mays; identical to SEQ ID NO: 58870
  misc_feature: Ceres CLONE 1518169

SEQ ID NO: 60033 - DNA, 631 bp, Zea mays
  misc_feature: Ceres CLONE 1518172
ggagctccccgcggtggcggccgctctataactagtggatcccccgggctgcaggaattcgtctcacccctagaaaaaacagttcctcgccggcactccccccaacccgagcacgctgcgcctccgcttgacccccagccgagtgaggaatgggtaacgttacgggcagcttcggctagcgccggaactagacgcacacggtctgcatccgctgcggacgacgcaacttccacctccggaagagtagctgctcctcctgaggttaccccgccggccgcttccgccagtataactggagtgtgaaggccatctcgtgcaagacaaccggtaccgaaaggatgtacggacttcgcaccacccccctcgccgtgtcgagagcagcttctgacaaggcactgacgctgctccccttaagtaggcgtgccgctgcccactaaagtctggatgtggctttcgggaatcccgataatgccagatcattgggaaccatgtttgcttaaagttggtactttccgaaaccccctcgggaccctggttacccctgggatggcccctgggggttataatttggctttttaattgaaaaggccaaaacccccccgggctggggtttggaaaagtgttccccccc

SEQ ID NO: 60034 - DNA, 644 bp, Zea mays
  misc_feature: Ceres CLONE 1518174
  misc_feature: Translation starting site: 350
  misc_feature (483)..(483): n is a, c, t, g, unknown, or other
taactggagctccccgcggtggcggccgctctagaactagtggatcccccgggctgcaggaattcgtctcacccctagaaaaacttgacccttgccgactccgccgccggccgccgctcctcctctgcgcgtattccgccgcgacctcatcgatcaccttctgactttccatcatggcgagacggcgatgtcgttccggacgttgccgccggagctccctagatgaggacgttccgcctgcactggtaccggcggggcctaccgagatgcgcttctcgacttgtcctcggacgaaccgcgtccagctcttccccgcgcgcgccaggacacaggctcctagaggggtctgatgaggatgaccatggcgctcatcatgaagctgcgcagggcgaaaatagatgctcccgctggggagaaacctgagcccgtcgagacacatctccgtaacatgatcattgtccctgagatgattggaagcattgntcggtcgtctacaacagcttgaccttcaaccatgttgatcatcaagctgatatgatcggcctgctacttgctggactctccatctcctataagccggtcaagcatggccagcccgggatcggtggctcccgctcctcgcggtttatccctccgatacgagc

SEQ ID NO: 60035 - DNA, 621 bp, Zea mays
  misc_feature: Ceres CLONE 1518175
  misc_feature: Translation starting site: 123
  misc_feature (434)..(434): n is a, c, t, g, unknown, or other
  misc_feature (443)..(443): n is a, c, t, g, unknown, or other
  misc_feature (545)..(545): n is a, c, t, g, unknown, or other
  misc_feature (575)..(575): n is a, c, t, g, unknown, or other
  misc_feature (588)..(588): n is a, c, t, g, unknown, or other
gctctagaactagtggatcccccgggctgcaggaattcgtctcacccctagaaaaagctagggttccgtcctcgatccgatccgccgagtgcacaccacctttccccactccgatcgaatcgatggccgccgagggcgagaagaagatgataaccctcaaaagctccgatggcgaggagttcgaggtggaagaggcggtggcgatggagtcgcagaccatccgccacatgatcgaggatgactgcgccgacaacggtatccctcttcctaacgtcaactccaagatcctatccaaggtaatcgagtactgcaacaagcacgtacatgccgccgccgccgccgccgccgcctcgaaggccggttccgacgacgtgggtgccgcctccgccaacagcaccgccgcctcgggtgaggacctcaagaactgggatgcngacttcgtncaggtcgaccaggccacgcttttcgacctcatcttggctgcaaactatctgaacatcaagggtctgctcgacctgacctgtcagactgttgctgacatgatncaggggcagacaccagaagagaattcgcangaccttcaacatncagaatgacttcacccctgaggaggaagaggaa

SEQ ID NO: 60036 - DNA, 855 bp, Zea mays
  misc_feature: Ceres CLONE 1518176
  misc_feature: Encodes the peptide sequence at SEQ ID NO. 60037
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (38)..(38): n is a, c, t, g, unknown, or other
  misc_feature (42)..(42): n is a, c, t, g, unknown, or other
  misc_feature (43)..(43): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
nnnnnnnnnnngggggggcccnnnnnannnnnaggggntttnngtttnnnnntgagaactggggctccccgcggtggcggccgctctagaactagtggatcccccgggctgcaggaattcgtctcacccctagaaaaacgcaacctcccactgcattctcgaattacgattcccaatccagcaaaccctaccagccttttgcaaactcagagagggacccgatggcgcccaaggcggaaaaaaagccggcggcgaaaaaacccgcagaggaggagcccgcggccccggcggagaaggcccccgctgggaataagcccaagggggagaaacggctcccggcgggaaatcccgcggggaggaaggtgggggtgacaagaatggggcggagaagggccttaaaaaaggggggaaaacttttttttccccccccccccagggggggggggggggggagtaatcttatattcctctttcttcctaaaatggggtgtgtacataaaaataaactcgatttggtcaagaagagtggggcggagaggggacccccccgccgtggggtgggccgctgcttttcgttgcgttttaacagaaaatatagaactaaaacaaaaacaccccccgggaggcagcgccgtagaaagcgtcattagaagcctggagaccgggacggcggagtgaaccggaccgcggaccttaagtggggcactaccacccgcggaacccacaacaaatagccgcccacactcgcacactacacggaagaaaatagaaacagggctgtatgcacgatacagaaggacgcggtggggggcgaccggtcctctggcggccgtgggcagaattaacaagaacggg

SEQ ID NO: 60037 - protein, 142 aa, Zea mays
  misc_feature: Ceres CLONE 1518176
MAPKAEKKPAAKKPAEEEPAAPAEKAPAGNKPKGEKRLPAGNPAGRKVGVTRMGRRRALKKGGKLFFPPPPRGGGGGSNLIFLFLPKMGCVHKNKLDLVKKSGAERGPPRRGVGRCFSLRFNRKYRTKTKTPPGRQRRRKRH

SEQ ID NO: 60038 - DNA, 606 bp, Zea mays
  misc_feature: Ceres CLONE 1518177
  misc_feature: Encodes the peptide sequence at SEQ ID NO. 60039
  misc_feature (585)..(585): n is a, c, t, g, unknown, or other
ctggagctccccgcggtggcggccgctctagaactagtggatcccccgggctgcaggaattcgtctcacccctagaaaaaacagcgctgctatttctctatctggcctgctctgatccttgcttgcgtttcgcgtcccgtctgatcttctcgggaagatcatggaggcctgcttgtttttccacagcgggagggcgcacgaggtcgcgtgcgcggagcaggaggaggacatcggctcgccgtcggattccgagtccccgtccacgtccacgtcgagggagtccgcgggatcctcgtcggagctcgatgacgacgccagctcctccggctcggaccgcttcgagatgtccgccctcatgacgcagctccccctcaagaggggcctggtccagttcttcgacggcaagtcgcagtccttcgcctcggtcgccgcccgtggggtcgctggaggacctggcctagccggcccggaagcgcctcatgccgtcgcggagctgctgcggcgccctcgacgcgcaccgcggacgccttctcttcgcgcgcaggcactggaccaagcccgccgccgcgtccgcgccaggaaacngccgcgagtatctgcgggttt

SEQ ID NO: 60039 - protein, 148 aa, Zea mays
  misc_feature: Ceres CLONE 1518177
  misc_feature (142)..(142): Xaa is any aa, unknown, or other
MEACLFFHSGRAHEVACAEQEEDIGSPSDSESPSTSTSRESAGSSSELDDDASSSGSDRFEMSALMTQLPLKRGLVQFFDGKSQSFASVAARGVAGGPGLAGPEAPHAVAELLRRPRRAPRTPSLRAQALDQARRRVRARKXPRVSAG

SEQ ID NO: 60040 - DNA, 639 bp, Zea mays
  misc_feature: Ceres CLONE 1518178
  misc_feature: Encodes the peptide sequence at SEQ ID NO. 60041
  misc_feature (308)..(308): n is a, c, t, g, unknown, or other
  misc_feature (335)..(335): n is a, c, t, g, unknown, or other
cgcggtggcggccgctctagaactagtggatcccccgggctgcaggaattcgtctcacccctagaaaaaacacacactcaccagcaggcagcagctagctagctctctagcaacgagcacaaaacgagcaatgccgctagttccgtcccactccctcgcttcccatcccgcaccccatggaagggagcagcactagctagcgtgggacagggcggggtggtgtcgtggtgatggaagcgggcggcggcgcctcggaactcggcctgctcggcgccggatctggcaggctgctcaagcacgggcgggcngaactctggcggggggagaggaccacngggtgggtcgtcgtcgtcggcggcggcggcagggccaagcaggccaggaccgcgtccgtcggcaccggggacgcggcggccacggcggccgtgccgttcctgctgggctcctgcggcggccccggccacggcggggaacggatgctcagcttctcgtccgccgccgcccgcgccccgggatgatggcgggtgccatgccgccgctgtactacggggaccccggcctcttgctcaggtgagcacggcgaccaaccgggggttggcgcggtggtgctggtgcaaaagcttcttcgtttttcttttc

SEQ ID NO: 60041 - protein, 95 aa, Zea mays
  misc_feature: Ceres CLONE 1518178
MEAGGGASELGLLGAGSGRLLKHGRAELWRGERTTGWVVVVGGGGRAKQARTASVGTGDAAATAAVPFLLGSCGGPGHGGERMLSFSSAAARAPG

SEQ ID NO: 60042 - DNA, 617 bp, Zea mays
  misc_feature: Ceres CLONE 1518181
  misc_feature (294)..(294): n is a, c, t, g, unknown, or other
  misc_feature (331)..(331): n is a, c, t, g, unknown, or other
  misc_feature (332)..(332): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (477)..(477): n is a, c, t, g, unknown, or other
  misc_feature (520)..(520): n is a, c, t, g, unknown, or other
  misc_feature (545)..(545): n is a, c, t, g, unknown, or other
  misc_feature (559)..(559): n is a, c, t, g, unknown, or other
  misc_feature (588)..(588): n is a, c, t, g, unknown, or other
  misc_feature (614)..(614): n is a, c, t, g, unknown, or other
  misc_feature (616)..(616): n is a, c, t, g, unknown, or other
atagctggagctccccgcggtggcggccgctctagaactagtggatcccccgggctgcaggaattcgtctcacccctagaaaaagtgctttcttagaggtgggttggcttctcctccccctccggttcgggttcgggttcgtgaggttctccggggttcggtttcgtgggtgagcggatcgagatggcgcgtcggagttgagtacgctgcttgtcggcggcctcgcctgggcccggacgacactccctccaacgccttcgcacctacgggagtctccagtccagatcatcctcnaatcgggaaaccagaggtccgccggcttccggtttcnncccccttctccccggaggaagccaacccccacccgccccggggggggggtgaaccgcgaaggaaccttgcccccccgcgggnnnnnnnannnnnnnnnnnnnnacccaaataaggcccattccccggggggggccccgggaaaanccgcccccccttgtgttccccggggggggccccctaagaaggngggcttttcccgaggttgcgccggnccccctgtgttggncgcgccgcatctcaatgggggtggccccnggggttcctagggggggcgggcgggntna

SEQ ID NO: 60043 - DNA, 637 bp, Zea mays
  misc_feature: Ceres CLONE 1518182
  misc_feature: Encodes the peptide sequence at SEQ ID NO. 60044
aaagctggagctccccgcggtggcggccgctctagaactagtggatcccccgggctgcaggaattcgtctcacccctagaaaaagtagagctccctgctttgttcagacttcagagcccttcctcttgtgtccgtgcaaattggtgatacttgaacagggatctcctccatattagtgagcaggatgtataatcctcccagtgggcaggacatgtcctactacgatcatgtgcagaagcgccatgaggagaagggctgcctatatgcatgcctgttcactgcgtgctgctgcttctgctgcttcgagacctgtgagtgctgcctcgaggctatctgctgctgctgctagttctgctttggaggcatgggcgtccatcatcgtggagatgtggccatgcgggacacccaccgccgaataaaatgctgtacttatatgcacgcacgttagaaatgcattagtggccgtttgatgtgatcctttttggggggggtgcccgcatcttcttttgcactggaaaatgctttattatttggtgaaaggctggaaatcccggttgaagggatccttggccaaattaaaatcctattattggtgcattatatcctcccctttgattgggccaaaaaaaaaaaaaaa

SEQ ID NO: 60044 - protein, 54 aa, Zea mays; identical to SEQ ID NO: 48310
  misc_feature: Ceres CLONE 1518182

SEQ ID NO: 60045 - DNA, 648 bp, Zea mays
  misc_feature: Ceres CLONE 1518183
  misc_feature: Encodes the peptide sequence at SEQ ID NO. 60046
  misc_feature (648)..(648): n is a, c, t, g, unknown, or other
ggcggccgctctagaactagtggatcccccgggctgcaggaattcgtctcacccctagaaaaatgcctcggtcggtcgaacaatcttcaataacccagtcggcaggcgtgacccgatgctctctcgtcgtcggatcgccgccaccgtctcctccgcgtctacaccgatatggacgaccggcagtatgccggactgaccaaggcaggcttgggcgtgctggccttcaactcgggcctcgccatctacaactcctggggcgacgcgagctccgtcgcgttcgtgctctccgcggactccatcctcgtgctgctcttcctctgcctccgtgagctggagctgcacgggcggggggccgccggcaggggcaggtatgtcgggatcatcacagccgcggtgtggacgctgacgacgctgctctgcgccatgttcgcgtctagggtggcgccgctgatgccgcccgtcgtctgcgcgctcgtctgggcgacggctgtggccactgccgccggcggcttctgggcggtcttcctcatctgaatgtttaggcttaattcgacgagagagtgatcctgtgcgtgctactagctagttggttaccatatttgcacttttgtatgcacaggatatttatgaaggtcgctttctgcattn

SEQ ID NO: 60046 - protein, 121 aa, Zea mays
  misc_feature: Ceres CLONE 1518183
MDDRQYAGLTKAGLGVLAFNSGLAIYNSWGDASSVAFVLSADSILVLLFLCLRELELHGRGAAGRGRYVGIITAAVWTLTTLLCAMFASRVAPLMPPVVCALVWATAVATAAGGFWAVFLI

SEQ ID NO: 60047 - DNA, 603 bp, Zea mays
  misc_feature: Ceres CLONE 1518191
  misc_feature: Encodes the peptide sequence at SEQ ID NO. 60048
aaagctggagctccccgcggtggcggccgctctagaactagtggatcccccgggctgcaggaattcgtctcacccctagaaaaagtccacccatcgcttctcccgctcgtcctcctcctctcctcctggacagcagagcacggcacaacacaccgagaaagaacaagcagccgccaccggagctcagaaccaccatcagcagcagcagcacacccggtcaaccttccacacacgcgcgcacacacacatggcgtcgcagcagaggcaacagcaggcgggagcggcggcggcggcgtcctccgccgtgggcttcgaggactacctgccggtgatggcggagcggctgggcgaggacgggctgatgcgggagctggcgagcgggttccggctgctgatggacccggcgcgcgggctcatcaccttcgacagcctccgccgcaacgcgccgctgctgggcctgggcggcatgtcggacgccgacctccgcgggatgctcgccgagggcgactttgacggcgacggcgcgctcagcgagacggagttctgcgtcctcatggtgcgccttcaccccccaactcatggaacaaaccccagggggggggc

SEQ ID NO: 60048 - protein, 118 aa, Zea mays
  misc_feature: Ceres CLONE 1518191
  misc_feature (78)..(106): Pfam Name: efhand Pfam Description: EF hand
  misc_feature: SWISSPROT Homolog: EC 2.7.11.1 Non-specific serine/threonine protein kinase
MASQQRQQQAGAAAAASSAVGFEDYLPVMAERLGEDGLMRELASGFRLLMDPARGLITFDSLRRNAPLLGLGGMSDADLRGMLAEGDFDGDGALSETEFCVLMVRLHPPTHGTNPRGG

SEQ ID NO: 60049 - DNA, 627 bp, Zea mays
  misc_feature: Ceres CLONE 1518194
  misc_feature: Encodes the peptide sequence at SEQ ID NO. 60050
ggagctccccgcggtggcggccgctctagaactagtggatcccccgggctgcaggaattcgtctcacccctagaaaaaaaaccaatcagatagagagagcatagtcgatcatgaagggtggcaagaaggaagtggccggtgcgatggtggccatactgctggttctgcagctcatggcagctccaccgacggccatggccgcccgctcgccgcacggagccgtgccggatggctccctcgccacgacgcccaaggtgacgatgctgtcggccacgctgtgctacacgggggagacatgcaaatacattggctgcctcactcctgcttgctcctgcaactatagtgatcgtctatgctacatcatatttactcctgttgcttgaggccattccgcgaagccacaactcttacaatatgcatgcgccggccgacgacgacacgcgctgcctctcgtgagcttctgttcaagtgatgcatgtttcaaggcatccatggatgctttacgtatatgcgtattaattagccgtgtcagggaaccggacagaaggcggtgtttgttttatatttaccgtcttctggtgatcaaaaaaaggggaaaatatttgtttggatggtgtgcaaaaaaaa

SEQ ID NO: 60050 - protein, 90 aa, Zea mays; identical to SEQ ID NO: 58696
  misc_feature: Ceres CLONE 1518194

SEQ ID NO: 60051 - DNA, 643 bp, Zea mays
  misc_feature: Ceres CLONE 1518198
  misc_feature: Encodes the peptide sequence at SEQ ID NO. 60052
aaaagctggagctccccgcggtggcggccgctctagaactagtggatcccccgggctgcaggaattcgtctcacccctagaaaaacaactcgcaattccgcattcgttccaactcctgagcactttctcctcgtccccgacaagccaatcgaagccgagatacggccatggactccaccggcaccggagcagggggtaaggggaagaagggagcggccgggcgcaaggtcggcgggccaaggaagaagtcggtgtcgaggtccgtgaaggccgggctccagttccccgtcggccgcatcgggcgctacttgaagaagggccgctacgcgcagcgtgtcggcaccggcgcccccgtctacctcgccgctgtcctcgaatacctgcgcgctgaggttctggagctcgctggtaatgctgccagggacaacaagaagactcgcattatcccgcgccacgtgcttctggcgatccggaacgacgaggagcttgggaagctgctgggcggggtgaccatcccctcacggggtgtgctccccaatatcaccctgtcctgctggccaaaaagacagcggagaatgcctccagtggggggaccaaagaggcaaagtcccccaagaagcccgcctagccccccagaaaggtt

SEQ ID NO: 60052 - protein, 158 aa, Zea mays
  misc_feature: Ceres CLONE 1518198
  misc_feature (31)..(104): Pfam Name: Histone Pfam Description: Core histone H2A/H2B/H3/H4
  misc_feature: SWISSPROT Homolog: EC 2.7.7.7 DNA-directed DNA polymerase
MDSTGTGAGGKGKKGAAGRKVGGPRKKSVSRSVKAGLQFPVGRIGRYLKKGRYAQRVGTGAPVYLAAVLEYLRAEVLELAGNAARDNKKTRIIPRHVLLAIRNDEELGKLLGGVTIPSRGVLPNITLSCWPKRQRRMPPVGGPKRQSPPRSPPSPPER

SEQ ID NO: 60053 - DNA, 727 bp, Zea mays
  misc_feature: Ceres CLONE 1518209
  misc_feature: Translation starting site: 329
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (26)..(26): n is a, c, t, g, unknown, or other
  misc_feature (28)..(28): n is a, c, t, g, unknown, or other
  misc_feature (30)..(30): n is a, c, t, g, unknown, or other
  misc_feature (35)..(35): n is a, c, t, g, unknown, or other
  misc_feature (38)..(38): n is a, c, t, g, unknown, or other
  misc_feature (39)..(39): n is a, c, t, g, unknown, or other
  misc_feature (42)..(42): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
ttttttttttttttttnnnntttttntntnccttnctnnttnggaagaannnnnccaaaactggagctccccgcggtggcggccgctctagaactagtggatcccccgggctgcaggaattcgtctcacccctagaaaaagcgcaaacatcgaatcgtctcactcgtgtctgccctgctcatactgcttgccctcgccgtatcgtccacccgcaacgcacaggaggattccatggccaacaacaccgggacgttggtgggcggcatccaggacgtgccggggagcgagaacgaccttcacctccaggagctcgcccgcttcgccgtcgatgagcacaacaagaaggccaatgctcttctgggggttcgagaagcttgtgaaggccaagacacaagtggttgctggcacgatgtactatctcactattgaagtgaaggatggcgaagtcaagaagctctacgaagctaacgtctgggagaagccatgcgagaacctcaaggggctgcaggaattcaagcctgttgaagagggtgctagccgccttaagatgtcttccttctccatgtgcgagcctgaaagcttcaaacaaatgttgcagaataaggaagccatgcctccctttgtgtaattttcataaaaaactaacaaccctatttaggggctttgtttggggttggggtcctggaatccaaaggggaaatttgaaaggtgaatttaaattttttct

SEQ ID NO: 60054 - DNA, 770 bp, Zea mays
  misc_feature: Ceres CLONE 1518210
  misc_feature: Encodes the peptide sequence at SEQ ID NO. 60055
  misc_feature (1)..(1): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (40)..(40): n is a, c, t, g, unknown, or other
  misc_feature (41)..(41): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (52)..(52): n is a, c, t, g, unknown, or other
  misc_feature (54)..(54): n is a, c, t, g, unknown, or other
  misc_feature (57)..(57): n is a, c, t, g, unknown, or other
  misc_feature (58)..(58): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
nttttttnnnnnnnnnnnnnnnnnnnnnnnnntttttttnntttnnnnnntntnttnntttnnntttttgtagacagccaaaaactggagctccccgcggtggcggccgctctagaactagtggatcccccgggctgcaggaattcgtctcacccctagaaaaatagccgcctgcctctcctcctccagagctcgtcgccaccggccaccgccaccctcgatcacgccgtccgtcgaggtaaggtcagcatggtgagggtcagtgtgctcaacgatgcgctcaagtccatgtacaacgctgagaagatcggcaagaggcaggtcatgatcaggccgtcgtccaaggtcatcatcaagttcctgacggtcatgcagcgccacggctacattggagagttcgagtacgttgatgaccaccgatcgggcaagatcgtggtcgaactcaacgggaggctgaccaagtgcggcgtcatcagccctcgctttgaaatcggcgtgaaagacattgagggatggactgcaagggtgctcccggccaggcaggttcggataattcgtcctcacaatttcgggagggattctgggaacccaggaagcccccccggaaaaacgttagggggccaggggtccagggttcctcctattgaaaaaaccgaaaaactcttttttaaggcccgggccggccggtttttactcccccaaaaaaaaaaaaaaacccggttattttttcactttaaaataggccccccccccaaaaaaaaaaaggcccg

SEQ ID NO: 60055 - protein, 173 aa, Zea mays
  misc_feature: Ceres CLONE 1518210
  misc_feature (5)..(102): Pfam Name: Ribosomal_S8 Pfam Description: Ribosomal protein S8
MVRVSVLNDALKSMYNAEKIGKRQVMIRPSSKVIIKFLTVMQRHGYIGEFEYVDDHRSGKIVVELNGRLTKCGVISPRFEIGVKDIEGWTARVLPARQVRIIRPHNFGRDSGNPGSPPGKTLGGQGSRVPPIEKTEKLFFKARAGRFLLPQKKKKTRLFFHFKIGPPPKKKKA

SEQ ID NO: 60056 - DNA, 829 bp, Zea mays
  misc_feature: Ceres CLONE 1518213
  misc_feature: Encodes the peptide sequence at SEQ ID NO. 60057
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (49)..(49): n is a, c, t, g, unknown, or other
tttttttttttttttttttttnnntttttttttttnnnnngcggaaaanaaaaaaggtggagctccccgcggtggcggccgctctagaactagtggatcccccgggctgcaggaattcgtctcacccctagaaaaagagcttatcccctcccgtctaggcgacgacgacgacgaagcagcgggaggagcataagcgccgccgatcccgagcctccgagcgtgttctcccctcatcctccgcctcgtgccgcagatccctacgtactccgcccgccagccatggcccgctcctcctcgcagtcgcagtcctccgttggcgccggcgccggcgccggcgcgcgcccggccaccgtcgggccgcgcggcacggccgcggcggccgccgggatgcggcgctgatgtgccacacggggtccgggggggggtgggggatacagaggagggcgggggggggcaacatgatcatgcattctaaagcagacgaagagggcggggggatccggaattccaaaccaaacaaaggaagcggcggtacttggccactacgggcgtacgttacgagctatgaagtaaaagaaacatgaggagttcctttccaggatagactatttgcatgagtgcccggggaccttcccgcggccccgtgtgtgcggtgtgtgtgtggttgtggattacgttcctgaccttataagaaacacacgtcacttcggagaactatggctccgactcggtgccgcaatcgcggagaagggtcctcgtggtatgcctgggaaacgactgagaaaatagcctcgcgcaaccgttgaaggagcgcggggaagaaggaaag

SEQ ID NO: 60057 - protein, 39 aa, Zea mays
  misc_feature: Ceres CLONE 1518213
MARSSSQSQSSVGAGAGAGARPATVGPRGTAAAAAGMRR

SEQ ID NO: 60058 - DNA, 630 bp, Zea mays
  misc_feature: Ceres CLONE 1518215
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (321)..(321): n is a, c, t, g, unknown, or other
  misc_feature (540)..(540): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggggggggggggcaaagctggactcccctcggtggcggccgctctagaatagtggatcccccgggctgcaggaattcgtctcacccctagaaaaataggggccatcagatccaagaagagggaagagcaccaaggaccttcggcgcccgttcaggatccacantcttccccgaagcgaagttctttggggttggaccctccttcccccctcggaccacctccaaaggctccctgggggtaaacttggcccacttccttttttccccccccaaatttcccaaaaggtttttttttaaaggggggcccgaaaaaaccccccaaaaaaattttttaaaaaaaccccccccaaaatggggggcttttaaaaaaaccccccccttgnccccctttttaaagaaccccccccttggggtggggggttgggggggggggggaaaaaccccccccccggggggggggggggggggaaaac

SEQ ID NO: 60059 - DNA, 661 bp, Zea mays
  misc_feature: Ceres CLONE 1518219
  misc_feature: Encodes the peptide sequence at SEQ ID NO. 60060
  misc_feature (516)..(516): n is a, c, t, g, unknown, or other
  misc_feature (519)..(519): n is a, c, t, g, unknown, or other
  misc_feature (527)..(527): n is a, c, t, g, unknown, or other
  misc_feature (532)..(532): n is a, c, t, g, unknown, or other
  misc_feature (576)..(576): n is a, c, t, g, unknown, or other
  misc_feature (593)..(593): n is a, c, t, g, unknown, or other
  misc_feature (607)..(607): n is a, c, t, g, unknown, or other
ggagctccccgcggtggcggccgctctagaactagtggatcccccgggctgcaggaattcgtctcacccctagaaaaaaatcccctccccacatcgggaaccgccgccgacgccgcaggaggagacgcatcgaggttagcacgcgaagaagcgaccatgagggccaagtggaagaagaagcgcatgaggaggctcaagaggaagcgcagaaagatgaggcagagatccaagtaggcagatcgagatggattgtggacctgatgacatgcgtgggtacatacatttcttcggatgcgttggtgtgcctgtggagagatgtcaacctgccatggtgtcacggtccgccatcagttgaacgtcttgcctgcacttcagtaggccacttttcatggttctagttgtatttgaatccagcgtttgccactaagataaatcagacagtcgttttgtgaacctattatgatggagctttatttgctgataatatctagctacctatttgagctgaggaaaaanaanaaaaaaanaaganaagaagaagaaaatagaaaagagaaaaagagagaaggggagaanaaaaaaaatggaagganaaaaggggaaaaanaatgagtggggggggtccgggggacccctttcccccttaggggggcgtaatccg

SEQ ID NO: 60060 - protein, 45 aa, Zea mays; identical to SEQ ID NO: 10997
  misc_feature: Ceres CLONE 1518219

SEQ ID NO: 60061 - DNA, 643 bp, Zea mays
  misc_feature: Ceres CLONE 1518220
  misc_feature: Encodes the peptide sequence at SEQ ID NO. 60062
  misc_feature (543)..(543): n is a, c, t, g, unknown, or other
aagctggagctccccgcggtggcggccgctctagaactagtggatcccccgggctgcaggaattcgtctcacccctagaaaaaatcatccagtgctctctcctcttgcgattcgctcgctcgatcctagcttcccttccaagaagcgcagcgcccatggccatggccacgcaagcctccgccgccacgcgccacctgctggccgccgcctgggcgccggcggcgaagccgcggcagctgagctcgcagctcgcgctgccgtcgtcgtcctcccgcgggccggccccgctccgcgcgtccaccgaggaggcggtggaggcgcccaaagagttcgtggccccgcagctggaccccagcacgccccccccgatcttcggcggcagcacgggcgggttgctcctcatggcccccgtggaggaagttctcgtcatcacgtggacgtcccccaaggagcaggtgttccaagatgcccaccagacaggcccccccattcatgccgtgaaggcccccaaccctcttgaaactcggcacccaagagagaagngccctgggcgctccgcccccagagtgccgcccccgagaacaaagaataaccaaacaagttactaccagggctcttcaccccaagggcgaaagcaccacaa

SEQ ID NO: 60062 - protein, 162 aa, Zea mays
  misc_feature: Ceres CLONE 1518220
  misc_feature (130)..(130): Xaa is any aa, unknown, or other
MAMATQASAATRHLLAAAWAPAAKPRQLSSQLALPSSSSRGPAPLRASTEEAVEAPKEFVAPQLDPSTPPPIFGGSTGGLLLMAPVEEVLVITWTSPKEQVFQDAHQTGPPIHAVKAPNPLETRHPREKXPGRSAPRVPPPRTKNNQTSYYQGSSPQGRKHH

SEQ ID NO: 60063 - DNA, 634 bp, Zea mays
  misc_feature: Ceres CLONE 1518221
  misc_feature: Encodes the peptide sequence at SEQ ID NO. 60064
  misc_feature (493)..(493): n is a, c, t, g, unknown, or other
aaagctggagctccccgcggtggcggccgctctagaactagtggatcccccgggctgcaggaattcgtctcacccctagaaaaaagagcagccaagcgccacacgccgacgcgaaccaaccagatggtagtaggttagctaagctcgggatcggaggagaggtgccccgcgaccctgacgatgacgatgcctcgccgcgcccttctcttcgccgcggtgctcctcgcggcctctgccgccgcggtctccgcgttccacctcgccggggacgagagcggcctcgtgaggggcgtgctcacagcggtccgcgagcgggccgaggccgaggccgaggacgccgcgcgcttcgccgtcgcctaccacaacaggaaccagggtgctgctttggagttcactagggtgctcaaatcgaagcggcaggttgtgaccgggaccctgcatgacctgatactggaggcagctgatgctggaaaaaagagtctgtacagagcanaagtctgggtgaagccgtgggaggatttcaagtccgttgtcgagtttcgccttgctggagactctgaatctgaacccgagccttctgttgcttctgatgaaggctctgggcaaagagtgccaagctctctcttgaagcaaa

SEQ ID NO: 60064 - protein, 151 aa, Zea mays
  misc_feature: Ceres CLONE 1518221
  misc_feature (37)..(124): Pfam Name: Cystatin Pfam Description: Cystatin domain
  misc_feature (105)..(105): Xaa is any aa, unknown, or other
MTMPRRALLFAAVLLAASAAAVSAFHLAGDESGLVRGVLTAVRERAEAEAEDAARFAVAYHNRNQGAALEFTRVLKSKRQVVTGTLHDLILEAADAGKKSLYRAXVWVKPWEDFKSVVEFRLAGDSESEPEPSVASDEGSGQRVPSSLLKQ

SEQ ID NO: 60065 - DNA, 702 bp, Zea mays
  misc_feature: Ceres CLONE 1518222
  misc_feature: Encodes the peptide sequence at SEQ ID NO. 60066
  misc_feature (702)..(702): n is a, c, t, g, unknown, or other
gctctagaactagtggatcccccgggctgcaggaattcgtctcacccctagaaaaactcgcgccgccgcggaacacaacaccgcaccacactacccagcggaatccgcccacccgcacccgcacccggagcagaggagatatgtcgcaggggaagggaggagcggcgaggaaggaggaggtggtcaccagggagtacaccatcaacctccacaagcgcctccacggctgcacattcaagaagaaggcacccaacgccatcacggagatcaggaagtttgcgcagaaggccatgggcaccccggacattaggatcgatgtgaacctcaacatccacctcccccccagcggggaggggggggggggccgcggaagggtttcgtggtgagaatccccccgcaaagagggaactgcctaggtaggaatgcccgggggaggaagctcctccctcccctttgtcgaccggttggcaggaagatcccccgcccaaggggttttgtagtgggctggggggaccccaggttggtttcacggaacccccctttgagggtgtgggcgtggttcctaccatcttttgggtgtgagtgtaggtggttttgtgtttttgtaaacaatctgaacacctttttgtattagacccgggttggggtcgtttccccggccaccgatagcgggcgggggtttggctttttttgtttgttgan

SEQ ID NO: 60066 - protein, 81 aa, Zea mays
  misc_feature: Ceres CLONE 1518222
  misc_feature (10)..(71): Pfam Name: Ribosomal_L31e Pfam Description: Ribosomal protein L31e
MSQGKGGAARKEEVVTREYTINLHKRLHGCTFKKKAPNAITEIRKFAQKAMGTPDIRIDVNLNIHLPPSGEGGGGRGRVSW

SEQ ID NO: 60067 - DNA, 650 bp, Zea mays
  misc_feature: Ceres CLONE 1518225
  misc_feature: Encodes the peptide sequence at SEQ ID NO. 60068
  misc_feature (613)..(613): n is a, c, t, g, unknown, or other
aaagctggagctccccgcggtggcggccgctctagaactagtggatcccccgggctgcaggaattcgtctcacccctagaaaaagcctaaacctaatccactagcagttcggcactgcggctgcggggatgcggcggccggcggcagcggcactacggagcccccagccagcaccaggttgcggcaacggcaacaaccagcaagtggccagcgattcacgggttcaggcgttcagcgccacgccgtcgtcgccccaagccaggtgtagttattagtttagtacactgctcagtgctcagttagacagttacatggaatgctcaatagacctccagtcaggaaccaccgattgtgatttgtgaagaactgtgaattgattaactgaagatgtcaaatagtggaggcaagggatgtcgttcccgtgctagatcaatgccacccgagaagcaactaggtatttcaagtttcttgcctgaacctccaccgccgcctccctctacgaaaggtagtaccaacggtcagccctgcagggatgatgaggaacaagatgctggaagtgatcccgacgtcatgaatgaatatggtgaagctttgaccgtgagtcaccgactantcatggtggcttaaggcctgacaacatggtttggaac

SEQ ID NO: 60068 - protein, 48 aa, Zea mays
  misc_feature: Ceres CLONE 1518225
MRRPAAAALRSPQPAPGCGNGNNQQVASDSRVQAFSATPSSPQARCSY

SEQ ID NO: 60069 - DNA, 632 bp, Zea mays
  misc_feature: Ceres CLONE 1518227
  misc_feature: Translation starting site: 254
gatagctggagctccccgcggtggcggccgctctagaactagtggatcccccgggctgcaggaattcgtctcacccctagaaaaaatcttctcccccagctccccagcaccagtccccaattatttggcctccgtcagagaggggagaaagacccgttcgaggcggcggcgatgtcggggcgcggcaagggcggcaagggtctgggcaagggtggagccaagcgccaccggaaggtgctccgcgacaacatccatgggcatcaccaagccggcgatccggaggctgggctcggaggggcggcgtgaatcgcatctcggagctcatctacgagtgacccgcggcgtgctcaggattctcctcgagaacgtcatcgcgacggcgtcacctacaccgagcacgcgccgcccaagaccgtccccgccatggatgtcgtctaccccctcaggcgcaagggccgacccctctacgggttcggaaggctaggcgccccttcctaacggggaatgcttagggggaaccccccccttcccggggggggcaattggtccccgctccccgaatgaaaccatttttttttttccccaaaaaaaaaaacccgggaaccccccccccgggcaaaaaaaaaaaaaaa

SEQ ID NO: 60070 - DNA, 645 bp, Zea mays
  misc_feature: Ceres CLONE 1518233
  misc_feature: Encodes the peptide sequence at SEQ ID NO. 60071
  misc_feature (392)..(392): n is a, c, t, g, unknown, or other
catagctggagctccccgcggtggcggccgctcctagaactagtggatcccccgggctgcaggaattcgtctcacccctagaaaaagcccagatagatctttcccccgtcctccctcgccttcgccttcgccggcaggagatttccaccaccaccgccgaaccgccccgaccctcctcccctctcgcgctatggcccagactgttgtgctcaaggttggcatgtcctgtgagggctgtgttggagctgtcaagcgggtcctcggcaagatggaaggcgtcgagtcctacgacgtagacatcatggaacagaaggtcaccgtgaagggcaatgtgacacctgaccccgtcctgcattctgtttcccccactggcaagaggacggcgttctggnagacttaagccctgacaaattaatcccgccacacctgccggtggccccgccctgacaggttcgaatgatctggaattgccccggcaaggagggaaaaaaaaaaaaatgtaaatggtgtttgccttggatccgttaccaaattatttggcaactgctaggctcggtctgtgacatttttacaattgccttttcccgggtgccggggagggtccccaaaaattttgggggaaattaaaaaccccattattttgtt

SEQ ID NO: 60071 - protein, 69 aa, Zea mays
  misc_feature: Ceres CLONE 1518233
  misc_feature (5)..(66): Pfam Name: HMA Pfam Description: Heavy-metal-associated domain
  misc_feature: SWISSPROT Homolog: EC 3.6.3.4 Copper-exporting ATPase
  misc_feature (68)..(68): Xaa is any aa, unknown, or other
MAQTVVLKVGMSCEGCVGAVKRVLGKMEGVESYDVDIMEQKVTVKGNVTPDPVLHSVSPTGKRTAFWXT

SEQ ID NO: 60072 - DNA, 661 bp, Zea mays
  misc_feature: Ceres CLONE 1518236
  misc_feature: Encodes the peptide sequence at SEQ ID NO. 60073
  misc_feature (235)..(235): n is a, c, t, g, unknown, or other
  misc_feature (295)..(295): n is a, c, t, g, unknown, or other
  misc_feature (318)..(318): n is a, c, t, g, unknown, or other
  misc_feature (326)..(326): n is a, c, t, g, unknown, or other
  misc_feature (337)..(337): n is a, c, t, g, unknown, or other
  misc_feature (390)..(390): n is a, c, t, g, unknown, or other
  misc_feature (391)..(391): n is a, c, t, g, unknown, or other
  misc_feature (392)..(392): n is a, c, t, g, unknown, or other
  misc_feature (393)..(393): n is a, c, t, g, unknown, or other
  misc_feature (394)..(394): n is a, c, t, g, unknown, or other
  misc_feature (402)..(402): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (465)..(465): n is a, c, t, g, unknown, or other
  misc_feature (506)..(506): n is a, c, t, g, unknown, or other
  misc_feature (507)..(507): n is a, c, t, g, unknown, or other
  misc_feature (535)..(535): n is a, c, t, g, unknown, or other
  misc_feature (552)..(552): n is a, c, t, g, unknown, or other
  misc_feature (573)..(573): n is a, c, t, g, unknown, or other
  misc_feature (592)..(592): n is a, c, t, g, unknown, or other
  misc_feature (621)..(621): n is a, c, t, g, unknown, or other
aaatctggagctccccgcggtggcggccgctctagaactagtggatcccccgggctgcaggaattcgtctcacccctagaaaaaacggagagcaaaggcagcacactcagctatccagcaaaagagatcgagaggcaggagtcatggccaccgtcagcgccgccgtggtgaccaccatcgttgcccgcgccgcgatcgccaggcccaatgctctagggctgcctgcgctgagggngaggagcgagagggtgcggtgcaactactccaaggacgcggccccagtctgcccaaaggngcaggcgcgtcgctgctcgccgnttcggggngcgtgaccgcntcagcgggcccccgcttttttcccccccccccgcgggggggggggggggggannnnnacttaacntcannntcnnnaacaacctgatggagggggaccccccggggggcctgcgggccccatctggtncctcttaaactacttaaacctctttacctcgacgaaggagnnggaactcccgcggccctcccccccctgnttccccccccccccccnggtaacaggatcgtaaagganggacatggcggccgggttntccagctgttaactctgacacctcgccgnctttcccccccaacgagcccccctcctgtttgtcggtaca

SEQ ID NO: 60073 - protein, 62 aa, Zea mays
  misc_feature: Ceres CLONE 1518236
  misc_feature (31)..(31): Xaa is any aa, unknown, or other
  misc_feature (51)..(51): Xaa is any aa, unknown, or other
  misc_feature (59)..(59): Xaa is any aa, unknown, or other
MATVSAAVVTTIVARAAIARPNALGLPALRXRSERVRCNYSKDAAPVCPKXQARRCSPXRGA

SEQ ID NO: 60074 - DNA, 709 bp, Zea mays
  misc_feature: Ceres CLONE 1518240
  misc_feature: Translation starting site: 625
  misc_feature (128)..(128): n is a, c, t, g, unknown, or other
  misc_feature (152)..(152): n is a, c, t, g, unknown, or other
  misc_feature (372)..(372): n is a, c, t, g, unknown, or other
  misc_feature (523)..(523): n is a, c, t, g, unknown, or other
  misc_feature (700)..(700): n is a, c, t, g, unknown, or other
  misc_feature (709)..(709): n is a, c, t, g, unknown, or other
tctagactagtggatcccccgggctgcaggaattcctctcacccctagaaaaaattcctcggagaggagaagccgccgtcgcatcaatcacagcagcccggagaacggccaggtccgacaagatgcanatctttgtgaagacgctgacaggnaagaccatcaccctcgaggtcaagagcagcgacaccatcgacatgtccaggccaaaatccaggacaagaagggatcccgcccggaccatcctctgtttaatttttcccggaaagagagtgggagatggcccaacatcttttttatttttaaatcccaaatgtatgtttagggtcttttttttttttcccccccccccccggggggaaagcaggggggatnaccccctatttttcccccccccccgaatttccgccaagaaaaagaaaatataatccctaccacgcgcgctgggggagcccaccacacccgtatatgttacaggaaccgcgcggcacgaggaggagaggggagccaaacgagacaccgagtnttaacaaccaacactaaccactacagcagacgctagtactcgtcgcccctcgcagaacatacttaaccccacagacgctttgctacaagatggcctcaacgatggacccgccgcccagacaaaataaaaaggcgagaaagcacactcacagagcacactacgccgcttataatatanacagatttn

SEQ ID NO: 60075 - DNA, 632 bp, Zea mays
  misc_feature: Ceres CLONE 1518242
gctctagaactagtggatcccccgggctgcaggaattcgtctcacccctagaaaaaatcactgccaaatcccccatgaaagtcaactcctccccaattccacgctgccgccaactcgccgtcctccgcgccaagcaccaaagctccgatggcccgcacgaagcagacggcgcgcaggtcaacgggaggaaaagagacccgcaagcagctggcgacaaaggcgtgcgcgcaagtctgcgccggccaccgggggtgtgaacaagccccacggcttccgccccggcaccgtcacgatcctggagattcgtacctaccaaaagagcacggagctgctcatccgcaagttgcccttccagcgcctcgtccgtgagatcacacaggacttcaagaccgatctccgcttccagacctcagccgttctctgcgctgcatgaggacaccgaggcctacctcgtggggctctttgacgactctaacctgtgacgcatccaagccaagcgcgtcagcatcatggccaatgacatccagctcttggcgccgatcagggtaaagagggcctgacccaagctggcctcctctcaccgcaggcgggggtcattgtggcttccggcctgcttgtaagacttgagcttc

SEQ ID NO: 60076 - DNA, 658 bp, Zea mays
  misc_feature: Ceres CLONE 1518249
  misc_feature: Encodes the peptide sequence at SEQ ID NO. 60077
aaagctggagctccccgcggtggcggccgctctagaactagtggatcccccgggctgcaggaattcgtctcacccctagaaaaactcctcggctgctgtctgtttgttgtgttagggtttcgtctcgtgtataaggagttcggagctcgcaaatcctttcctctctcgcgttcgaggctaggtagccgtcaccatgagccgctcggggcatcctccggatctcaccaagtacatggacaagaaggttcagattaagatgaatgcaaaccgtgttgttatcggcacacttcgtggattccaccagttcatgaatctggtggtggacaacattgcggaggtcaatggaaatgacaaaacagatattggaatggtggttatcaggggaaacagtgttgtaatgatcgaggcactggagccagttgcgacgtcacagtgaatcattgttctttagcactagcagcgcgaagactgatgtataagatatcagtgcaccctggtgtacttgactaatgcttttgcacagcaacatcacttcagaggtggaatgtctatccctttttctatgggatgctcgtagctatacaatcatcgagctcttaattacatgatctaacgcatgctcatcgagctcttaaaataaattgcacaaaaaaacgag

SEQ ID NO: 60077 - protein, 80 aa, Zea mays
  misc_feature: Ceres CLONE 1518249
  misc_feature (8)..(72): Pfam Name: LSM Pfam Description: LSM domain
MSRSGHPPDLTKYMDKKVQIKMNANRVVIGTLRGFHQFMNLVVDNIAEVNGNDKTDIGMVVIRGNSVVMIEALEPVATSQ

SEQ ID NO: 60078 - DNA, 687 bp, Zea mays
  misc_feature: Ceres CLONE 1518252
  misc_feature: Encodes the peptide sequence at SEQ ID NO. 60079
aagctggagctccccgcggtggcggccgctctagaactagtggatcccccgggctgcaggaattcgtctcacccctagaaaaaatccgacactcacacggacacagtcacccaaaagtcgtccagcgtacagactattctgttttgtttctctctcaagcaagtagcagacgacatcgtcatcccaacatggcttccatgacgacgacggcttacaacgacctggctcgcgagtggctcgtgcgagctctcttcggctctgcatgctacgtgccaggaaggggccgtggccgccacccatgggctcggcgaggacgacgaccctcggctgccgtgccaccggcacacaggccgtggcgaggcgacgacagaagcatcagatccacaaagcgttactactagccgcagcagacggcgacgacaggcttcaggaggacgtcgcgaggtgtctcggcgccatgtcctacatcacgctctacgtcgtcctagaccggttcgcgctacgctgaccagggctactgctcacccgccgctgccgccgcctgcgacacgatcgatcggggcgtgctgtactgtacagacgtataacatgcatgtctgcacgaccaggattcagccaataaatgctgtatatgaacagaaatgccatcaagggttgctttctaaagaaaaaacaaacaaactcgcc

SEQ ID NO: 60079 - protein, 69 aa, Zea mays
  misc_feature: Ceres CLONE 1518252
MGSARTTTLGCRATGTQAVARRRQKHQIHKALLLAAADGDDRLQEDVARCLGAMSYITLYVVLDRFALR

SEQ ID NO: 60080 - DNA, 822 bp, Zea mays
  misc_feature: Ceres CLONE 1518252-R
ggtactcgagcgtctcgtttttttttttttttttgggagcaacaaagaagtttttagcgtatgtatacagcttttgcttaatcaatggtaggactactaacaagcaagaatgaaccaagaaataaatctagctgatgctattctccatcatcgcggtggactgtacccacgataactgacgcggcagcttcatttgggcctaaaacctggagaagaacgcagtacgctcttgacgtgacatggcggcgtcctacctgctgacctctgccaccgacctgtcggtccaggtcgcgcgggatgcctccaaccaccatgttctccatgatgatcttgtcatcgcctcagcacctccgctcttcgtggtggtcctcctcatcatggtcgacgtcctcgtagaagcactgggtggcctccaccgtctcccactgggaggtggcagcactgaagaagtagaggtcgtcgacgtaaaggcccggcgtgtcctggacggccggcgcgatgcaggagatgatggcggagcacgctctcggactgggagctgaaccagaacgcccgcatctcgtcaatggagtactcgcactacccgcagcggacccggtcgccgcgcgcgcctcccatgtctgccaaggccgagaccattgccgcgacctttgcgaaccaagtacatggtcaggctgtgccacgcgccagcatttcgcgctatagtaccgttagccgcagcatattcacggctgtcgtcccaaacgacggactcttcattcccgcctcaaatgcgcttccgtgtcggaattagatgcaagctcttcattcggaacgatgcaa

SEQ ID NO: 60081 - DNA, 536 bp, Zea mays
  misc_feature: Ceres CLONE 1518254
  misc_feature: Encodes the peptide sequence at SEQ ID NO. 60082
aagctggagctccccgcggtggcggccgctctagaactagtggatcccccgggctgcaggaattcgtctcacccctagaaaaaagcagcacagtcatccacactaacgaacgaactgaggtcgacgacgactgatcgagcagcgacgatggcggctgtgctgaacagcaggaagacgccgcaggtggttgccgtgctggtggcggcggcgctgctggcgtcgtccgcttcggcggcgatcacctgcgggcaggtggggtcgtcgctggcttccgtgcatcccgttacgcgaccgggaaggggccagggcgcttccccgcggtcgtgggttgcaccgggcgttccaagaagccctccaaaagcgcgggggcggggggaacacaatccggggggaaaccccccagggggcgggggcgggcccccttttcccccttttagaaaaagggatttttcccccccaccaccccacttccttttatatagaaggaagggcctccctaaaccaccctcctgtgggtttggcgccgcccctctcct

SEQ ID NO: 60082 - protein, 129 aa, Zea mays
  misc_feature: Ceres CLONE 1518254
MAAVLNSRKTPQVVAVLVAAALLASSASAAITCGQVGSSLASVHPVTRPGRGQGASPRSWVAPGVPRSPPKARGRGEHNPGGNPPGGGGGPPFPPFRKRDFSPPPPHFLLYRRKGLPKPPSCGFGAAPL

SEQ ID NO: 60083 - DNA, 715 bp, Zea mays
  misc_feature: Ceres CLONE 1518256
  misc_feature: Encodes the peptide sequence at SEQ ID NO. 60084
aaagctggagctccccgcggtggcggccgctctagaactagtggatcccccgggctgcaggaattcgtctcacccctagaaaaagtgctttcttagaggtgggttggcttctcctccccctccggttcgggttcgggttcgtgaggttctccggggttcgggttcgtgggtgagcggatccagatggcggcgtcggatgttgagtaccgctgcttcgtcggcggcctcgcctgggccacggacgaccactccctccacaacgccttcagcacctacggcgaggtcctcgagtccaatatcatcctccatcgggagacgcagaggtcccgcggcttcggcttcgtcaccttctccacggaggaggcgatgcggaacgccatcgaaggcatgaacggcaaggacccccacagccgctgcatctccgtcaacgaggcccagtcccgctgcggctgtggaggcggcggttgtgggtactgtgggtggccgtggaggcggcagctacagaggtggtgggcgccctgaaggccgtggcccctacggcggtggcggcggctactgggggcggcgccgccttccttggtaggtgggcgcagcttcagtagggggcaaccgtcgccggccggttatcggcaacctccgaatgggaaactggaggaacttgacccggcggggcccccccgcccgcccaaaattaaccccgtttgccccttacggg

SEQ ID NO: 60084 - protein, 112 aa, Zea mays
  misc_feature: Ceres CLONE 1518256
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAASDVEYRCFVGGLAWATDDHSLHNAFSTYGEVLESNIILHRETQRSRGFGFVTFSTEEAMRNAIEGMNGKDPHSRCISVNEAQSRCGCGGGGCGYCGWPWRRQLQRWWAP

SEQ ID NO: 60085 - DNA, 748 bp, Zea mays
  misc_feature: Ceres CLONE 1518258
  misc_feature: Encodes the peptide sequence at SEQ ID NO. 60086
  misc_feature (713)..(713): n is a, c, t, g, unknown, or other
aaagctggagctccccgcggtggcggccgctctagaactagtggatcccccgggctgcaggaattcgtctcacccctagaaaaagcgcaaacatcgaatcgtctcactcgtgtctgccctgctcatactgcttgccctcgccgtatcgtccacccgcaacgcacaggaggattccatggccaacaacaccgggacgttggtgggcggcatccaggacgtgccggggagcgagaacgaccttcacctccaggagctcgcccgcttcgccgtcgatgagcataacaagaaggccgatgctcttctggggttcgagaatcttgtgaaggccaagacaccagtggttgctggctctatttattctctcactaggggaggggggggggggcccaacttcaaaattctctccccccccccaggtttggagaaaaatccatgataaaaccctcaggggggggtgggagaatctaacagtcgtggtcaaaaagaggtgttaggttttactaacaaatggtcatctcttactaccagtgtcggcgttccagactgttataggcctaatccccgagaagaagggggccgccgcggtcccttttagtttgccgcccccagaaacccgatcacttggcaattaagcaactgtggtgagcgcgatgagcgcggtcctcccgtgaagatattgcgggaggctacgagtctcttttatgttagtgatngggtgggggtggccgatcttctctctcccaccgcc

SEQ ID NO: 60086 - protein, 86 aa, Zea mays
  misc_feature: Ceres CLONE 1518258
  misc_feature (10)..(87): Pfam Name: Cystatin Pfam Description: Cystatin domain
MANNTGTLVGGIQDVPGSENDLHLQELARFAVDEHNKKADALLGFENLVKAKTPVVAGSIYSLTRGGGGGPNFKILSPPPGLEKNP

SEQ ID NO: 60087 - DNA, 688 bp, Zea mays
  misc_feature: Ceres CLONE 1518260
  misc_feature: Encodes the peptide sequence at SEQ ID NO. 60088
  misc_feature (688)..(688): n is a, c, t, g, unknown, or other
aagctggagctccccgcggtggcggccgctctagaactagtggatcccccgggctgcaggaattcgtctcacccctagaaaaaagccaagcaaataagacgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacgcctgcggctgcggtagcagctgcaagtgcgacccctgcaactgctgatcacatcgatcgacgaccatggatatgattattatctatctagcttgtggtggtggttgaacaataataagcgaggccgagctggctgccatacataggtattgtgtggtgtgtgagagagagagagaaacagagttcttcagtttgctatctctctctctgcatgtttggcgtcagtctttgtgctcatgtacgtgtgtctacctgcatgttggttgatccgattgcatctgctgtaaccatatattaattggtccacgatgatatgatttgatactatatatatactaaaaccggacn

SEQ ID NO: 60088 - protein, 76 aa, Zea mays; identical to SEQ ID NO: 42649
  misc_feature: Ceres CLONE 1518260
  misc_feature (1)..(76): Pfam Name: Metallothio_2 Pfam Description: Metallothionein

SEQ ID NO: 60089 - DNA, 723 bp, Zea mays
  misc_feature: Ceres CLONE 1518261
  misc_feature (480)..(480): n is a, c, t, g, unknown, or other
aagctggagctccccgcggtggcggccgctctagaactagtggatcccccgggctgcaggaattcgtctcacccctagaaaaatcgccattcgccacaaagccatttgaaccccccacgtctcctcgcctcgttccccatttgctgcggctccttgcccgcgccgccgctcgccgtttgcccctgcgtctccgcaccgcgcgctgttgtccatccttgtgcagcaaacatgacggctggctacattgttggctcactggtcggatcctttgccattgcatacctgtgtgacacatttatctctgactagaaagcatttggaggtagcacccccaagactgtttctgagaaggagtggtggcaagccacagacaccaagttccaggtctggcctcgcactgctgggccaccggttgtcatgaaccccatcagtcgtcagagcttcgtcgacaagtctactgagtaggtttgtgctggatcngctcgttcagcaacttgatgccgtcatgaagccagagttccttttctaaagtcttaatacaatcgtagtacaacgaaagtcatccagggatttttttgggatttttaccctggacctgtaagggaccgtggggatcttttgcccttgtcattcaaggggttccggctccttggggaaattcccccccccccccgttaaaagaaccggggttgtttttcaaaaaaaagcgcttttggccacccg

SEQ ID NO: 60090 - DNA, 652 bp, Zea mays
  misc_feature: Ceres CLONE 1518264
  misc_feature: Encodes the peptide sequence at SEQ ID NO. 60091
ggagctccccgcggtggcggccgctctagaactagtggatcccccgggctgcaggaattcgtctcacccctagaaaaagtttttctccacctccatcacccgcctccactcccccctcccaggtgctgcccaggtaagtcggcggcggcgatgacaacgcgcttcaagaagaaccgcaagaagcgcggccacgtgtccgccgggcacggccgcatcggcaagcacaggaagcacccgggaggtcgcggtaacgccggtggcatgcaccaccaccgtatcctcttcgacaagtaccatccgggctacttcggcaaggttggcatgcgttacttccataagctccgcaacaagttctactgccccgcggtcaacatcgagcgcctctggtcgatggtgcccaccgacaaggcggcggaggccggcggcgacaaggccccgcagatcgacgtcacgcagttcggctacttcaaggtgctcgggaagggggtgctgccgccaaagcccattgtcgtcaaggccaagctcatctccaaggtcgccgagaagaagatcaaggcagcaggcggcgccgtcgtgctcaccgcctaggtttcagtcctttgttcgcctcctggtttttgaattctatatcctgacctgatagtgcctttct

SEQ ID NO: 60091 - protein, 145 aa, Zea mays
  misc_feature: Ceres CLONE 1518264
  misc_feature (107)..(139): Pfam Name: L15 Pfam Description: Ribosomal protein L15
MTTRFKKNRKKRGHVSAGHGRIGKHRKHPGGRGNAGGMHHHRILFDKYHPGYFGKVGMRYFHKLRNKFYCPAVNIERLWSMVPTDKAAEAGGDKAPQIDVTQFGYFKVLGKGVLPPKPIVVKAKLISKVAEKKIKAAGGAVVLTA

SEQ ID NO: 60092 - DNA, 782 bp, Zea mays
  misc_feature: Ceres CLONE 1518266-R
  misc_feature (1)..(1): n is a, c, t, g, unknown, or other
ngtcctcgagcgtctcgtttttttttttttttttcgattttttttttttttttttttttttttttttttttttttttcgaaaaccccccatttttttcttccaagtttgggccaaatcccacgaggtggttctattcttttctccctgacaatgtttcggtcaaaaactttttgccctttctcctttttaggagtagggaaaaatcccctttgataatcttcggcttccaccttcctgaacatgccaagctttcttgcctcttggccccgaatgttcccggccattttattttcctgaagaggcccaacaacttccctgatgcaccctgttggcgcctccagcccagttacgaacttttctcttggcgaagctttcagaacgcgccttgtcccttgccaacccctaagaaaggccaggtgataagcccttctcttttagggttgaaaatctttgcaaacccttatcttgatccagggccccctgaaacctgatgccccccctccaaaggcttggcctttttcccccctttttggccgggtgaacatgggccgcccaaaaattctattctctccccccccttttgtggggaacaccacccttggggcccccctttttttttttttatccccccccccaaaaaaaagagggtttccccaaaattttctggggggtttctccccgggggcggggggtcccccacgttttttgaaagagaaacaaaaaaaaacacccctctttttttctccctgcggggggagaaaaaaaaaatttttttttttct

SEQ ID NO: 60093 - DNA, 613 bp, Zea mays
  misc_feature: Ceres CLONE 1518267
  misc_feature: Encodes the peptide sequence at SEQ ID NO. 60094
  misc_feature (432)..(432): n is a, c, t, g, unknown, or other
  misc_feature (443)..(443): n is a, c, t, g, unknown, or other
acccgcggtggcggccgctctagaactagtggatcccccgggctgcaggaattcgtctcacccctagaaaaaactgacccagagcgatcggagctgacgacgatggccgggaaggcggcggccgcgacggcggcgaggtgggcggaggggtacccgtggaaggagaagctggcaaagtacaagggtgagctcgggaagggggtgtggggatactgggagctcggcgcgtggaagccgctcggcatcagcgctcgcaagcgcgcccgcctccgcaaggaggtgctcctcgccggcgaggactggagctacgatcctccccgcggggagatgcgtaccaagcgcaagggccacaagtgcgaccgcatctccgccgagaagcgagcaaatactgttgagctgatgaagaagatgccccagatgctgctcgactancagaaacgtangtggggagaagaagaatgaaagtggaggaaaacggccagaaattgataccccccggcttcgcccgggggcttttcctttccaaataaaggcccaacttttttcccgggggtttccgggaaggttaatttttaaccccccttttcctggggggatcccgctcccccggggg

SEQ ID NO: 60094 - protein, 119 aa, Zea mays
  misc_feature: Ceres CLONE 1518267
  misc_feature (110)..(110): Xaa is any aa, unknown, or other
  misc_feature (114)..(114): Xaa is any aa, unknown, or other
MAGKAAAATAARWAEGYPWKEKLAKYKGELGKGVWGYWELGAWKPLGISARKRARLRKEVLLAGEDWSYDPPRGEMRTKRKGHKCDRISAEKRANTVELMKKMPQMLLDXQKRXWGEEE

SEQ ID NO: 60095 - DNA, 550 bp, Zea mays
  misc_feature: Ceres CLONE 1518270
  misc_feature (206)..(206): n is a, c, t, g, unknown, or other
  misc_feature (307)..(307): n is a, c, t, g, unknown, or other
  misc_feature (507)..(507): n is a, c, t, g, unknown, or other
ctggagctccccgcggtggcggccgctctagaactagtggatcccccgggctgcaggaattcgtctcacccctagaaaaaaggacgacccaagcaagctagctcgatctactactactactactagctggtacacatactagccatcctgccagccagccagcttgccatggcgcccaccgtgatgatggcctcgtcggcaaccgnccgtcgcccctgttccaggggtctcaagtccgccgcagcctcccgtcgcccgcgcagcaccagagcctcgcacgtcagcaacgcgaagatccgtgcatgcngtgtggccggctacggcacagagtcgagacctgtcctactgccgcgctgcaacgacaactgcttacagtggactactgctgccaaacgctgaaacttggctccagttcccaagtccggttctggacccgaaaaactcccctccccgggtacaccaaggccctaacgggaccctggggaaaaccccccatttttgggttgncccaaacccccccccgggggtaaaagaggtttccagggggccc

SEQ ID NO: 60096 - DNA, 681 bp, Zea mays
  misc_feature: Ceres CLONE 1518276
  misc_feature: Encodes the peptide sequence at SEQ ID NO. 60097
aaagctggagctccccgcggtggcggccgctctagaactagtggatcccccgggctgcaggaattcgtctcacccctagaaaaagctcttccacccccaccacccacccacctctccccggcctcgcacccatggccacgactttgatggttgcagccaccacctcctgctccccgggccgcgccgcgccgcgcctgaagccggtggcctcctcctcctccagcagcagcagcagcagctcggcgcggccgcggcggcccttggcgcagcagctcccgcggctgctggcgacggcggcggcggcggcggtggcagccgcgccgctcccggcgctggcggagcagatggagaaggccgcactgtttgacttcgagcggacgctcccggcgatcacaaccaaacccccccctgctcatggtgggggctggacaaacttctacttcacgccgctaggcaagttcttggattatcgggaacccccagatccccccgccgaccccgggaattttttggggccgcccccaaggagggtggaaacagcctggatttaccccgccgggcccgccaattttcgaaaggctggctcccccccccataaacacccgccccattcccccccccacggatttcgccacaggggacctccggctatgagaagcttaaagaccgccctagacacgg

SEQ ID NO: 60097 - protein, 183 aa, Zea mays
  misc_feature: Ceres CLONE 1518276
MATTLMVAATTSCSPGRAAPRLKPVASSSSSSSSSSSARPRRPLAQQLPRLLATAAAAAVAAAPLPALAEQMEKAALFDFERTLPAITTKPPPAHGGGWTNFYFTPLGKFLDYREPPDPPADPGNFLGPPPRRVETAWIYPAGPANFRKAGSPPHKHPPHSPPHGFRHRGPPAMRSLKTALDT

SEQ ID NO: 60098 - DNA, 636 bp, Zea mays
  misc_feature: Ceres CLONE 1518279
  misc_feature: Encodes the peptide sequence at SEQ ID NO. 60099
tggagctccccgcggtggcggccgctctagaactagtggatcccccgggctgcaggaattcgtctcacccctagaaaaagcctcctctcgccctcgctccgccgccgccgccgccgccgcatcaagcacccgccccgccgtcgcctgaggtagacaccaatccgccgccatggggcgtatgcacagccgcgggaagggtatctcatcgtcggcgctgccgtacaagaggacgcctcctacctggctcaagaccgctgcctccgacgtggaggagatgatcacaaaggcagcgaagaagggacagatgccgtcgcagatcggcgttctgcttcgtgaccagcaacgtatcccccttggcaggaagcgcaccggcagcaaaattctcccgcatctcaaggcccatgggctgggacccaaaaatcccaaggaacttttccttccctctaaaaaaggggggggggaaaaaggaaagcccctttgaaaggaaaacggaagggaaaaaaaccttttaaatttcgggccttatttttttggggaaaaaaagagaaaaaacaccgcttttttgcccccgttttataaaaaggggccccaaaaaaaaaaagttttccccccccccccctttgggaaaaattaata

SEQ ID NO: 60099 - protein, 103 aa, Zea mays
  misc_feature: Ceres CLONE 1518279
  misc_feature (1)..(60): Pfam Name: Ribosomal_S13_N Pfam Description: Ribosomal S13/S15 N-terminal domain
MGRMHSRGKGISSSALPYKRTPPTWLKTAASDVEEMITKAAKKGQMPSQIGVLLRDQQRIPLGRKRTGSKILPHLKAHGLGPKNPKELFLPSKKGGGEKGKPL

SEQ ID NO: 60100 - DNA, 675 bp, Zea mays
  misc_feature: Ceres CLONE 1518284
  misc_feature: Encodes the peptide sequence at SEQ ID NO. 60101
ccccgcggtggcggccgctctagaactagtggatcccccgggctgcaggaattcgtctcacccctagaaaaactactgcggcttcaggactcgacctcttgcgccgccgccatgaccttcaagcgccgcaacggcggccgcaacaagcatggccgcggtcacgtcaagtacatccgatgctcaaactgcgccaagtgctgccccaaggacaaggcgatcaagaggtttcaagtgaggaatatcgtggaacacgctgccatcaaggacgaccaggaagcatgcgtctatgatggctacgtcctcccgaagctgtacgccaaggtgcaccactgcgtctcgtgcgcgatccacgctcacatcgaccgcgtccgatcccgtgagaagcgcagggaccgcaagccgccggagcgcttcaagcacagggaggataggcctgctggtggacaaggaggcccccgccctggtcctggtgctgctgctacagctccagctccagcactgggtgctgctcgcccataggctttagcttttcgagcgtgttaagtcttctgcccactcagtttcagagttgtcgcctatgggtgtgtgaagctgctatattagagttactttatgtctaaagcctgaacattttcaaagaatttgagtatctgaacatttgaatatatgtgctga

SEQ ID NO: 60101 - protein, 135 aa, Zea mays
  misc_feature: Ceres CLONE 1518284
  misc_feature (1)..(117): Pfam Name: Ribosomal_S26e Pfam Description: Ribosomal protein S26e
MTFKRRNGGRNKHGRGHVKYIRCSNCAKCCPKDKAIKRFQVRNIVEHAAIKDDQEACVYDGYVLPKLYAKVHHCVSCAIHAHIDRVRSREKRRDRKPPERFKHREDRPAGGQGGPRPGPGAAATAPAPALGAARP

SEQ ID NO: 60102 - DNA, 660 bp, Zea mays
  misc_feature: Ceres CLONE 1518286
  misc_feature: Encodes the peptide sequence at SEQ ID NO. 60103
  misc_feature (404)..(404): n is a, c, t, g, unknown, or other
  misc_feature (443)..(443): n is a, c, t, g, unknown, or other
agctccccgcggtggcggccgctctagaactagtggatcccccgggctgcaggaattcgtctcacccctagaaaaagcgcaaacatcgaatcgtctcactcgtgtctgccctgctcatactgcttgccctcgccgtatcgtccacccgcaacgcacaggaggattccatggccaacaacaccgggacgttggtgggcggcatccaggacgtgccggggagcgagaacgaccttcacctccaggagctcgcccgcttcgccgtcgatgagcacaacaagaaggccaatgctcttctggggttcgagaagcttgtgaaggccaagacacaagtggttgctggcacgatgtactatctcactattgaagtgaaggatggcgaagtcaagaagctctacgaagctaangtatgggagaagccatgggagaaagtcaaggagctgcangaattcaaaccctgtgaagagggtgctagcgcctaaagatgtctccttctccatgtgcgagcctgaagctcaaagcaaagttgcagaataaggagccatgcctcccttgggaaatttcaaaagactacaaccctattaaggccttgtttggtttgggtctggtttcaagggaaattaaaggggaataaatttccccttcaattttaaaaaaaggggt

SEQ ID NO: 60103 - protein, 103 aa, Zea mays
  misc_feature: Ceres CLONE 1518286
  misc_feature (10)..(98): Pfam Name: Cystatin Pfam Description: Cystatin domain
  misc_feature (79)..(79): Xaa is any aa, unknown, or other
  misc_feature (92)..(92): Xaa is any aa, unknown, or other
MANNTGTLVGGIQDVPGSENDLHLQELARFAVDEHNKKANALLGFEKLVKAKTQVVAGTMYYLTIEVKDGEVKKLYEAXVWEKPWEKVKELXEFKPCEEGASA

SEQ ID NO: 60104 - DNA, 679 bp, Zea mays
  misc_feature: Ceres CLONE 1518288
  misc_feature: Encodes the peptide sequence at SEQ ID NO. 60105
  misc_feature (484)..(484): n is a, c, t, g, unknown, or other
  misc_feature (504)..(504): n is a, c, t, g, unknown, or other
  misc_feature (542)..(542): n is a, c, t, g, unknown, or other
aagctggagctccccgcggtggcggccgctctagaactagtggatcccccgggctgcaggaattcgtctcacccctagaaaaaacttttccggcctcccattcctcgcgcggcgaccacccgattcgaagcgtgcggagagaccgaagaagcgggagagatggctcgtaccaagcagactgctcgcaagtccacgggagggaaggctcccaggaagcagcttgccaccaaggctgcccgtaagtctgcccccaccactggtggagtgaagaagcctcaccgctaccgccctggaactgttgccctccgtgagatccgcaagtatcagaagagcactgagctgctgatcaggaagctgcccttccagaggctcgtcagggaaattgcacaggacttcaaaactgatttgcgtttccagagccatgcggtgcttgccctccaggaggctgctgaggcataccttgttggcctgtttgaggacaccnacctgtgcgccatccatgcntagcgtgtgaccatcatgccaaaggacattcagctggncagggagaatccgcgcgagagggcctaatcgccacctcaaacatcgtgacaaaacatgaagtcctgggggttatgtaaatctggtggccatggaaggacctatgagtaaggtttggttttggggatcgcacgtttcc

SEQ ID NO: 60105 - protein, 115 aa, Zea mays
  misc_feature: Ceres CLONE 1518288
  misc_feature (58)..(116): Pfam Name: Histone Pfam Description: Core histone H2A/H2B/H3/H4
  misc_feature (109)..(109): Xaa is any aa, unknown, or other
MARTKQTARKSTGGKAPRKQLATKAARKSAPTTGGVKKPHRYRPGTVALREIRKYQKSTELLIRKLPFQRLVREIAQDFKTDLRFQSHAVLALQEAAEAYLVGLFEDTXLCAIHA

SEQ ID NO: 60106 - DNA, 680 bp, Zea mays
  misc_feature: Ceres CLONE 1518293
  misc_feature (534)..(534): n is a, c, t, g, unknown, or other
  misc_feature (536)..(536): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (592)..(592): n is a, c, t, g, unknown, or other
aaagctggagctccccgcggtggcggccgctctagaactagtggatcccccgggctgcaggaattcgtctcacccctagaaaaactacggctggtggtgatcgatcgccgtgcccaccggcctatcggagtggtactactacggtctaccgtatgagctgatgcgctgcatgcccaccgccgcaccagtacctcctgttacttgttcttggagttaggatttttttaaaaaaaaatctttaggagatggatttggtggtatgtactgtagcatactagcatgagctgtggagcttcttctcttggtgagtgatctcgtgtcttgtgagggaaggagggagttcatgctgtgggtgtcctactcctctgtacagaacagaaatctggactcagtctggtctatgtaaatataggtgctgcgtatgtatatgtgtgtatagaataagatttctgtaaattattactactactacaggcaagactgctgttgatggcctctttgaaaaggccggcttcggattcactattgtaaaananannnnnnnnnnnnnnnnnnnnnnnnnnnnnnnnnnnnnnnnaaaaaaaaaaaaaanggaaaaaaaaaaaaaaaaccgagacgctcgaggtacccaattcgccctatagtgagtcgtattacgcgcgctcactggccgtcgtttt

SEQ ID NO: 60107 - DNA, 713 bp, Zea mays
  misc_feature: Ceres CLONE 1518306
  misc_feature: Encodes the peptide sequence at SEQ ID NO. 60108
  misc_feature (377)..(377): n is a, c, t, g, unknown, or other
  misc_feature (378)..(378): n is a, c, t, g, unknown, or other
  misc_feature (395)..(395): n is a, c, t, g, unknown, or other
ggagctccccgcggtggcggccgctctagaactagtggatcccccgggctgcaggaattcgtctcacccctagaaaaaagctgctggccccgacacgcatcgactcccgccgccgccgcttccgctccgtcgctcgcctcacgcctccggcgccacctccaccatggccccgaagaaggagaaggccccgccgccatcgtccaagccggccaagtccggaggcgggaagcagaagaagaagaagtggagcaagggtaagcagaaggagaaggtcaacaacgctgtgctcttcgatcaggccacctacgataagctgctctccgaggtgcccaagtacaagcagatcaccccatccatcctatctgagcgcctcaggnntaatggatccttggcancgagggccatccaggatctgatggcaaaggggctcataaggatggtctctgttcattctagccagccgatatacaccagggcaaccaacacatgaaggggggttttgcgtcctggcggacgttatcggtcaaaacaatttggagttgccattatatcaagtttaatttaaaccgggggccgatcaactcttacttttgggtttgaagggccaaaattttttgaaatattttggcctttttttaaaaaacggtttttttttaaatttttaaaaaccctgtgcgccccccaaaattttaatctttgggggggaaaataaa

SEQ ID NO: 60108 - protein, 108 aa, Zea mays
  misc_feature: Ceres CLONE 1518306
  misc_feature (1)..(106): Pfam Name: Ribosomal_S25 Pfam Description: S25 ribosomal protein
  misc_feature (72)..(72): Xaa is any aa, unknown, or other
  misc_feature (78)..(78): Xaa is any aa, unknown, or other
MAPKKEKAPPPSSKPAKSGGGKQKKKKWSKGKQKEKVNNAVLFDQATYDKLLSEVPKYKQITPSILSERLRXNGSLAXRAIQDLMAKGLIRMVSVHSSQPIYTRATNT

SEQ ID NO: 60109 - DNA, 612 bp, Zea mays
  misc_feature: Ceres CLONE 1518310
  misc_feature: Encodes the peptide sequence at SEQ ID NO. 60110
  misc_feature (457)..(457): n is a, c, t, g, unknown, or other
ctggagctccccgcggtggcggccgctctagaactagtggatcccccgggctgcaggaattcgtctcacccctagaaaaaattccacccgcttcccccagccgcacgaaaccctaacgctgccgccgcttcacaggtaagccgccgccatggtgtccggttccggcgtatgcgcgaagcgcatcgtggtggacgcgcgccaccacatgctgggccgcctgtcgtcgattatcgccaaggaactgctcaatgggcagaaggtggtcgtcgtccgctgcgaggagatctgtatgtcgggtgggctcgtacgccagaagatgaagtacctccgctttctccgcaagcggatgaacaccaagccatcccatggacccatccacttccgcgccccgtccaagatcctgtggcgcaccatccgcgggatgattccgcacaagaaccaagaaggggggaggctngctctgggcgaagggctcagaacgtactgagggctgtaccgctcgccgtacgaacaagaactaaagcgcctgggtcatcccctgaccgctcttaaaggttcttgaaggctgcaacccagaacccaagtactggcctccttggggaagcttttcta

SEQ ID NO: 60110 - protein, 112 aa, Zea mays
  misc_feature: Ceres CLONE 1518310
  misc_feature (11)..(107): Pfam Name: Ribosomal_L13 Pfam Description: Ribosomal protein L13
MVSGSGVCAKRIVVDARHHMLGRLSSIIAKELLNGQKVVVVRCEEICMSGGLVRQKMKYLRFLRKRMNTKPSHGPIHFRAPSKILWRTIRGMIPHKNQEGGRLALGEGLRTY

SEQ ID NO: 60111 - DNA, 625 bp, Zea mays
  misc_feature: Ceres CLONE 1518312
  misc_feature: Encodes the peptide sequence at SEQ ID NO. 60112
gcggtggcggccgctctataactagtggatcccccgggctgcaggaattcgtctcacccctagaaaaaacagcaacccccaacagcgccactgtccagtgcgcgcgtcaagcttgcttagctagccgccatggcctccctcgccgccgactccgtgaagcccgtggccatcaagggtctcgccggcagctccatctccggaaggaagctcgccgtcgccaggccgtcagcccgctccatccgcaggccccgcgcagccgccgtggtggccaagtacggcgacaagagcgactactttgacctcgacgacatcggctaaacccaccgggaaagggggtaaccttcttacggagtttttcgaaagaggtcactcccctctttttttgcgattagggtccacctgctagacaacaaagtagtttttaacccccccccccccccgttcccaacagaatagatttttcccccccctctacccccaaaaagaaagatggtgttccccccgtaacccctaataccctattacggttggcaacgaaatttattccccctcctaataccccaactgaggtttgtgtttattgttaggggggttacattaaaccatatctacacgcggcgcgccg

SEQ ID NO: 60112 - protein, 62 aa, Zea mays
  misc_feature: Ceres CLONE 1518312
MASLAADSVKPVAIKGLAGSSISGRKLAVARPSARSIRRPRAAAVVAKYGDKSDYFDLDDIG

SEQ ID NO: 60113 - DNA, 736 bp, Zea mays
  misc_feature: Ceres CLONE 1518507
  misc_feature: Encodes the peptide sequence at SEQ ID NO. 60114
ggctccccgcggtggcggccgctctagaactagtggatcccccgggctgcaggaattcgtctcacccctagaaaaaattcctcggagagggagaagccgccgccgcagcaatcacagcagcccggagaaagcccaggtccgacaagatgcagatcttcgtgaagacgctgacagggaagaccatcaccctcgaggtcgagagcagcgacaccatcgacaatgtcaaggccaagatccaggacaaggaagggatcccgccggaccagcagcggctgatctttgccgaggagcagctggaggatggccgcacccttgcggactataacatccaaaaggagtctacgcttcacctcgtgcttaagctccgcggtggcatcattgaggcctcgctggaagcgctcgctcgcaagtagacccaggaaaagatgatctcgcccaaatgctatgccccgattgccccctagggctgtcaccttgcgcaagaaagagtgtggtcccagcccaccgctgaagggccagaaaaaaaataagaacggagggggtggtcctaaaccgggtttctgggaaaaaggggggggcttgtattatgggtgggagggggggtttaacccgggttttttttttccccacatttttgggggcccctcgaagtttggtttccacacgtgggggccccggaggcccaatttttttttgcgcaaaataaacaccctgtttttttttattatataataaa

SEQ ID NO: 60114 - protein, 88 aa, Zea mays
  misc_feature: Ceres CLONE 1518507
  misc_feature (6)..(74): Pfam Name: ubiquitin Pfam Description: Ubiquitin family
MQIFVKTLTGKTITLEVESSDTIDNVKAKIQDKEGIPPDQQRLIFAEEQLEDGRTLADYNIQKESTLHLVLKLRGGIIEASLEALARK

SEQ ID NO: 60115 - DNA, 682 bp, Zea mays
  misc_feature: Ceres CLONE 1518525
  misc_feature: Encodes the peptide sequence at SEQ ID NO. 60116
agagctggagctccccgcggtggcggccgctctagaactagtggatcccccgggctgcaggaattcgtctcacccctagaaaaaactcgtctcatctcttccatacgaccataccctacctccaaattcccaattgtcaacctctcctcagagttcgagtgaccatgtcggggcgcggaaagggcgggaaggggctgggcaagggcggcgcgaagcgtcaccgcaaggtcctccgcgacaacatccagggcattacgaagccggcgatccggaggctggcgagaaggggcggcgtgaagcgcatctcggggctcatctacgaggagacccgcggcgtgctcaagatcttcctcgagaatgtcattcgcgacgctgtcacctacacggagcacgcccgccgtaagaccgtcaccgccatggacgtcgtctacgcgctcaagcggcagggccgcaccctctacggatttggcggctgaggggtcaggggtgtccgccagctgctgctggtcgtggcagaagtcttgggtcgcggtcacgaaatggagtgattcgagagtattcttgcccatggccttagtttcgtaggcttatcactctagactctagtgcctttggtccagtagtagcatacgacttgtactgcatttctttgttctgaaacctctaatatgatgaaatgggg

SEQ ID NO: 60116 - protein, 103 aa, Zea mays; identical to SEQ ID NO: 6459
  misc_feature: Ceres CLONE 1518525
  misc_feature (25)..(94): Pfam Name: Histone Pfam Description: Core histone H2A/H2B/H3/H4

SEQ ID NO: 60117 - DNA, 770 bp, Zea mays
  misc_feature: Ceres CLONE 1518528
  misc_feature (204)..(204): n is a, c, t, g, unknown, or other
  misc_feature (297)..(297): n is a, c, t, g, unknown, or other
  misc_feature (300)..(300): n is a, c, t, g, unknown, or other
  misc_feature (301)..(301): n is a, c, t, g, unknown, or other
  misc_feature (302)..(302): n is a, c, t, g, unknown, or other
  misc_feature (303)..(303): n is a, c, t, g, unknown, or other
  misc_feature (305)..(305): n is a, c, t, g, unknown, or other
  misc_feature (306)..(306): n is a, c, t, g, unknown, or other
  misc_feature (349)..(349): n is a, c, t, g, unknown, or other
  misc_feature (350)..(350): n is a, c, t, g, unknown, or other
  misc_feature (352)..(352): n is a, c, t, g, unknown, or other
  misc_feature (354)..(354): n is a, c, t, g, unknown, or other
  misc_feature (355)..(355): n is a, c, t, g, unknown, or other
  misc_feature (357)..(357): n is a, c, t, g, unknown, or other
  misc_feature (358)..(358): n is a, c, t, g, unknown, or other
  misc_feature (359)..(359): n is a, c, t, g, unknown, or other
  misc_feature (360)..(360): n is a, c, t, g, unknown, or other
  misc_feature (361)..(361): n is a, c, t, g, unknown, or other
  misc_feature (362)..(362): n is a, c, t, g, unknown, or other
  misc_feature (363)..(363): n is a, c, t, g, unknown, or other
  misc_feature (364)..(364): n is a, c, t, g, unknown, or other
  misc_feature (365)..(365): n is a, c, t, g, unknown, or other
  misc_feature (366)..(366): n is a, c, t, g, unknown, or other
  misc_feature (367)..(367): n is a, c, t, g, unknown, or other
  misc_feature (368)..(368): n is a, c, t, g, unknown, or other
  misc_feature (406)..(406): n is a, c, t, g, unknown, or other
  misc_feature (607)..(607): n is a, c, t, g, unknown, or other
  misc_feature (611)..(611): n is a, c, t, g, unknown, or other
  misc_feature (614)..(614): n is a, c, t, g, unknown, or other
  misc_feature (618)..(618): n is a, c, t, g, unknown, or other
tcccccgggctgcaggaattcgtctcacccctaggaaaaagcaagaacagctgtcgatccaattgtcacttgctctccctccaacaagctaattaaggccggtcgtcatccctcttctagctcgttttattatccatggcggaggagaagcaccaccaccaccacctgttccaccataagaaggacgaggagcaggaggaacanctcgccggcggcgggtactgcgagtcccccctattacccggaggggaggggagaagggagtgttgtccactttttaaaacaaaaaccacaaanacnnnnannaaattttttttcccccccccccccggggataagaaaagggggnntntnntnnnnnnnnnnnncccttggtggggtggtataaaaaaaaaaaaaaaaaaangggccggggcggcggtctcactgtttgttttttcgatgtattccgcgtgccctccaacatgccgtttgggtgcgtttttgcccgtatgtcgacgcacgggcagcaaagcaccgcggacggagcctgcggcatgtgtccaggtcgcaatctagagtgtgctttataagtgcggtcgtatagatagtagcgtgccgctcgcanaacnccnaaanccaccccacaccacaaatttggtagtgtatgaggagggtaacttccaggagtatgcatgcaggggagcacgccaccccgcgtgtgccgcctacggttggcggtcgatgcgatatatatggttaatctgggtccttgacagcgtagcttcgtg

SEQ ID NO: 60118 - DNA, 792 bp, Zea mays
  misc_feature: Ceres CLONE 1518538
  misc_feature (29)..(29): n is a, c, t, g, unknown, or other
  misc_feature (147)..(147): n is a, c, t, g, unknown, or other
  misc_feature (350)..(350): n is a, c, t, g, unknown, or other
  misc_feature (351)..(351): n is a, c, t, g, unknown, or other
  misc_feature (419)..(419): n is a, c, t, g, unknown, or other
ctctaaactagtgatcccccgggctgcangattcctctcacccctagaaaaagctgtctttcttctgctcttccatcgcgccagtgttttgagaagctggtcggcgctcctaaatcccttcgcctctctcgcgttcgaggctaggtnaccgccaccatgaaccgctcggggcagcctccggatctcaaaaagtacatgggacaacaagcttccaaattaagctgaaatgcaacccgtggttgttattgggcacacttttttggacatccaaagaggggacattgaaaactgggggaaaccaaccattttctgttggaaaagtacaacaggaaaaaaccaacccccaactnnatatttttttttttccccccccccccccccttcctccgggggggaaagaaaggggagggggcttcatntatttaaaaaaaacaaaaaaaaaacccccccttgggcggacgcggggcgaaaaggaaaaaaaccaaagcttttttctcaggggagagcgaaaagtacgccgagcacccccaaaccaaccagagcgcgctaggacgtggggctatagaagtgaagaacaacccatgtggcggaatggccgctcgcaacacctccccccagtgcatagatacagacgggaagcgagaatcaactttacctcgcagattccttgtaatgaaatatagagaccaggtaacgacaccggcggataccaaagtgaatggcaccaatcaagcaccttaaggagagcttgacacattacgcatatggcgggacggcgaacaagcactcatc

SEQ ID NO: 60119 - DNA, 743 bp, Zea mays
  misc_feature: Ceres CLONE 1518542
  misc_feature: Encodes the peptide sequence at SEQ ID NO. 60120
  misc_feature (53)..(53): n is a, c, t, g, unknown, or other
  misc_feature (54)..(54): n is a, c, t, g, unknown, or other
  misc_feature (75)..(75): n is a, c, t, g, unknown, or other
  misc_feature (347)..(347): n is a, c, t, g, unknown, or other
  misc_feature (348)..(348): n is a, c, t, g, unknown, or other
  misc_feature (404)..(404): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (449)..(449): n is a, c, t, g, unknown, or other
  misc_feature (460)..(460): n is a, c, t, g, unknown, or other
  misc_feature (461)..(461): n is a, c, t, g, unknown, or other
  misc_feature (465)..(465): n is a, c, t, g, unknown, or other
  misc_feature (466)..(466): n is a, c, t, g, unknown, or other
  misc_feature (467)..(467): n is a, c, t, g, unknown, or other
  misc_feature (468)..(468): n is a, c, t, g, unknown, or other
  misc_feature (476)..(476): n is a, c, t, g, unknown, or other
  misc_feature (483)..(483): n is a, c, t, g, unknown, or other
  misc_feature (491)..(491): n is a, c, t, g, unknown, or other
  misc_feature (499)..(499): n is a, c, t, g, unknown, or other
  misc_feature (507)..(507): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (546)..(546): n is a, c, t, g, unknown, or other
  misc_feature (563)..(563): n is a, c, t, g, unknown, or other
  misc_feature (568)..(568): n is a, c, t, g, unknown, or other
  misc_feature (569)..(569): n is a, c, t, g, unknown, or other
  misc_feature (602)..(602): n is a, c, t, g, unknown, or other
  misc_feature (619)..(619): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (651)..(651): n is a, c, t, g, unknown, or other
  misc_feature (654)..(654): n is a, c, t, g, unknown, or other
  misc_feature (665)..(665): n is a, c, t, g, unknown, or other
caggctgaagctcaccgcggtggcggccgctctagactagtggatttcttggnnctgcaggattcgtctcatctntagggaggtccgtattcccgtcacgcccccaacacgcccacaacccgaagcagcgaaagctcccctaaccctctccgcgcatccgatcgcaaggaagaagagggagatgagctactacgggcagcagccccccgtcggcgtcccgccgcagcaaggctacccgggcaaggacggctacccgccagcggggtacccgccggccggttcccccccgggggggcagggctaccctccgcagggctacgctctgcagtgggcggcaggcgcccggnnttattgtttgtggcgcgcgggggggcggggggggggtggaagttatttttggtttnttcggcccccccannnncnnnnntagaaggnnnngggtcccaggnggaggaggggnngagnnnnaggggtcngacgcgngccgaagncatagagncgcggcgntcgttnnngaggagaggccgcgaggtacgctggaggtgnggaaggaactgcggggngcttnnggtggcgggccccggggtggtgcggggactaanatcggctgtcgcttctntcctcaggaggnnnnggttacgcacggggcgntgntgctctggaanagcgggggccggcgggtgcgggtcgcgcgcgctcgggcccgtcgaacgaggtaagggaaagcgcctccgcccgcgggc

SEQ ID NO: 60120 - protein, 78 aa, Zea mays
  misc_feature: Ceres CLONE 1518542
  misc_feature (56)..(56): Xaa is any aa, unknown, or other
  misc_feature (75)..(75): Xaa is any aa, unknown, or other
MSYYGQQPPVGVPPQQGYPGKDGYPPAGYPPAGSPPGGQGYPPQGYALQWAAGARXYCLWRAGGRGGGGSYFWFXRPP

SEQ ID NO: 60121 - DNA, 655 bp, Zea mays
  misc_feature: Ceres CLONE 1518546
  misc_feature: Encodes the peptide sequence at SEQ ID NO. 60122
  misc_feature (383)..(383): n is a, c, t, g, unknown, or other
  misc_feature (474)..(474): n is a, c, t, g, unknown, or other
  misc_feature (630)..(630): n is a, c, t, g, unknown, or other
  misc_feature (631)..(631): n is a, c, t, g, unknown, or other
  misc_feature (633)..(633): n is a, c, t, g, unknown, or other
  misc_feature (634)..(634): n is a, c, t, g, unknown, or other
ccgctctagaactagtggatcccccgggctgcaggaattcgtctcacccctagaaaaaggcaacaccaacgcaaccacgttacgcaatatatagagaacatacccgtgagaagctaagacccggccgttgctcaccacagcatcatcgccgcgccgtgctagctcaaggatggagaacaacaggcagcagcagcagcaggcgccgccgccgccaggctacccgacggcggctgcaggcttggagcaggagcagggaggcaggaagggacgacgccgggagaagacgacctcgcgcggggataaaggcttcatcgaaggatgcatcgcggcgctctgctgctgctggatctgcgagatgtgctgcgactatgcacgcagctagncgagctagctctccgtctccggcggccatacttacgaaatacgatgagagagcctgccacagctttctgcttctgcaaaaaagaactggcntaaattatccaatccggccaaagatgggggaaaaacccggaaatttgttttgttttgggggggggttttttttttgggtaagggggggaagccccccccccccccctttttattttgggaaaaaaaaaaaatatttagggggggggggggcggcgnncnnaaaaaaaaaaaattttttgtt

SEQ ID NO: 60122 - protein, 70 aa, Zea mays
  misc_feature: Ceres CLONE 1518546
MENNRQQQQQAPPPPGYPTAAAGLEQEQGGRKGRRREKTTSRGDKGFIEGCIAALCCCWICEMCCDYARS

SEQ ID NO: 60123 - DNA, 698 bp, Zea mays
  misc_feature: Ceres CLONE 1518586
  misc_feature: Encodes the peptide sequence at SEQ ID NO. 60124
  misc_feature (569)..(569): n is a, c, t, g, unknown, or other
tccccgcggtggcggccgctctagaactagtggatcccccgggctgcaggaattcgtctcacccctagaaaaacgccggccatcaggttcgccgactccaacctccagaccttcccgccgtccgaggccaggggcaagatctccggcgcctaccgcccgcccaccgacgccgatgacaccttctcgtccaagggcggaggagccggaagcggtggcagaggcggcagcgccgggttggatgatgccgcgcagggcggctggttccgcatgttctccgtggcagcgtacaagccctacttcgacgttgacacctctgacgttgtcgagagaatctgggagtccgtcttccccttccgcggcacatttaccgagaagacctccgagaaccctgacctgtatggggcattttggacatgcaccaccctgattttcgttgctgcatctattgccccttttgtcacctacctatctcacaaatggcacaagaagggatgaactatgatatcaacttggttacctggtctgctggctttatctatggctacgtaacctttggtccccctccttcnaaagggtatccccaggacttctcagctcctgctgggctagtggcattgtggtggccatagggatacctcctgttcatcttcattccgcatcgtttttgtttattgggccatagaaaatttcgaaggggg

SEQ ID NO: 60124 - protein, 75 aa, Zea mays
  misc_feature: Ceres CLONE 1518586
MFSVAAYKPYFDVDTSDVVERIWESVFPFRGTFTEKTSENPDLYGAFWTCTTLIFVAASIAPFVTYLSHKWHKKG

SEQ ID NO: 60125 - DNA, 724 bp, Zea mays
  misc_feature: Ceres CLONE 1518594
cgcggtggcggccgctctagactagtggatcccccgggctgcaggaattcgtctcacccctagaaaaaagctcaagcttctcggccagtttcagcctcccattctgtctactctgtacacctcacgaccaagatgaacacagcagtgttcttcttgtagatgatgttctcctgcctctcgctctctgatctcatgtgagcgcctgagagaattgtcttagtataagacctactcctctgataccaggtatggtggctccccagctcctccggacgtattaggagacggccacgagccaacgccaacaccatctcatcgtggcacagcaccgacaccttcttacggcacaacaacaagtacacctgctcatggagtccctgatattctcaagcatggattagttgtatcctgccactactgtaacagccacccatacatgatcattgcagttgttgcgtcccttggcaacattggcaagacctttggtgctgcctagcgtccgctcgtcggcaacatacttgatcatctgcatgaagcactctcaaacaccagaactgatggccttggtgccctgctacgagaggactcatctgctatcctgactccattgtcactcagcatgtcccctttaccacccacctgtgaaagactgcatagctgcgtgcatgacctctgacgatgctgctatctgcccaggtagggatcttcaggacgcctcatgata

SEQ ID NO: 60126 - DNA, 705 bp, Zea mays
  misc_feature: Ceres CLONE 1518601
  misc_feature: Encodes the peptide sequence at SEQ ID NO. 60127
aaagctggagctccccgcggtggcggccgctctagaactagtggatcccccgggctgcaggaattcgtctcacccctagaaaaagcgatccaaacgcgcgacgcgacttattcagcaccaccgccgcctttcattttttccttcgcatcttgagagagagagagagagagagcggaggaggagagcaaggagatgggcggcttcgaccagcaggtgaaggagcggaccaaggagctgaagcacctcaagaccgcggcgatgaagggcatcaaggcggccggcgagtcgtgcaagaaggcgtggagcaaggtcaggagcagcatcaagcgctcaaggggcctaggcgctgttgctctgctgctgcgtggttctcggagctatggactgcggtagatgtgcgcttgcggcaactgcttgttggatctacttatctctttaggatatacatcatgtgtgaagatctgcatgcgtgtgttcctagtgttttttgcatctgatcgttcgctgtgtgatcctcttcgagcttgtgtagccacagaaggaaatcttccgtcgcaaacaaactctcttggatttctttggggaacctcgggaattcatggaaaaaacattttgcctaaaggtagggagcccctaatggccgggggccgtcggggggacccaatttcccccccaaaaggtgaggactaaatacccccgcgctcc

SEQ ID NO: 60127 - protein, 66 aa, Zea mays
  misc_feature: Ceres CLONE 1518601
MGGFDQQVKERTKELKHLKTAAMKGIKAAGESCKKAWSKVRSSIKRSRGLGAVALLLRGSRSYGLR

SEQ ID NO: 60128 - DNA, 757 bp, Zea mays
  misc_feature: Ceres CLONE 1518605
  misc_feature: Encodes the peptide sequence at SEQ ID NO. 60129
  misc_feature (530)..(530): n is a, c, t, g, unknown, or other
  misc_feature (540)..(540): n is a, c, t, g, unknown, or other
  misc_feature (541)..(541): n is a, c, t, g, unknown, or other
  misc_feature (549)..(549): n is a, c, t, g, unknown, or other
ccccgcggtggcggccgctctagaactagtggatcccccgggctgcaggaattcgtctcacccctagaaaaaaacaccaccgacgcgtagcacagtccattattgccgtctcccttttgcgtgagcaaagaaagagagcgagaacagcagtcgccatgtctggcatcatccacaacatacacgagaagctccacatggggggcgaccacaagaataaggaggaggagcaccacaataaagccgaggagcaccacaagaaggaggaggcggagcaccacaagaacgacggcggggagcacaaggaaggcatcgtggagaagatcaaggacaagatcaccggcgagcacggcgacaactcccgcgaccacgggggaaaagaaggacaagaaaaagatgaaccccgcccaggggcattgaccacgaaccgcggccacagtaaccacaaacaaccaacaccgactgaaattttggtgtccccagcacaaggtggggggcccccccccgcctccccccccggcaagaaggaaaanaaaaaaaaanntaaagtantggtttccccggggggcctgcctggtaacggggtattttttaatcaaaaaaaaaaaaaaaaaaaaacagtcaacggaggggtttggttggcctcggggatcctttgaccctccccaatttaaaattacgcctgctctcacagggggcgtgcaaacttgggacaaaaaaaaggggtgaaacccgcgcgggttgcggcttctaaaaatag

SEQ ID NO: 60129 - protein, 166 aa, Zea mays
  misc_feature: Ceres CLONE 1518605
  misc_feature (2)..(144): Pfam Name: Dehydrin Pfam Description: Dehydrin
  misc_feature (125)..(125): Xaa is any aa, unknown, or other
  misc_feature (129)..(129): Xaa is any aa, unknown, or other
  misc_feature (132)..(132): Xaa is any aa, unknown, or other
MSGIIHNIHEKLHMGGDHKNKEEEHHNKAEEHHKKEEAEHHKNDGGEHKEGIVEKIKDKITGEHGDNSRDHGGKEGQEKDEPRPGALTTNRGHSNHKQPTPTEILVSPAQGGGPPPASPPGKKEXKKKXKVXVSPGGLPGNGVFFNQKKKKKKTVNGGVWLASGIL

SEQ ID NO: 60130 - DNA, 695 bp, Zea mays
  misc_feature: Ceres CLONE 1518613
  misc_feature: Encodes the peptide sequence at SEQ ID NO. 60131
  misc_feature (406)..(406): n is a, c, t, g, unknown, or other
  misc_feature (458)..(458): n is a, c, t, g, unknown, or other
  misc_feature (475)..(475): n is a, c, t, g, unknown, or other
  misc_feature (518)..(518): n is a, c, t, g, unknown, or other
  misc_feature (547)..(547): n is a, c, t, g, unknown, or other
  misc_feature (563)..(563): n is a, c, t, g, unknown, or other
ggcggccgctctagaactagtggatcccccgggctgcaggaattcgtctcacccctagaaaaactctcgctccgttgctcgcctcgggtcaaaccctaagcagggagttgatttatccgctgcagccatgagtaagttgcagtctgagtctgtcaaggatgccatctcccagattgttggggatgccaaggagaagaataggaagttcactgagactgtggaacttcagattggtctgaagaattatgatccacagaaggacaagcgtttcagtggctctgttaagttgccccatatccctcgtcccaagatgaaggtgtgcatgcttggtgatgcccagcatgttgaggaggccgagaagatgggacttgactacatggatgttgaggctctcaagaaaatgaancagaacaagaagcttgttaagaggcttgcccagaagtaccatgctttctggncatcagaggccatcatncagcagattccccgtctccttgggtccctggtctcacaggcanggcagttcccgaccctgggtactcaccangaatccctcgagtccnaggtgaacgagactaagggcacccgtcagtccagctcaagaaggtcttttgcatgggtgttgccgttggcacttggcgatgggagagaagcgatccagcagacatccagatgagcgtcaacttccttgttcc

SEQ ID NO: 60131 - protein, 182 aa, Zea mays
  misc_feature: Ceres CLONE 1518613
  misc_feature (9)..(173): Pfam Name: Ribosomal_L1 Pfam Description: Ribosomal protein L1p/L10e family
  misc_feature (93)..(93): Xaa is any aa, unknown, or other
  misc_feature (111)..(111): Xaa is any aa, unknown, or other
  misc_feature (116)..(116): Xaa is any aa, unknown, or other
  misc_feature (131)..(131): Xaa is any aa, unknown, or other
  misc_feature (140)..(140): Xaa is any aa, unknown, or other
  misc_feature (146)..(146): Xaa is any aa, unknown, or other
MSKLQSESVKDAISQIVGDAKEKNRKFTETVELQIGLKNYDPQKDKRFSGSVKLPHIPRPKMKVCMLGDAQHVEEAEKMGLDYMDVEALKKMXQNKKLVKRLAQKYHAFWXSEAIXQQIPRLLGSLVSQAXQFPTLGTHXESLESXVNETKGTRQSSSRRSFAWVLPLALGDGREAIQQTSR

SEQ ID NO: 60132 - DNA, 681 bp, Zea mays
  misc_feature: Ceres CLONE 1518621
  misc_feature: Encodes the peptide sequence at SEQ ID NO. 60133
agaagctggagctccccgcggtggcggccgctctagaactagtggatcccccgggctgcaggaattcgtctcacccctagaaaaaacatgcactagctcctcctctcttgcccaccagcgactcccgtagctggaactcgctcgtcaaaaggaaaaggaaacacttcgcttcagctcgttgacagacgacgactcagagcaaaatgggtatactggtgattacggtggacctagactgctgtcgctgcagagccaagatcaccaaggtcctggactgtctcaaagaggagttctgcatcgagaaagtggagttcgatgacaagaaggagaagaaggtggtggtggtgcgtgggaagttcgacgccgagaagctctgcaagaaagtgtggtccaaggccgggaagatccccaaggggattgtcatcgctgaggtgtggccaataccagccccgcccaaggagtgcaagcctgaggcaccgaaatgttgcgactgtgagaagtgcaagccccaaccccaaccctgagcccccgaaatgtttcgactgtaaaaaatgcaagccccaagcccaagcctgagccacccaaatgttgcccactgtgaaaaagtgcaagcccaagcctgaacccccccaaacaaaaaaaaatgctccactggcctggttgttctctgcaaggcccaag

SEQ ID NO: 60133 - protein, 106 aa, Zea mays
  misc_feature: Ceres CLONE 1518621
MGILVITVDLDCCRCRAKITKVLDCLKEEFCIEKVEFDDKKEKKVVVVRGKFDAEKLCKKVWSKAGKIPKGIVIAEVWPIPAPPKECKPEAPKCCDCEKCKPQPQP

SEQ ID NO: 60134 - DNA, 661 bp, Zea mays
  misc_feature: Ceres CLONE 1518627
  misc_feature: Encodes the peptide sequence at SEQ ID NO. 60135
aaagctggagctccccgcggtggcggccgctctagaactagtggatcccccgggctgcaggaattcgtctcacccctagaaaaaatctcacggctagctagcacaagcatagtgcaggggcttgccacctaagtaaggcccgcctgagagccatggcatccaaggccgtcctcttcttggctctcaacctcctgttcttcacggtggccaacgcctgcggcaactgcccgaccccaacgcccccggtcgagccaccgccgccgcctcctgctgctaccccacccccttcgtccagcggcaagtgcccgctgaacgcgctcaagttcggcgtgtgcgccgatgtgctcggcctcgtcaaaggcgaggttggcaaggtgcctgccgagccatgctgtaccctcatcaaaggccttgcggacttcgaggccgccgtctgcctctgcacggccatcaaggccaacgtgctcggcgtcgtcgtcgatgtccccatcaagctcagcgcgctcgtcaactactgtggcaagtgcgtgcccaagggctacatgtgcgcgtaaacagcttcgggcggtaccaccctcgcaccttttccactccaaaatttaattgcccccccccccgcaagggcccaaaacatccatttggtcccccgaaaatttcttcc

SEQ ID NO: 60135 - protein, 133 aa, Zea mays; identical to SEQ ID NO: 52393
  misc_feature: Ceres CLONE 1518627
  misc_feature (51)..(132): Pfam Name: Tryp_alpha_amyl Pfam Description: Protease inhibitor/seed storage/LTP family

SEQ ID NO: 60136 - DNA, 687 bp, Zea mays
  misc_feature: Ceres CLONE 1518628
  misc_feature: Encodes the peptide sequence at SEQ ID NO. 60137
  misc_feature (57)..(57): n is a, c, t, g, unknown, or other
  misc_feature (393)..(393): n is a, c, t, g, unknown, or other
ccaagctggagctcacctgcggtggcggccgctctagaactagtggatcccccgggnctgcaggaattcgtctcacccctagaaaaaaaaaagctccccaacgaagtgcgagcgacccacgtccacacgacacgaaccaccaccaccaaccagcagccgcaccacgcacccagcgcaaagcgatggcgtcgctcaccatgatggcgtccttcgccgccgtggcggtggccgcgccctcgcgccgcggcaccttcgccgtggtcaggtccgccaaggtcgaccgctgccaggagcccgccacgctagcagcaaccgaggccaggcccgccgccgacggacgccgcgccgtcatgctcgcggctgctgcggcggccgtggcagccatcggcggcnccggccccgccatggcgggccccaagaacgggacccccgaggcgaagaagaagtacgcggccatctgcgtcaccatgcccaccgccaaggtctgccacaactgagcacgcccgcgttgcaactgccgggccggggggtggtatataattaatgtacgtgccccggtggttgttgtcccctatgtttgttccaggcttagatgcatgcctgacctgaggccgcttaattgctttctaacggccttcgagctgtaaaaatatcaagtgccctggcaaaatgaatacgggttgaaaa

SEQ ID NO: 60137 - protein, 104 aa, Zea mays
  misc_feature: Ceres CLONE 1518628
  misc_feature (71)..(71): Xaa is any aa, unknown, or other
MASLTMMASFAAVAVAAPSRRGTFAVVRSAKVDRCQEPATLAATEARPAADGRRAVMLAAAAAAVAAIGGXGPAMAGPKNGTPEAKKKYAAICVTMPTAKVCHN

SEQ ID NO: 60138 - DNA, 708 bp, Zea mays
  misc_feature: Ceres CLONE 1518631
  misc_feature: Encodes the peptide sequence at SEQ ID NO. 60139
  misc_feature (83)..(83): n is a, c, t, g, unknown, or other
aaagctggagctccccgcggtggcggccgctctagactagtggatcccccgggctgcagggattcgtctcacccctagagagngtcacaagcctccacagaactctccccgactttgccgtccactcccccgccgcagccgcgccgttcgccgggacaggagggatagtagagcaccaggatgccggcgacgccgacgatcatcggtgccctcctggggctgggcacccagatgtactcaaacgctctccgcaagctcccctacatgcgccatccatgggagcatttgttggggatgggtctcggtgcagtgtttgtgaaccagctggtaaagtttgatgagaagctcaaggaggacctcgacaagatgcttgagcgcgcccggctagccaactaacacccctacccccacaatgatgaatagatgcccagatttatttgccggcgacctggatttttttttgcaacatgttgccccgtacacatgggccaggactggaagaatccccaccgtcctagttcccctcccctttccccatttccaccggtgatcctggaagaagaaggtctcgaacctcctggatttcccaatgagggtccccccccgtggggctcttccacctgatgggtgaggctttcctcctacaaagaagttcctctataagagcgcgcataacataccccctcgcggaaattcagagtcgccccc

SEQ ID NO: 60139 - protein, 71 aa, Zea mays
  misc_feature: Ceres CLONE 1518631
MPATPTIIGALLGLGTQMYSNALRKLPYMRHPWEHLLGMGLGAVFVNQLVKFDEKLKEDLDKMLERARLAN

SEQ ID NO: 60140 - DNA, 760 bp, Zea mays
  misc_feature: Ceres CLONE 1518635
  misc_feature (522)..(522): n is a, c, t, g, unknown, or other
tacccgcggtggcggccgctctagaactagtggatcccccgggctgcaggaattcgtctcacccctagaaaaaagccaagcaaataagacgacttgtttcattgattcttgaagagatcgagcttcttttgcaccacaaggtcaaggatgtcttgcaactgcggatcaagctgcggctgcggctcaagctgcaagtgcggcaagaagtaccctgacctgtaggagacgagcaccgccgcgcaggccaccgtcgtcctcggcgtggccccggagaagaaggccgcgcccgagttcgtcgaggccgcggcggagtccggcgaggccgcccacgcctgcggctgcggtagcagctgcaagtgcgacccctgcaactgctgatcacatcgatcgacgacaccggatatgattattatctatccaactttgggggggtggtgaaaaataataaagcaaggccgagctggctgccatacataggtatttggggggtgtgtgtcaaagacaaagaaaccgagttcttcngtttgctatctctctctcggcagggttggccgtcagccattgagcacactgtaccgggggccaaacaggatggtgggttcaacccaaaaggcggcggccagaaccccattttcacttggtgcacacaagaaaccgcacttggacaacaaaatatatagtttgcagacccccccccttaggagatggttaaataatgagaccccccccgagggaacccaattttcccccccataaaggg

SEQ ID NO: 60141 - DNA, 644 bp, Zea mays
  misc_feature: Ceres CLONE 1518639
  misc_feature: Encodes the peptide sequence at SEQ ID NO. 60142
tcccccgggctgcaggaattcgtctcacccctagaaaaagacctgcagccaaccatctaccaacgactcatcgagcgagagcagcactcacgctgctagctaggagcagcagcgcagcagcggcgatggcggcctccatgatctcctcgtcagctctggcggtggcgcctcagagcctgccacccctcgggcgccgcgcctcctcctgcggcgtcgtctgctccgggaagaagatggggagcgacataggcctaccggatttgaaatctggcctaaccctcccacgccaacgccaacggggaaaatgggcgtggggctaacctcctcttaccccttttttatgaacaataacggggctggattttccatctgttttcccccccgaggggaccaagggggggtggtatggggtctcccccgcggggggacagtcaactttcgggtggggaacccctggggccttcccggattcggggtgcgggcccccctcggggggggatcccccgaagtggttcgccacccctcctcccggctcccgacaacggcgggccctccccgggctaaagtatacaccaagtggagttgaccttcttgcgggacccctcctctctgcaatgcctggcggggtcaaaataaaaaaacgg

SEQ ID NO: 60142 - protein, 64 aa, Zea mays
  misc_feature: Ceres CLONE 1518639
MAASMISSSALAVAPQSLPPLGRRASSCGVVCSGKKMGSDIGLPDLKSGLTLPRQRQRGKWAWG

SEQ ID NO: 60143 - DNA, 681 bp, Zea mays
  misc_feature: Ceres CLONE 1518642
  misc_feature: Encodes the peptide sequence at SEQ ID NO. 60144
  misc_feature (417)..(417): n is a, c, t, g, unknown, or other
aaagctggagctccccgcggtggcggccgctctagaactagtggatcccccgggctgcaggaattcgtctcacccctagaaaaagtgtccagaagacgcctcagccaccgcaaaatccccaaatccgcggcggagaggagagagccggagagaggggcgcagccagagagatcggagaaggggaagaagatggtgcgggtggcgacctacttcgcgatgaccttcggggcgttcctcttctggcagtccatggacagggtccacgtctggatcgcccttcaccaggacgagaagaaagaaaagatggaaagggagctggagataaagagaatgcaggcagagttactggcccaagctaaagagaatgaatcatgatggtcatttgtccaatgggtttcaggcaggttcccttatcgnaatttcctctggccggatttccatgcaaaatccttgacctgagggatgccccctgccccagcacctcccaataaagcgagacctgcttttgccattgtttgaatgcaaaggggtattgcccttttgccgtatggcctatggttggaatgggtgtacctttcccccacctggaagaagggtggccccccgccttgattgggaacaacaaggaatttgcggcggggttttttgtccccttttaccgggacaacaccccagtgcacc

SEQ ID NO: 60144 - protein, 61 aa, Zea mays
  misc_feature: Ceres CLONE 1518642
MVRVATYFAMTFGAFLFWQSMDRVHVWIALHQDEKKEKMERELEIKRMQAELLAQAKENES

SEQ ID NO: 60145 - DNA, 496 bp, Zea mays
  misc_feature: Ceres CLONE 1518647
  misc_feature: Encodes the peptide sequence at SEQ ID NO. 60146
  misc_feature (404)..(404): n is a, c, t, g, unknown, or other
ctggagctccccgcggtggcggccgctctagaactagtggatcccccgggctgcaggaattcgtctcacccctagaaaaaagctagaggttgcaccagcaaaccaaataagcagaccaccttctccacccggctggcctggccgagccttcagtcttcctccgatccccaggccccagccactccccgtacaagccaaaaagaccagtaggtaggcagggcagttcatcgtcgatcgagcaagatgtcggactggggcccccgtgttgatcgggcctgtggcttgttcgtgcctgctctcccccgggggctgcttcgttccaactccccccgggcgcccaccaacttgggggggaaaattccggggcaaacccctgaaaaaaaaacaaaagggggcccccgggncccccccaaaaaccccccctgtgtccccacccccccccacacaaaacaatctctaaatttttttggcggggggggtgaaaaaaaacccccct

SEQ ID NO: 60146 - protein, 84 aa, Zea mays
  misc_feature: Ceres CLONE 1518647
  misc_feature (54)..(54): Xaa is any aa, unknown, or other
MSDWGPRVDRACGLFVPALPRGLLRSNSPRAPTNLGGKIPGQTPEKKTKGGPRXPPKNPPCVPTPPHTKQSLNFFGGGGEKKPP

SEQ ID NO: 60147 - DNA, 737 bp, Zea mays
  misc_feature: Ceres CLONE 1518651
  misc_feature (1)..(1): n is a, c, t, g, unknown, or other
  misc_feature (313)..(313): n is a, c, t, g, unknown, or other
  misc_feature (315)..(315): n is a, c, t, g, unknown, or other
  misc_feature (387)..(387): n is a, c, t, g, unknown, or other
  misc_feature (388)..(388): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (392)..(392): n is a, c, t, g, unknown, or other
naacagctggagctccccgcggtggcggccgctctagaactagtggatcccccgggctgcaggaattcgtctcacccctagaaaaaagcagcagcacagtcatccacactaacgaacgaactcttgctccgatcacgagctagctgaggtcgacgatggcggctgtgctgaacagcaggaagacggcgcaggcggtggtggccgtgctggtggcggcggcgctgctggcttcgtccacttcggcggcgatcacctgcgggcaggtggggtcgtcgctggcgccgtgcatcccgtacgcgacggggagggccancncgctccccgcgtcgtgctgcagcggcgtcaagagtcttattttttctcctcccaccagggggggggcggggnnnnnnttgcccctccctcaaaatcctctcccaaatcgtcaagagcgtcaacctgggcccccggcgcccccctccccggcaagtgcgggggtcctccgcccgattcccccaccaccgtgtccaccgactgtagacacgaacaggctaatctcccacctaccaacgttgataaggcttctctacgcccgccccgaaccgcccccccccccctcctcgaggggcacccgaatcccgggggggaaaataacctgcccgccgcccccattttgtcggtgccgccccccccgcgtccttatagccccccgtcctctcgtagccactcgctttgtacgcccccccccccctcctccc

SEQ ID NO: 60148 - DNA, 678 bp, Zea mays
  misc_feature: Ceres CLONE 1518652
  misc_feature: Encodes the peptide sequence at SEQ ID NO. 60149
ctggagctccccgcggtggcggccgctctagaactagtggatcccccgggctgcaggaattcgtctcacccctagaataaacccaccgagccaaaggccaccaccattccttccccaactctgcaggctgctcgtcgccctccctccacgccggacgcgccccgatccagatccaggggcgtaacatggcatcaaaacgtatcctcaaggaattaaaggacctgcagaaggaccctccaacgtcatgcactgcaggccccgctggtgaggatatgttccactggcagggaaccatcatgggtcctcctgataatccaatatgccggacgtgcttacataaaacaaaaatcatttcccccccggaaatacccagtgtagaggctcgaaaggtaactctctaacaactaaaggcttcccatcctaaacacccaatagtaattcggaaacaaaaagcctccaacaattcttaaggaaccactgggaaccccggcctttgacaaccccctaaaggtgttgccctttcaaacctggcccggcgagggaataggttcccaaacccaaaacaatcccccttgctccccccaaaagcgccccccaatggaccaaaaaaggaaatgaccctaaaattagggaggccaaccacccccgcagcgggggaccctaaataatattctattg

SEQ ID NO: 60149 - protein, 71 aa, Zea mays
  misc_feature: Ceres CLONE 1518652
  misc_feature: SWISSPROT Homolog: EC 6.3.2.19 Ubiquitin--protein ligase
MASKRILKELKDLQKDPPTSCTAGPAGEDMFHWQGTIMGPPDNPICRTCLHKTKIISPPEIPSVEARKVTL

SEQ ID NO: 60150 - DNA, 679 bp, Zea mays
  misc_feature: Ceres CLONE 1518655
  misc_feature: Encodes the peptide sequence at SEQ ID NO. 60151
aaagctggagctccccgcggtggcggccgctctagaactagtggatcccccgggctgcaggaattcgtctcacccctagaaaaaggtggctgtagtttagtggtgagaattccaaagcaaataagacgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacggctgcagctgcggtggcaactgcaagtgcgaccccctgcactgctgatcacatcgatcgacgaccatggatatgattattatctatctagcttgtggtggtggttgacaataataagcgaggccgagctggctgccatacataggtattgtgtggtgtgtgtgaaaaaaaaagaacaaagttcttcagtttgctatctctctctgcatgtttggcgtcagcctttgtgctcatgtacgtacctgggtctacctgcatgttggtggatcccattgcatctgctggaacccataattatttggtccccgaaag

SEQ ID NO: 60151 - protein, 76 aa, Zea mays
  misc_feature: Ceres CLONE 1518655
  misc_feature (1)..(76): Pfam Name: Metallothio_2 Pfam Description: Metallothionein
MSCNCGSSCGCGSSCKCGKKYPDLEETSTAAQATVVLGVAPEKKAAPEFVEAAAESGEAAHGCSCGGNCKCDPLHC

SEQ ID NO: 60152 - DNA, 655 bp, Zea mays
  misc_feature: Ceres CLONE 1518657
  misc_feature: Encodes the peptide sequence at SEQ ID NO. 60153
  misc_feature (80)..(80): n is a, c, t, g, unknown, or other
  misc_feature (415)..(415): n is a, c, t, g, unknown, or other
  misc_feature (463)..(463): n is a, c, t, g, unknown, or other
  misc_feature (655)..(655): n is a, c, t, g, unknown, or other
catgctggagctcacgcggtggcggccgctctagactagtggatccccgggctgcaggattcgtctcacccctagaaaancaacggtcccgtcgctggcggccccggcggccaagaagcggtccggcggcgtcacgtacgtggagggcatgaacgcctacagcggcctcaaggggctcaacaaggtgaacatgctcggggtgcgcaagaccgccgactactccttcgccaaggtcgtggcgtcgctcagccccgcgggcaggaagcggcgcggcggcgcgttcggcgcccagatgaacgccgccgccgagatcttcaggatcgccgccaccatgaacggcctcgtgctcgtcggcgtcgccgtcgggttcgtgctgctcccggtggaggccgccgtccaaggagccgagtagggngcgtgggccttgcactgttggctgtcgccccgggcccaatctgcttcnaaaaccggataaatataaccagatggtaccctttcgattcaatttactttggtatgtatccatgaacaattggtgaataccgtgggaaaatatgtttttttggaagtccaggccccaaaaaaaaaaaaaaaaaaccgagcgccctccaagggtccccctttgtccccctatatagtgggggcgcgtattccn

SEQ ID NO: 60153 - protein, 87 aa, Zea mays
  misc_feature: Ceres CLONE 1518657
  misc_feature (49)..(84): Pfam Name: PetM Pfam Description: PetM family of cytochrome b6f complex subunit 7
MNAYSGLKGLNKVNMLGVRKTADYSFAKVVASLSPAGRKRRGGAFGAQMNAAAEIFRIAATMNGLVLVGVAVGFVLLPVEAAVQGAE

SEQ ID NO: 60154 - DNA, 664 bp, Zea mays
  misc_feature: Ceres CLONE 1518665
  misc_feature: Encodes the peptide sequence at SEQ ID NO. 60155
cagagctggagctccccgcggtggcggccgctctagaactagtggatcccccgggctgcaggaattcgtctcacccctagaaaaaatccagtgttctgtcctagcgccgccgccgccccagctcgccttgcgtgactgagagctcgtcggcttccgtccacgcgtgaagcgagagcatggacacccaggtgaagcttgctgttgtggtgaaggtgatgggcaggaccggctccaggggtcaggtgacccaggtcagagtgaagtttttggatgaccagaaccggctcatcatgaggaatgtcaaggggcccgttcgcgagggtgacatcctcaccctgctcgagtccgagagggaggccaggaggctgcgctgaagccctagcgttcttggtgggctcttgtatggcctttggtgtcttggaatttgtgctatgtttgaacttctgtgaccctgttttaagagtaagaagcctgggtataagaattcgcaacttttctttatcctgggtgaaaaggcgcaattggggggttcaaaaacaggggaaaacccctgccccacacatacctaaaaaaccccccccggcgcttgtgaatttccctcacaaaaaaaaaaaaaaaaaaacccgcacaacaacatcaaaataaaacccccggaaaaccgccc

SEQ ID NO: 60155 - protein, 65 aa, Zea mays; identical to SEQ ID NO: 5504
  misc_feature: Ceres CLONE 1518665
  misc_feature (1)..(65): Pfam Name: Ribosomal_S28e Pfam Description: Ribosomal protein S28e

SEQ ID NO: 60156 - DNA, 785 bp, Zea mays
  misc_feature: Ceres CLONE 1518668
  misc_feature: Encodes the peptide sequence at SEQ ID NO. 60157
  misc_feature (566)..(566): n is a, c, t, g, unknown, or other
aagctggagctccccgcggtggcggccgctctagaactagtggatcccccgggctgcaggaattcgtctcacccctagaaaaagtgctttcttagaggagggttggcttctcctccccctccggttcgggttctgattcgtgaggttctccggggttcgagtttcctgggtgagcggatcgagatggttgctatcgatgttgaggaccgctgcttcgtccgcgggctcgcctgggtcacccacgaccgctgcctcctaccccccttcagcatccacggtcaggacctctactccggcaccatccgcgaacggtagacgcaaaggtcccgcagtttcggctacgtcccctgtcttcttggatgaggctatgcgggagcctcttcaagggtatgatttggtatggaaccgcgacttgctccacatataccgtcaatatagttcccaaaccctcggtttacctttggtagccgctaccccggtggtacggccgcctccctcttaaaatgccgccgcctccccctatggggatgggccgccctggacgagcggcgttttcgtaccgcagnattcgcccttggcgcaccacaggttgccgggccctctcccttattttttggtgcgcgagcgatcgtttctgcggtttttctttaacccccccaatgtcggtcttgcccgctttctttccagtgggtcacctggctgtgcactttcacccggtatgtgggtcctctccacagacccacccttatgtggcgaggggtttattattttgtcgtagaccgaac

SEQ ID NO: 60157 - protein, 43 aa, Zea mays
  misc_feature: Ceres CLONE 1518668
MVAIDVEDRCFVRGLAWVTHDRCLLPPFSIHGQDLYSGTIRER

SEQ ID NO: 60158 - DNA, 680 bp, Zea mays
  misc_feature: Ceres CLONE 1518671
  misc_feature: Encodes the peptide sequence at SEQ ID NO. 60159
  misc_feature (394)..(394): n is a, c, t, g, unknown, or other
  misc_feature (398)..(398): n is a, c, t, g, unknown, or other
  misc_feature (450)..(450): n is a, c, t, g, unknown, or other
ggagctccccgcggtggcggccgctctagaactagtggatcccccgggctgcaggaattcgtctcacccctagaaaaaagcttctcaaccggataggtagcaccggagcaggtagaacgctgcacaatccccttcgccgccgccaagatggtgaacgttcctaagaccaagaagacgtactgcaagaacaaagagtgcaagaagcacacactccacaaggtgactcagtataagaagggcaaggatagcctgtctgcccagggaaagcgccgttatgaccgcaagcagtcaggatatggtggtcagaccaagcctgtcttccacaagaaggccaagaccaccaataatattgttctcaagctgcggggggggggggtgcaagcactactcacancacnccatcaaaagatgcaagcattttgagattggtggagaccaaaagggccaggncacatcttttttctaagcttctcgtccccctgtctggttggtaagttgaaactgtgggtctaccactactgtaataaaacatggcggctaaattcagtgtcaatggagccatgaaagcgcacccgcctagtttcccaattccgcggcgggagtttggttcggcgggggggggcggattttggtacgcgaagaatttgtgcttaaaaaaaaaaggaaaaaagcgctcgggg

SEQ ID NO: 60159 - protein, 91 aa, Zea mays
  misc_feature: Ceres CLONE 1518671
  misc_feature (19)..(90): Pfam Name: Ribosomal_L44 Pfam Description: Ribosomal protein L44
  misc_feature (83)..(83): Xaa is any aa, unknown, or other
  misc_feature (84)..(84): Xaa is any aa, unknown, or other
MVNVPKTKKTYCKNKECKKHTLHKVTQYKKGKDSLSAQGKRRYDRKQSGYGGQTKPVFHKKAKTTNNIVLKLRGGGVQALLTXXHQKMQAF

SEQ ID NO: 60160 - DNA, 704 bp, Zea mays
  misc_feature: Ceres CLONE 1518672
  misc_feature: Encodes the peptide sequence at SEQ ID NO. 60161
aaagctggagctccccgcggtggcggccgctctagaactagtggatcccccgggctgcaggaattcgtctcacccctagaaaaagcggcgacggtgacgacgaccgcgcgagcgccgccgactccctactgcatcaggtgcctcggccttcgtcgtgctctccgccggcaacgagtatagacgggcgcgcatggccaccttcgagctgtaccggaggtccaccatcggcatgtgcctcaccgagacgctcgacgagatggtctccaacggcaccctcagcccggagctcgctatccaggtcctcgtccagttcgacaagtccatgacggatgctctggagaaccaagtgaagagcaaggttactgtcaagggtcacctgcacacctacaggttctgtgacaacccccggaccttcatcttgacagacacaagctttcaaaatgaggaggccaccgagcacgtgggcaaggtgaagattgtggcatgtgattccaaatttgtccggacaataaggcctgtgtacccctcgagggtcagggaaggaagccttttaattgccggcgaggccgggggccttgcctgccctttcagcttgtaacccccctttggtttacccccgaggcgggggggcttgtttttggttccgcctgaatcccccccttagattaaccgcccccgaaggggggttttttattgtggccctt

SEQ ID NO: 60161 - protein, 135 aa, Zea mays
  misc_feature: Ceres CLONE 1518672
  misc_feature (2)..(50): Pfam Name: TFIIA_gamma_N Pfam Description: Transcription initiation factor IIA, gamma subunit, helical domain
  misc_feature (52)..(101): Pfam Name: TFIIA_gamma_C Pfam Description: Transcription initiation factor IIA, gamma subunit, beta-barrel domain
MATFELYRRSTIGMCLTETLDEMVSNGTLSPELAIQVLVQFDKSMTDALENQVKSKVTVKGHLHTYRFCDNPRTFILTDTSFQNEEATEHVGKVKIVACDSKFVRTIRPVYPSRVREGSLLIAGEAGGLACPFSL

SEQ ID NO: 60162 - DNA, 571 bp, Zea mays
  misc_feature: Ceres CLONE 1518673
  misc_feature: Encodes the peptide sequence at SEQ ID NO. 60163
  misc_feature (96)..(96): n is a, c, t, g, unknown, or other
  misc_feature (332)..(332): n is a, c, t, g, unknown, or other
  misc_feature (349)..(349): n is a, c, t, g, unknown, or other
  misc_feature (353)..(353): n is a, c, t, g, unknown, or other
caaagctggagctccccgcggtggcggccgctctagaactagtggatcccccgggctgcaggaattcgtctcacccctagaaaaaacagtgccgcngctgccccgcagcctcagccgcatggctctcctcgcctcccccacgccgttcggcgctgcagccatccgccgccgcgtcgccccgcttcctctcatccctgcaggcggtcgcgccgccctgcacgtggccctcgcgcgccgcggcggggtctcgtcccgcacgcagcggcgcctcgaggagcgcggaggcaagaagcgccgcggcggggtcgcggcgcccgacgtggacgaggacncggcggaggcggggacngccngcggaatgggaggggaaccgctggggttcaggtgtcacgaccatgcggaactcccaacccgaaaaacccaacttctgggagggcgctcatggggagcccttggtttcttcggcaaaaatgggggcgttcggggtctttttgggccccattgttttggggtcccttgggccccctacaaacacgggggaaagggattttcaaaaaacccccggtttaaa

SEQ ID NO: 60163 - protein, 151 aa, Zea mays
  misc_feature: Ceres CLONE 1518673
  misc_feature (72)..(72): Xaa is any aa, unknown, or other
  misc_feature (79)..(79): Xaa is any aa, unknown, or other
MALLASPTPFGAAAIRRRVAPLPLIPAGGRAALHVALARRGGVSSRTQRRLEERGGKKRRGGVAAPDVDEDXAEAGTAXGMGGEPLGFRCHDHAELPTRKTQLLGGRSWGALGFFGKNGGVRGLFGPHCFGVPWAPYKHGGKGFSKNPRFK

SEQ ID NO: 60164 - DNA, 637 bp, Zea mays
  misc_feature: Ceres CLONE 1518674
  misc_feature: Encodes the peptide sequence at SEQ ID NO. 60165
atagctggagctccccgcggtggcggccgctctagaactagtggatcccccgggctgcaggaattcgtctcacccctagttattgcccccgtctcaccgcactggcttgccccctactctgcctcgcttagcttagccgccgctgctacgcactctcgccgtccttgttcccgcgtcgctctgctcgcgatggcgtcccgcgttgcattgctgctcgtggccgtggcggccgtgctgttcgccgcggcgtcggcggcggagatggacctgggcgtgacccccgcgcacgtgcccgacacgggcgcggcagcgggggccgcggcgtcagtcctgaacaggccttgccctgcagcctgcgtcatacttctgcccggcggcctcgtgccagaggcgctcccgtcgacgcgggagctagctgctggctcgggggcgggcggaacactgatcgaccgggtcccccttacctatccctggaagtaagagtcatgggctgggttgatcgtgccccagtctccccctggggcgccctggccaccttgggctatggccttatccccgtgtaccttacccgctaggccaacaaaaaccctggtgtccaggcggcccatttaataaaaaaaacacaaggaaccccttc

SEQ ID NO: 60165 - protein, 96 aa, Zea mays
  misc_feature: Ceres CLONE 1518674
MASRVALLLVAVAAVLFAAASAAEMDLGVTPAHVPDTGAAAGAAASVLNRPCPAACVILLPGGLVPEALPSTRELAAGSGAGGTLIDRVPLTYPWK

SEQ ID NO: 60166 - DNA, 625 bp, Zea mays
  misc_feature: Ceres CLONE 1518675
  misc_feature (48)..(48): n is a, c, t, g, unknown, or other
  misc_feature (191)..(191): n is a, c, t, g, unknown, or other
tggagctcaccgcggtggcggccgctctagaactagtgatgccccagnctgcaagaatccgtctcacccctagttattgccctagcctccaccccatccggcagcagccaaaccctacataggcgccgccgcaggcggcccccccgcatcgtcgccaaagatgcagatctttgtgaagactctgacggggnaaagaaaccatcacttttgggagggtggagtccctcgggacaccattcgaacaatggtgatattttgttggtgttttttttgttttgttttaggtaaagaagaagaaaaaaggaataaatcaaaatttacttattaaggcgcacacccggcgcgcacgcgtggaaaatcgagtgtatatagactgggtacgacgcatgggtttgtaagagagtgagaggtttattttatgagcaagggggatagagtagtattggtgataattgatagatggaacggtttagggacgatcgtttttttataaaagagttatttatggtaattggattgacgtaattgtatattggtgtttttatggaacagtgattattgattataggccaggtgaaaagatgatgatttgtcttgattggttattgatggataagaaatattg

SEQ ID NO: 60167 - DNA, 654 bp, Zea mays
  misc_feature: Ceres CLONE 1518681
  misc_feature: Encodes the peptide sequence at SEQ ID NO. 60168
aaagctggagctccccgcggtggcggccgctctagaactagtggatcccccgggctgcaggaattcgtctcacccctagaaaaaagataagcgttccagatcgtactggaccaatctgccaccacactttgatcacacacaggaagttgagatcagaaaaatgcaggctgccgctactgccgccgggttctcggccgtgctgcccgccaagggcaggccggcggcgaggagcagggtggtggcccgtgtccccgccacaaggaggagcgtccgtgtagctgccgtcgtcgcgaccgaggccgcgcagatcgactacagctcaagcgtctcggtgttcccgatggaggcctgcgacctgcttggtggcgacgcgtgcaacgggcccatgttcccggaggccaagcccgcctcggcggcggcggcggcgagcaggagtgtggtcggggtggacagggactacctgtcctacgacgagccaaagacggtgttcccgggcgaggcgtgcgatgaccttggcggcgagttctgcgaggcgccgtaccaggacggcgtcttcaaagagctggcgcacgcctgaaaaccctgatccatccatttctgtcccccccccatgtacgtatggtgaccaaatggtttaccatctactggtaaaac

SEQ ID NO: 60168 - protein, 138 aa, Zea mays
  misc_feature: Ceres CLONE 1518681
  misc_feature (1)..(126): Pfam Name: Lir1 Pfam Description: Light regulated protein Lir1
MQAAATAAGFSAVLPAKGRPAARSRVVARVPATRRSVRVAAVVATEAAQIDYSSSVSVFPMEACDLLGGDACNGPMFPEAKPASAAAAASRSVVGVDRDYLSYDEPKTVFPGEACDDLGGEFCEAPYQDGVFKELAHA

SEQ ID NO: 60169 - DNA, 634 bp, Zea mays
  misc_feature: Ceres CLONE 1518682
  misc_feature: Encodes the peptide sequence at SEQ ID NO. 60170
  misc_feature (634)..(634): n is a, c, t, g, unknown, or other
ggagctccccgcggtggcggccgctctagaactagtggatcccccgggctgcaggaattcgtctcacccctagaaaaaatctcagcagtgacgaactcgaagcttgcgttcttgtagtagaggtcggcagcaagcggtggtagagcgagaggtcgagaagatgaagagcagcactctgttggcgatcctagttctccaggcccttctggtctctgcggccgtggccaaaggacctgcagggccgacgacgaagaagcagtgctggtgcggcgagtgcaccagctggtcgggcgtgtggacctgcgacgacctcctcaccaagtgcgccgccacctgcaagaactgcgtccccgtgtccccggacaagggggccatcaagtacaggtgccgcgacttcctcccccgaaactgcggctgcaagatccactagagactcatccaattccaccatggccgcgcgccacagcggcacagccgatggatccctccatgttccctcgtccgtccgcccttgcctacagccagcagcccccaccaataagctacctccttgttgttgttttggaatgtcttgattgggtgttccctttcccagtcggagtgggaaataaaaataaatcctcccggggccccn

SEQ ID NO: 60170 - protein, 89 aa, Zea mays
  misc_feature: Ceres CLONE 1518682
MKSSTLLAILVLQALLVSAAVAKGPAGPTTKKQCWCGECTSWSGVWTCDDLLTKCAATCKNCVPVSPDKGAIKYRCRDFLPRNCGCKIH

SEQ ID NO: 60171 - DNA, 675 bp, Zea mays
  misc_feature: Ceres CLONE 1518685
  misc_feature: Encodes the peptide sequence at SEQ ID NO. 60172
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
aagctggagctccccgcggtggcggccgctctagaactagtggatcccccgggctgcaggaattcgtctcacccctagaaaaaaccatcacacagcaatccacacaagcacttcgacgtcacacgggcgctgcgcacagacacaccaagcgtcggcaccaatggcttactaccaggaggtggactactgctcgcaggaggtgaggtcggtggccccggccgggttcggccgccacggcggaggagtccaccatcacgtcgtccatgagaagttccaggaagtcgacacagtctcacacgacggtgcataccaccaccaccaccatggtcaccacggcggtcacggcttcttgctgcgcgagacgcgatgtcgagaggacatcaacacctgcaccggcgagatccagaagcgcacgaaaaccttcctcaccagggctaactgagccgcccggcggccggcatccacgcccgttcctgcttgcctgcgtgacttatgtatgtctgtggttgactggttctgcatggtcatcgtacttggctacgaccgccacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 60172 - protein, 93 aa, Zea mays
  misc_feature: Ceres CLONE 1518685
MAYYQEVDYCSQEVRSVAPAGFGRHGGGVHHHVVHEKFQEVDTVSHDGAYHHHHHGHHGGHGFLLRETRCREDINTCTGEIQKRTKTFLTRAN

SEQ ID NO: 60173 - DNA, 571 bp, Zea mays
  misc_feature: Ceres CLONE 1518686
  misc_feature: Encodes the peptide sequence at SEQ ID NO. 60174
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
ctccccgcggtggcggccgctctagaactagtggatcccccgggctgcaggaattcgtctcacccctagaaaaaagccaagcaaataagacgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacggctgcagctgcggtggcaactgcaagtgcgacccctgcaactgctgatcacatcgatcgacgaccatggaatatgatatttacctatcctagccttggggggggggggttaaacaaaaaaaaaaccagggggcaaaaatgggggccccccaaaaaaaaaaaaaatttttttggggggggggggggggggnnnnnncnnnnnnnnnnnnnnnnnnnaaaaaaaaaaaaaaaaatcttttt

SEQ ID NO: 60174 - protein, 76 aa, Zea mays; identical to SEQ ID NO: 8464
  misc_feature: Ceres CLONE 1518686
  misc_feature (1)..(76): Pfam Name: Metallothio_2 Pfam Description: Metallothionein

SEQ ID NO: 60175 - DNA, 638 bp, Zea mays
  misc_feature: Ceres CLONE 1518689
  misc_feature: Encodes the peptide sequence at SEQ ID NO. 60176
  misc_feature (638)..(638): n is a, c, t, g, unknown, or other
ccccgcggtggcggccgctctagaactagtggatcccccgggctgcaggaattcgtctcacccctagaaaaaattattcctcgcagctgtcccagctgacggacgactgttccacccacagacaaaatggccgcctccacctcctccgtctccggcctagccggcgcctccctggccagccgcccgggcttctccagctggtatccacggggcacccgggtgtctgcgagaaacccccctgatgatcaagaacctggagaagagtgaggagacctcgtgaatgaggtttaaacgggactgaatagctaacgtacctaaagtccctcgagtgtggtcttattcttcttaatggaccccacccagggttggggggcctcaacatgaataatatttaaacgggcgccccccccccccaataaacccgattcttgcccatttgcccacgggcccctgcccgccacctcccagtaccagcttgcggtcaccttacttgtcccccaacgcttttgtcccgatgcccacttcgcgcctcgtcctcatcactcaatccgccgctccccagacattctcctaatactacatacgactcacaaaccacccacgccactgcccgcgcggagcccccccttcatttgctn

SEQ ID NO: 60176 - protein, 46 aa, Zea mays
  misc_feature: Ceres CLONE 1518689
MAASTSSVSGLAGASLASRPGFSSWYPRGTRVSARNPPDDQEPGEE

SEQ ID NO: 60177 - DNA, 709 bp, Zea mays
  misc_feature: Ceres CLONE 1518694
  misc_feature: Encodes the peptide sequence at SEQ ID NO. 60178
  misc_feature (397)..(397): n is a, c, t, g, unknown, or other
agagctggagctcaccgcggtggcggccgctctagaactagtggatcccccgggctgcaggaattcgtctcacccctagaaaaaagccaagcaaataagacgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacgcctgcggctgcggtagcagctgcaagtgcgacccctgcagctgctgatcacatcnatcgacgaccatggatatgattattatctatctagcttgtggtggtggttgaacaaaataagcgaggccgagctggctgccatacataggtattgtgtggtgtgtgagagagagagagaaacagagttcttcagtttgctatctctctctctgcatgtttggcgccgggctttgtgctcatgtaccgtgtgcctacatgctggttgggttgatccgaatggcgccggctgtaacccataaataatttggccccccaagaattggatttgaaacgcaagaagatacgtaggagccagaaaaaagaaaaagaag

SEQ ID NO: 60178 - protein, 76 aa, Zea mays
  misc_feature: Ceres CLONE 1518694
  misc_feature (1)..(76): Pfam Name: Metallothio_2 Pfam Description: Metallothionein
MSCNCGSSCGCGSSCKCGKKYPDLEETSTAAQATVVLGVAPEKKAAPEFVEAAAESGEAAHACGCGSSCKCDPCSC

SEQ ID NO: 60179 - DNA, 723 bp, Zea mays
  misc_feature: Ceres CLONE 1518698
  misc_feature: Encodes the peptide sequence at SEQ ID NO. 60180
ggcggccgctctagaactagtggatcccccgggctgcaggaattcgtctcacccctagaaaaactcgagcctgacccttacgccttcgctcgcgccgccgccgccgccgccgctacgccccgcacctcgcttcatttcgtgtcgccaagatgacgaagcgcactaagaaggcaggaattgttggcaaatatggaaccaggtatggtgctagcttgcgtaagcaaatcaagaagatggaggtatctcagcattccaagtacttttgcgagttctgtgggaagtttgctgtgaagaggaaagcagttggaatttgggggtgcaaggactgtgggaaggtgaaggctggtggtgcttacaccatgaacactgctagtgcggtcaccgtcaggagcacgatccgccgcctgagggagcagaactgagcatgatatagctctttatattattggggtttcctgtaattgctcttgtcaggcatgttggggggccttatctagtggaaatgtgaaatcactgtactggctgttttgccaagacatgctccttaaatttggttatgctctaggatacccaaggtggggttgtgaaatttgccctcgggtaccgtttcgaaactgaaaagggattttggacctggggcctcaaaaaaaaaaaaaaaaacgagacctccggggtcccaattcgcccataagggggccaatttagcggcgccctggggccgtt

SEQ ID NO: 60180 - protein, 90 aa, Zea mays
  misc_feature: Ceres CLONE 1518698
  misc_feature (2)..(91): Pfam Name: Ribosomal_L37ae Pfam Description: Ribosomal L37ae protein family
MTKRTKKAGIVGKYGTRYGASLRKQIKKMEVSQHSKYFCEFCGKFAVKRKAVGIWGCKDCGKVKAGGAYTMNTASAVTVRSTIRRLREQN

SEQ ID NO: 60181 - DNA, 704 bp, Zea mays
  misc_feature: Ceres CLONE 1518701
  misc_feature (170)..(170): n is a, c, t, g, unknown, or other
  misc_feature (173)..(173): n is a, c, t, g, unknown, or other
  misc_feature (188)..(188): n is a, c, t, g, unknown, or other
  misc_feature (236)..(236): n is a, c, t, g, unknown, or other
  misc_feature (237)..(237): n is a, c, t, g, unknown, or other
  misc_feature (251)..(251): n is a, c, t, g, unknown, or other
  misc_feature (254)..(254): n is a, c, t, g, unknown, or other
  misc_feature (293)..(293): n is a, c, t, g, unknown, or other
  misc_feature (337)..(337): n is a, c, t, g, unknown, or other
  misc_feature (338)..(338): n is a, c, t, g, unknown, or other
  misc_feature (339)..(339): n is a, c, t, g, unknown, or other
  misc_feature (340)..(340): n is a, c, t, g, unknown, or other
  misc_feature (380)..(380): n is a, c, t, g, unknown, or other
  misc_feature (381)..(381): n is a, c, t, g, unknown, or other
  misc_feature (382)..(382): n is a, c, t, g, unknown, or other
  misc_feature (383)..(383): n is a, c, t, g, unknown, or other
  misc_feature (384)..(384): n is a, c, t, g, unknown, or other
  misc_feature (385)..(385): n is a, c, t, g, unknown, or other
  misc_feature (386)..(386): n is a, c, t, g, unknown, or other
  misc_feature (387)..(387): n is a, c, t, g, unknown, or other
  misc_feature (388)..(388): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (392)..(392): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
ccccgcggtggcggccgctctagaactagtggatttcttgggctgcaggaattcgtctcatccctagggaagccatcacctcctcgcctagcctgccactgccagcaggtgccaccgccatctctgctctgctctcgcaacgcaagcacacgcccggccgcctgccacanttnccatggcaaccatanccacgatggcgctgctgaagcccgccgccaaggccggcggccgttccnncccttcaccaccantgnagtctctccctttttttcccccaggggggagggcgccanaaaaattttcttttttttttcaccatcctcccaggtgggggaannnnttttttttccccccccccccgggggaaaagaaaaaggggnnnnnnnnnnnnnnnnnnnnnnccccccccccccccccaaaaacaaaccacaatcttccctctggggggtgggggggcgtacccccccctttcccctcctacccctctctaccccccacccccccgggcccccaaaacaacccccacccactttcagtgctcaccccctccgcgacacctccctcccgcccccgtctacctcccccctatttttctctgccatcccccttgtcatatcccccccccgccccccccgccattctttctcgccggggccctgagaatgactttctcttcacccccccgtctatatcggggacattag

SEQ ID NO: 60182 - DNA, 703 bp, Zea mays
  misc_feature: Ceres CLONE 1518703
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (586)..(586): n is a, c, t, g, unknown, or other
  misc_feature (703)..(703): n is a, c, t, g, unknown, or other
cgcggtggcggccgctctagaactagtggatcccccgggctgcaggaattcgtctcacccctagaaaaaactctctcttgtctcccagtttctaaccctagccgccaaggccaagctccctcccaagtccaaagtcccaaactgctcgtatgcggtgcaaggctgcaggcatccacctccatcaggcgctgacccagtttccgccatccaccaggcgtcctcagaatacggtgcagggctgccgagcagcgagcagcaagccgccgagcagcgagcactgaggaccgtcgagcagccgagcaccgagcagcgagcagaggacagcgaccgtcgagcaaccgagtcgcgagtcttctctggtaaattaaacaagcttggatgaattagtgtttcgatttagagttttggacagattacttgtatggatttgaaaagattacttgtatgaaacgttgaaattgttgtttggtgcttaaaatattattggaatgctgttggaatgttaatttgtgataaatttctgctnnnnnnnnnnnnnnnnnnnnnnnnnnnnnnnnnnnnnnnnnnnnnnnnnngaaaaaaaaanaaaacgagacgctcgagtacccaattcgccctatagtgagtcgaatacgcccgctcactggccgtcttttacaacgtctgactgggaaaaccctggcgttaccaacttatcgcctgn

SEQ ID NO: 60183 - DNA, 649 bp, Zea mays
  misc_feature: Ceres CLONE 1518706
  misc_feature: Encodes the peptide sequence at SEQ ID NO. 60184
ggagctccccgcggtggcggccgctctagaactagtggatcccccgggctgcaggaattcgtctcacccctagaaaaaaccgcccccgatccaccattcctcctccggatttcgcagtcagcggtggtgaaggtagcgggcgcggaggaagatggggctcgcgttcgggaagctcttcagccggctcttcgccaagaaggagatgcggattcttatggtcggtctcgacgccgccggtaaaaccaccatcctctacaagctcaagctcggcgagatcgtcacaaccatccccaccatcggtttcaatgttgaaactgttgagtacaagaacattagcttcacggtctgggatgtcgggggtcaggacaagatcagacctctctggaggcattacttccagaacacacagggtcttatctttgttgtggatagcaatgaccgtgaccgtgttgttgaagccagagatgacctgcacaggatgctgaacgaggatgagctacgtgatgctgggctgcttgtttttgccaacaagccaagatcttcccaatgccctgaatgctgcctaaaatccccgacaaactttgggattacctccccgggccccggaaaatggggatactccaaaagacttttggcccccatggggggg

SEQ ID NO: 60184 - protein, 166 aa, Zea mays
  misc_feature: Ceres CLONE 1518706
  misc_feature (5)..(164): Pfam Name: Arf Pfam Description: ADP-ribosylation factor family
MGLAFGKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDDLHRMLNEDELRDAGLLVFANKPRSSQCPECCLKSPTNFGITSPGPGKWGYSKRLLAPMGG

SEQ ID NO: 60185 - DNA, 650 bp, Zea mays
  misc_feature: Ceres CLONE 1518707
  misc_feature: Encodes the peptide sequence at SEQ ID NO. 60186
  misc_feature (419)..(419): n is a, c, t, g, unknown, or other
ggcggccgctctagaactagtggatcccccgggctgcaggaattcgtctcacccctagaaaaaatttacatgatcccagaatattggcaatggctgctgctcaacaccgtttacttgaagacgagtacgatgaatatactgcaacaaacaataacgctgctgtgttttgccgctctatatttctgattttgatggcccttctgctcctgaggcatacattgaccattactaacagtgatgatgaagatgatgcatctgctattttctcgctatttcttttgagagccgctggatttttgctgccatgctatattatggcttgggctattagtatcatgcagcgtcaaagacaaagacaggaagaagcaatgctgttaccaacggaagtggcgatcattctgcacccggacggaagaaancatgcatttgcggtggcaccagcggaatctcctgcatcacttcagtgaacaggttcaaggcgctgcctccgggagtgctaaactaaaacgaaggcctccccacccatcggggccttaaaagggggaaaaacccaaaaaactttttgggaatttacggtgggggcccccccacaattttgtttaacttttccacggggaaaaataccccggtttgttttcacaaagggcccc

SEQ ID NO: 60186 - protein, 125 aa, Zea mays
  misc_feature: Ceres CLONE 1518707
  misc_feature (110)..(110): Xaa is any aa, unknown, or other
MAAAQHRLLEDEYDEYTATNNNAAVFCRSIFLILMALLLLRHTLTITNSDDEDDASAIFSLFLLRAAGFLLPCYIMAWAISIMQRQRQRQEEAMLLPTEVAIILHPDGRXHAFAVAPAESPASLQ

SEQ ID NO: 60187 - DNA, 681 bp, Zea mays
  misc_feature: Ceres CLONE 1518712
  misc_feature: Encodes the peptide sequence at SEQ ID NO. 60188
cagagctggagctccccgcggtggcggccgctctagaactagtggatcccccgggctgcaggaattcgtctcacccctagaaaaaaccactcatcaccagctagtagctctagcaaagcacttgccatctaccgaccgccgcattccaaacagcccgacgagctagcagagcggcaggcacctcctccaggaacatggcccgcacgcagcagttggcagtagtggcgacagccgtggtggccttggtgctgctggcggcggcgacgtcggaggcggccatcagctgcgggcaggtggcgtcggccatcgcgccctgcatctcctacgcgcgcggccagggctcagggccctccgccggctgctgcagcggcgtcaggagcctcaacaacgccgcccgcaccaccgccgaccgccgcgccgcctgtaactgcctcaagaacgccgccgccggcgtcagcggcctcaacgccggtaacgccgccagcatcccctccaagtgcggcgtcagcatcccctacaccatcagcacctccaccgactgctccagggtgaactgaaaccctaaacgacgacgacggcgccgggcggccgcctgaaaacgaaccatatctatcccgcccgcctcggggccctggggttcggaccgtcatgaccctatctacctccgcaggatcaccactg

SEQ ID NO: 60188 - protein, 120 aa, Zea mays
  misc_feature: Ceres CLONE 1518712
  misc_feature (31)..(116): Pfam Name: Tryp_alpha_amyl Pfam Description: Protease inhibitor/seed storage/LTP family
MARTQQLAVVATAVVALVLLAAATSEAAISCGQVASAIAPCISYARGQGSGPSAGCCSGVRSLNNAARTTADRRAACNCLKNAAAGVSGLNAGNAASIPSKCGVSIPYTISTSTDCSRVN

SEQ ID NO: 60189 - DNA, 710 bp, Zea mays
  misc_feature: Ceres CLONE 1518714
  misc_feature: Encodes the peptide sequence at SEQ ID NO. 60190
cagagctggagctccccgcggtggcggccgctctagaactagtggatcccccgggctgcaggaattcgtctcacccctagaaaaactggttctccatccggtcagaccaatcaacaaagtgacgcgagcacgagcatccatcgtttccccttcttccccatcgcgtgccctcgccgcagacatcttccatggccgaccagctcacggacgaccagatcgcggagttcaaggaggccttcagcctcttcgataaggatggcgaccgctgcatcactaccaaggagcttggaactgtgatgcgctcccttggccagaaccccactgaaccagagctgcaggacatgatcaacgaggttgatgctgatggcaatggcaccattgacttcccagagttcctgaacctgacgcccaggaagatgaaggacacccgactccgaggaggagcttaaggagggctttcgcgtctacgacaaggaccagaatggtttcatctcgggctgctgagctccgccatgtgatgaccaacctctggcgaaaaactaactggacgaagaggttcgaagatataaatccgtgaaggccgaatgtttaaaggcggacggccaaaatcaactagcgacgaattctctctcaggccttcaatggcccaaatggaggaaccgatcccctatgtcctctcgaatggaatttcacgcagaaaattcccgcct

SEQ ID NO: 60190 - protein, 86 aa, Zea mays
  misc_feature: Ceres CLONE 1518714
  misc_feature (12)..(40): Pfam Name: efhand Pfam Description: EF hand
  misc_feature (48)..(76): Pfam Name: efhand Pfam Description: EF hand
  misc_feature: SWISSPROT Homolog: EC 2.7.11.1 Non-specific serine/threonine protein kinase
MADQLTDDQIAEFKEAFSLFDKDGDRCITTKELGTVMRSLGQNPTEPELQDMINEVDADGNGTIDFPEFLNLTPRKMKDTRLRGGA

SEQ ID NO: 60191 - DNA, 704 bp, Zea mays
  misc_feature: Ceres CLONE 1518715
  misc_feature: Encodes the peptide sequence at SEQ ID NO. 60192
  misc_feature (503)..(503): n is a, c, t, g, unknown, or other
  misc_feature (507)..(507): n is a, c, t, g, unknown, or other
  misc_feature (566)..(566): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (665)..(665): n is a, c, t, g, unknown, or other
  misc_feature (666)..(666): n is a, c, t, g, unknown, or other
acccgcggtggcggccgctctagaactagtggatcccccgggctgcaggaattcgtctcacccctagaaaaaatcacaacaaaaggcgcaagcaccgcacggagagcaagcaagaaagcatccactgcactgccactacctaacaatggcccgcgcctacgtgtttctcgtcgtgctcctcctggccgctgtcatcgtggcaccgttcgcgggagcgacgcgtgtcgacgtcgttgagggcaggtccatggcgtccgccgacgcgccggaggccgccgcaccatcacccgggcctgactctgcctcgtcaccggactcctcgtcggaagcgccctccagcagcagctcctcggactagatagctctagccgctcgacgcacgatctcgctctccatctacacggcgatcgagttctagctttgtcggcatgcaatgcaaaaattccgaattctcgggaaataatcagcaccaaaggaatgtgcttgcctcactcactactagnaccntgtttttatatatgttccctccccctgacgctctccgatttttaatctcatgtatgcancatatgtgatggatggaaaaatcgatttggatttgtcagtccnnnnnnnnnnnnnnnnnnnnannnnnnnnannnnnnnnnnnnnnnnnnannnatttnnaaaaaaaaaaagcgaaccctcaggtacccatttcccct

SEQ ID NO: 60192 - protein, 70 aa, Zea mays
  misc_feature: Ceres CLONE 1518715
MARAYVFLVVLLLAAVIVAPFAGATRVDVVEGRSMASADAPEAAAPSPGPDSASSPDSSSEAPSSSSSSD

SEQ ID NO: 60193 - DNA, 611 bp, Zea mays
  misc_feature: Ceres CLONE 1518726
  misc_feature: Encodes the peptide sequence at SEQ ID NO. 60194
aaagctggagctccccgcggtggcggccgctctagactagtggatcccccgggctgcaggaattcgtctcacccctagaaaaatcatccccatccgcacctctctccatctccctgctcctccgccttcttcttgatccagccaagccagggatcgccatgtcggactcggaggagcaccacttcgaatcgaaggccgacgccggagcgtccaagacctacccgcagcagggcggcaccgtccgtaagaacggcttcctcgccatcaagaaccgcccctgcaaggccgaggaggttaccaccccaacaccggtaagcttggtcatggccaatgccactttggtgccctagatttttccccccccaaagaggggggggaggggggcccccctcccccaacctcaccccccgccggggaacccaccgaccttccgccccatggaataccccacactccatcctggacacctcctactccccagcgccacccgcagggcgctcctccacccccccccgcccacaccctcccctccccacccaccccagcgcctccccaaccccccccgccccacaccccccccgaccctcccccctcggcctcctaaccaaccg

SEQ ID NO: 60194 - protein, 63 aa, Zea mays
  misc_feature: Ceres CLONE 1518726
MSDSEEHHFESKADAGASKTYPQQGGTVRKNGFLAIKNRPCKAEEVTTPTPVSLVMANATLVP

SEQ ID NO: 60195 - DNA, 607 bp, Zea mays
  misc_feature: Ceres CLONE 1518732
  misc_feature: Encodes the peptide sequence at SEQ ID NO. 60196
atagctggagctccccgcggtggcggccgctctagaactagtggatcccccgggctgcaggaattcgtctcacccctagaaaaagcagcacgccggagacgagccccaccgacacgcacgctaaaggcagccagcaatggagctgctgctcgtcccatgccgcgccgcaagcgcccgcccgctacgcgcagccagccccagagcctttcgctgccccagcgccaggccggcggccgccagctccagcaacgccgaggtcatcgacaccacggcgacgacgtcgtcgccggacgccccgaagcagtggcgcgcgggcgggcttgggctggagctgtcggaggagttgcggcgcggcatgacgtggcggatgctggcgcctcccgcggcggcagtggcggcggacgccgcgttcctggggctgctcgagcgcgcacagcccggggacctgccggcatgggccgccgccgcgggctccgccgtgctcttcgcggcggggctgctcggagtccactacggcttcctgtcgtcgaggtgggacgcggaggagaacgggtccgtccttggctgggacctcgccgtgcgggactggaacgtcctttccacgcga

SEQ ID NO: 60196 - protein, 157 aa, Zea mays
  misc_feature: Ceres CLONE 1518732
MELLLVPCRAASARPLRAASPRAFRCPSARPAAASSSNAEVIDTTATTSSPDAPKQWRAGGLGLELSEELRRGMTWRMLAPPAAAVAADAAFLGLLERAQPGDLPAWAAAAGSAVLFAAGLLGVHYGFLSSRWDAEENGSVLGWDLAVRDWNVLSTR

SEQ ID NO: 60197 - DNA, 678 bp, Zea mays
  misc_feature: Ceres CLONE 1518734
  misc_feature: Encodes the peptide sequence at SEQ ID NO. 60198
aaaactggagctcaccgcggtggcggccgctctagaactagtggatcccccgggctgcaggaattcgtctcacccctagaaaaaaccgcggcgagttcaaatcccacaatcttcttgtagcacaccactgtcttcgtccaactcggcggcgatgtctgggcgcggcaagggcggcaaggggctgggcaaaggcggcgcgaaacgccaccttaaggttctccgcgacaacatccagggtatcactaagccgggactccggaagctggctagaaagggtggaattaaactaatctcccggcctaaccacgaagaaaccccccgtcttcttcagaatcttcctcaaaaaaagcatccggagacgccctcactcaaaaagcgagggggggtcgatagaaagaacactttcgggccaccaaaagttgtgggcctcccctccagcccccagggcccccactcccgtaacggggtaaccaagggtccaaacgcagtctctttcccctctggtggaaaccggagtggcggatatgctttttccccaaagacccccttaccccttgctatggcactcgaatttaaaaaaaattttctataaattttaaaatactcccgaaaagaggctttgccatattgggaggaggaaacaacgagcccccccgcccatgagcgggggaaaccacg

SEQ ID NO: 60198 - protein, 146 aa, Zea mays
  misc_feature: Ceres CLONE 1518734
MSGRGKGGKGLGKGGAKRHLKVLRDNIQGITKPGLRKLARKGGIKLISRPNHEETPRLLQNLPQKKHPETPSLKKRGGVDRKNTFGPPKVVGLPSSPQGPHSRNGVTKGPNAVSFPSGGNRSGGYAFSPKTPLPLAMALEFKKNFL

SEQ ID NO: 60199 - DNA, 584 bp, Zea mays
  misc_feature: Ceres CLONE 1518743
  misc_feature: Encodes the peptide sequence at SEQ ID NO. 60200
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
ctcacccgcggtggcggccgctctagaactagtggatcccccgaggctgcaggatattcgtctcacccctcagaaaaaaaaaaaaaaaaaaaaaannnnnnggccgaaagcccgaaaccagaggcgggtagggttctagctgcaggcgacggccatggccgcctccgccgccgccccggcgctgcttcgacgcctcttctgcagctctattccagcctcctcctccgtactgcgcgctaccttttgctcctccgccggcttcggctcgtcttctccgtcctccatattcggcgacgccaccgaggtcgccaacgtgccaccgctcaccacgcccaacctcttcgtcagtggcctttcaaggttaacgacagatgagaagctccagggtgcatttgctcctttcgggaggctccttgaagcaaaagtggtgaccgatagagtttctgggaggtcaaagggtttcggtttcgtgagatatgccccccttaaaaaagcccaaaaaaccccggcagggaatgaaacccccagttcccgggatggaatgggccaatcttcgtttgaacccttgccaagcccaagggcgt

SEQ ID NO: 60200 - protein, 143 aa, Zea mays
  misc_feature: Ceres CLONE 1518743
  misc_feature (62)..(125): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAASAAAPALLRRLFCSSIPASSSVLRATFCSSAGFGSSSPSSIFGDATEVANVPPLTTPNLFVSGLSRLTTDEKLQGAFAPFGRLLEAKVVTDRVSGRSKGFGFVRYAPLKKAQKTPAGNETPSSRDGMGQSSFEPLPSPRA

SEQ ID NO: 60201 - DNA, 632 bp, Zea mays
  misc_feature: Ceres CLONE 1518746
  misc_feature: Encodes the peptide sequence at SEQ ID NO. 60202
  misc_feature (588)..(588): n is a, c, t, g, unknown, or other
aatctggagctccccgcggtggcggccgctctagaactagtggatcccccgggctgcaggaattcgtctcacccctagaaaaagacccatctcccaacccctacactcccgagcggcggttctcgagcagcagcaccagcacccgaaagatggggaacttcctcaagcccaggtaggccgtgatcctcctgcaaggacggttcgccagcgggaaggcagtgatcgcgctcgtgtgctacgagagcacccgcgaccgcccctacggccactgactcgtcgcctgcctcgcaaagtacccctagaacgtggtccgcaggttctctgccaagaggaccgcgaagaactcgcgagcctagtgcttcatctagcccgtctacttcatccacttcatgcacacgcgctacaccctcaatgtcaacttcatggacgtggcctacggcgggaccgacgcggtctcaacctctacaagttggtacgctcatgcaaaggcgtcttcgcgcgcctcgaggagatgcccatgacctgctagaactagtggttctttaccaagctccgcttctagatggtcggcgtgccgaatggtgaccngacagtttcttgtataggacacactccaatgcttgtctcattat

SEQ ID NO: 60202 - protein, 43 aa, Zea mays
  misc_feature: Ceres CLONE 1518746
MHTRYTLNVNFMDVAYGGTDAVSTSTSWYAHAKASSRASRRCP

SEQ ID NO: 60203 - DNA, 743 bp, Zea mays
  misc_feature: Ceres CLONE 1518749
  misc_feature: Encodes the peptide sequence at SEQ ID NO. 60204
  misc_feature (546)..(546): n is a, c, t, g, unknown, or other
  misc_feature (633)..(633): n is a, c, t, g, unknown, or other
  misc_feature (637)..(637): n is a, c, t, g, unknown, or other
tagctggagctccccgcggtggcggccgctctagaactagtggatcccccgggctgcaggaattcgtctcacccctagaaaaatttagttattttcgtgaatatgttcaaaaaatcacgtgatgaaaatgctcgaaacgctgaagctgagaaaaagaaactggaaaaggaaaaagaaaaggcaagtgtgtctgctaaataaggtttggaatgagactgctgctctgccaaagttgcatctttgtgaagctgtcgtgctggactgacaaagaggacctgcagtataatttgcggccagtgaagaacctggttttgaaacacctttctgtacctacagaagaagctgtggccaggaagtcctcgcctatcttgagctgcccccccccttaaaatgggtttgcctttttggagaaatttccaaagagatactaccgccccccctccgttgcttcaatggtagacagcggggaatatatttttccaaacaacaaccgacctggaaacaaaaacgttcgccccaacagaccacagacaatagagtgttagntctccttcccccccccccaaattattaaacaaaaaaaactgccacgcaaaaaacacgaaccaccccccggccaacatttaaaattcntgtncctagagcgcccaaacaagcacgagcgaccaaaaaaaataccgccaccctcctggttaccaatttctctcacaataaaaaaaaaaccccgcaacaacggttggctt

SEQ ID NO: 60204 - protein, 32 aa, Zea mays
  misc_feature: Ceres CLONE 1518749
MFKKSRDENARNAEAEKKKLEKEKEKASVSAK

SEQ ID NO: 60205 - DNA, 640 bp, Zea mays
  misc_feature: Ceres CLONE 1518750
  misc_feature: Encodes the peptide sequence at SEQ ID NO. 60206
ctggagctccccgcggtggcggccgctctagaactagtggatcccccgggctgcaggaattcgtctcacccctagaaaaacccgccgcttcttcatcccgtagtgggtggcctaccgccgaggtgtatgaacagcagctccgccatgcctgggtcccgcggagatctgcccaaccgaattcttgagattgatgacttcctcctcaccggaaagaggactgatgcccgctcagagaagatccataccacccacgatgtcctccagctactggtgcgatgctcccagtacttgtacacgctctgcgtcttccatgctcataaccgaacaagttcgactaatctcttgccccagccctgaccccctgaggaagctgattgtctacatggtcaagaagatttgaactacctacggttatctatcctaccacgacatgctactctatgtactcttggattctaagctatcaaacctgacattattggaacgtctgcttcttgagttcttgaagaatagctcttcacgtccgtcatcgtcggatacatcttccttgtgctacctcacatcacttgatccgttacacaacctgctccaacaactcaccgaccccgtgcactccaaggtgcctcacccgccccatagt

SEQ ID NO: 60206 - protein, 70 aa, Zea mays
  misc_feature: Ceres CLONE 1518750
  misc_feature (9)..(66): Pfam Name: Ribosomal_L38e Pfam Description: Ribosomal L38e protein family
MPGSRGDLPNRILEIDDFLLTGKRTDARSEKIHTTHDVLQLLVRCSQYLYTLCVFHAHNRTSSTNLLPQP

SEQ ID NO: 60207 - DNA, 637 bp, Zea mays
  misc_feature: Ceres CLONE 1518766
  misc_feature: Encodes the peptide sequence at SEQ ID NO. 60208
  misc_feature (353)..(353): n is a, c, t, g, unknown, or other
ctggagctccccgcggtggcggccgctctagaactagtggatcccccgggctgcaggaattcgtctcacccctagaaaaaactaccaccagtaccacaccactccgcgctagctgaggacggtacagcggcacagaggtgcgacgtacgacgacgacgacgcaggcgccacacatggcatcccagctctccgccgccgtgccccggttccacggcctccggggctacgccgcgcccaggtccgcggtggcagcgctgccgtccgtgagggtgggcaggaagtagtcgtcgtcgcagggcatccgctgcgactacatcggctccgccacctacctgatcatggtgacgacgacnacgctgatgctgttcgcggggcggttcgggctggcgccgtcggcgaaccgcatagcgacggcggggctgaagctggatgcgcgcgactccggcctgcagacgggtgaccccccgcgggtccacctcggcgacacgctggcttgcggcgcctcagccaaattcctcgggtcggcttcgtgctcgggctcaagaacacggggccctccgacaaatcatcgggtaaatccctacggcggccgttgtaaaataaactcaagaacctcaattcgccccccggccggaag

SEQ ID NO: 60208 - protein, 99 aa, Zea mays
  misc_feature: Ceres CLONE 1518766
  misc_feature (1)..(74): Pfam Name: PSI_PSAK Pfam Description: Photosystem I psaG / psaK
MVTTTTLMLFAGRFGLAPSANRIATAGLKLDARDSGLQTGDPPRVHLGDTLACGASAKFLGSASCSGSRTRGPPTNHRVNPYGGRCKINSRTSIRPPAG

SEQ ID NO: 60209 - DNA, 633 bp, Zea mays
  misc_feature: Ceres CLONE 1518772
  misc_feature: Encodes the peptide sequence at SEQ ID NO. 60210
ctggagctccccgcggtggcggccgctctagaactagtggatcccccgggctgcaggaattcgtctcacccctagttattccgccgctaggtgccgactgccgaggccctcaccggcggcgaagagcgcccgccagcaatggcagcaaggtgtagtagcctttcctcgccatccttgtcggtccatggacccctccgccgcaataaacccagcaagagactcgctccatgcctgccatcgtcgccaagaccaggagccgctgctctgagagcgcgtgctgcgaaacttcctccaggggttgaagcgcccagggtgcaaccgaagctgagcgagcccttcttggggttcacccagaccgcggagatttggaactccagggcctgcatgatcggcctcatcggcaccttcattgtggagctggtgctgaacaaggggattcttcaaatgattgggggggaggtggggcaagggtctgggaccttcctctttgaaggggggaccaaacagtaacattatcgtttggctggtgtattatgctgggcccaaaaaaatgaaggggtttcacttgctttttgacttggggcgctacattatgcctggttcattcaggcctggcccttggattatccggag

SEQ ID NO: 60210 - protein, 123 aa, Zea mays
  misc_feature: Ceres CLONE 1518772
  misc_feature: SWISSPROT Homolog: EC 4.99.1.1 Ferrochelatase
MAARCSSLSSPSLSVHGPLRRNKPSKRLAPCLPSSPRPGAAALRARAAKLPPGVEAPRVQPKLSEPFLGFTQTAEIWNSRACMIGLIGTFIVELVLNKGILQMIGGEVGQGSGTFLFEGGTKQ

SEQ ID NO: 60211 - DNA, 722 bp, Zea mays
  misc_feature: Ceres CLONE 1518777
aaagctggagctccccgcggtggcggccgctctagaactagtggatcccccgggctgcaggaattcgtctcacccctagaaaaacaaaagaggtggcacgaggaacagggtcttgagctcggacttcgtccccctgtttcacctcagcatagagctgccaaatgaggaggatgcagaagggacggtgcaggtcctacaggcactcatcgagaagggcaaggcacggaggtgggacaagaacatcctacaccggagcaacatcagttgaggttttcacaacagtagtagaggtaggcgttttgattgaaggggaaaataaactaaatttccaccccgatttactctgaatcaggtggattaaataccacaacaaagggctccatggcagaagcagtcaccaacataccccccccccggggggggaattaaaaaaacaaaagtgttcccatagggggattcaccccggtgggaacacgggggttgaggtttttttgtgcgagtgctaacgggggagcctccccaaaaagtttgtggttcaaacgggggttgggaataaggaaggggggggaagagggcccttttggtgtcggggtagtgaacacacagattttctttaggccctcgggcttattgtggtacaaaagccgctcccccagattaagagaggcccgtgtagttacttctttgatttcccccccccacaggggtgggtcttatccggg

SEQ ID NO: 60212 - DNA, 666 bp, Zea mays
  misc_feature: Ceres CLONE 1518900
  misc_feature: Encodes the peptide sequence at SEQ ID NO. 60213
  misc_feature (434)..(434): n is a, c, t, g, unknown, or other
ctggagctccccgcggtggcggccgctctagaactagtggatcccccgggctgcaggaattcgtctcacccctagaaaaacagaagcctggcaaagtcgatggaaagaaaatcgagttcataacagctggtggcaggaccactgcctacgtgccgcaactgcaaaaactggttggaacccagtccagcaaaacgatatccgtggccgagaacggtgatgccaaggatccagggaccgagggagaagatgcagatgttttgaagccaagaaagcgagccgcgacctccagtgctgccaggggacagcgaaacaaagataccgccggctcgagaaaagcaagagtaaatggcgccgatgctgaggaagctgaaccaacaacaagtatcgtcggaagcaagggtaaccccccccccccccccacccaaaaaagaacnctgtccaataaaaccaaaccgggcttaaaaaaaaatccttccagaaaaaatcaaagcccccccaagaaaatcctaaaccaaggtaacccacggggatccgtcccccaggagattttccctttaaaatggggcaaccaggcccaccccccaattttttgcccccccccgggagaaatggtctttttttgggaaccacaaaaaaaaaatatctcgtgccccaaatttccccggg

SEQ ID NO: 60213 - protein, 221 aa, Zea mays
  misc_feature: Ceres CLONE 1518900
GAPRGGGRSRTSGSPGLQEFVSPLEKQKPGKVDGKKIEFITAGGRTTAYVPQLQKLVGTQSSKTISVAENGDAKDPGTEGEDADVLKPRKRAATSSAARGQRNKDTAGSRKARVNGADAEEAEPTTSIVGSKGNPPPPPTQKRTLSNKTKPGLKKNPSRKNQSPPKKILNQGNPRGSVPQEIFPLKWGNQAHPPIFCPPPGEMVFFWEPQKKNISCPKFPR

SEQ ID NO: 60214 - DNA, 836 bp, Zea mays
  misc_feature: Ceres CLONE 1518901
  misc_feature: Encodes the peptide sequence at SEQ ID NO. 60215
  misc_feature (323)..(323): n is a, c, t, g, unknown, or other
  misc_feature (325)..(325): n is a, c, t, g, unknown, or other
  misc_feature (334)..(334): n is a, c, t, g, unknown, or other
atctctggagctccccgcggtggcggccgctctagaactagtggatcccccgggctgcaggaattcgtctcacccctagaaaaaacccaacctcccttttcggagatctcgccgcctccgccgtcgacttccgtcgcccccctatcccgcgtccgggcttacccgatggcacggctgcactggcttgaggctgtcctgccgctggggatcatcggcggcatgctctgcatcatgggcaacgcccagtatttcttccacaatgccgcgcacggcaggccgatacacatcgggaaggatatgtgggacgtcgtcatggaacaccncnaacaagaanacctccaaacaaccctcccgcaactaagcccaccgcccccccgggggggggtgcctggataattaaccaaacaccccccccggggccccacaattttctggcggttttttgtttgtcgggttcccctcgcggatgccacgaatcgcgcttccgggggaggcggttccaaggtagtacccgcggctccgggggccacagggacccgggggggcgcttgagttttccccgcctgagaatctcccagtatgtgccgcccccacctcctcggggacacctgtgggggccgagagtacctgttttcttacctcctccccgtacggagggccgtagaagccctctttctgggtcatggccttttaaggggtgccccccttgcgggggttggcaccttgggcttcctcggcgcccccctcgtggtgatgtactcccgctccttgttgccaagtgtgtagagtgcgcgcccctggggcggggtccccccccctgggcggctcccttgggg

SEQ ID NO: 60215 - protein, 76 aa, Zea mays
  misc_feature: Ceres CLONE 1518901
  misc_feature (53)..(53): Xaa is any aa, unknown, or other
  misc_feature (54)..(54): Xaa is any aa, unknown, or other
  misc_feature (57)..(57): Xaa is any aa, unknown, or other
MARLHWLEAVLPLGIIGGMLCIMGNAQYFFHNAAHGRPIHIGKDMWDVVMEHXXQEXLQTTLPQLSPPPPRGGVPG

SEQ ID NO: 60216 - DNA, 694 bp, Zea mays
  misc_feature: Ceres CLONE 1518905
  misc_feature: Encodes the peptide sequence at SEQ ID NO. 60217
ggagctccccgcggtggcggccgctctagaactagtggatcccccgggctgcaggaattcgtctcacccctagaaaaaaccagcaacccccaacagcgccactgtccagtgcgcgcgtcaagcttgcttagctagccgccatggcctccctcgccgccgtctccgtgaagcccgtggccatcaagggtctcgccggcagctccatctccggaaggaagctcgccgtcgccaggccgtcggcccgctccatccgcaggccccgcgcagccgccgtggtggccaagtacggcgacaagagcgtctactttgacctcgacgacatcgggaacaccaccggacagtgggacctctacggctctgacgcgccctcgccctaaacccgctaaaaagcagttcttcaacaccctcgcgggttcggtcacaagaaaagtctgctgctcaagtcctgctgctgggcgggcggtccattttggccaaggtaacgcgtcggggtcccggaactcctggcaataagaagggacccaggaacccccccagccgggccccccggaaaaacaaaacccaacttccccatttgcaggggcaaaaactgggtttgacaggaaggcccggccaaccgtgggaaacggaaggacaatcctatttttgtggtgtttccctgtcacaattgggaaatttccccctcccaaaaaaa

SEQ ID NO: 60217 - protein, 78 aa, Zea mays
  misc_feature: Ceres CLONE 1518905
  misc_feature (5)..(79): Pfam Name: PSI_PsaH Pfam Description: Photosystem I reaction centre subunit VI
MASLAAVSVKPVAIKGLAGSSISGRKLAVARPSARSIRRPRAAAVVAKYGDKSVYFDLDDIGNTTGQWDLYGSDAPSP

SEQ ID NO: 60218 - DNA, 785 bp, Zea mays
  misc_feature: Ceres CLONE 1518907
  misc_feature: Encodes the peptide sequence at SEQ ID NO. 60219
  misc_feature (362)..(362): n is a, c, t, g, unknown, or other
  misc_feature (442)..(442): n is a, c, t, g, unknown, or other
aaagctggagctccccgcggtggcggccgctctagaactagtggatcccccgggctgcaggaattcgtctcacccctataaaaagggcaactcgaacaagccgcgtgcgttatcctttgagcagtttgggcgctgagcaagtccagtgagagagggagagcggccagaggatggctgggatggcatcgctgcagggcgccatggcgtcgctctccatctccgcgctaggcgcggcgacggcgagcagcagcagcttctggggcaaccggctcgccacctactccgcgccgcagcctggggtaaggtttatggtcaagatatgcccaattgaaatgagacttaagagatgggagcgaaagaantgtaacccaaacagtcttcctgtgctgcacaggatgcatggttagcaccccccaacccgcccccgtttattgcaggcccngagaaaggaagggttggagaagtccccccccttttctcagcccaacagcccgggtgattcgtgaaggacctggaccttggagtccgaagcccctagaaatgccccaaaacaatgaaccccgggtgaaattcctcttggatttggagggcccccatttcataggctcaaagggtgagtgcttctccctctcaaggaaaaaaagggtgggtaaaccggggttgggccctccaatttcctcggtaaggacgggaccccaagggtcgcaaaaccctcggtcaaagaccggtgaaaataactcccccgcgtggcgcacaaaacgcgcgcaaacaactttttcaaggag

SEQ ID NO: 60219 - protein, 78 aa, Zea mays
  misc_feature: Ceres CLONE 1518907
  misc_feature (64)..(64): Xaa is any aa, unknown, or other
MAGMASLQGAMASLSISALGAATASSSSFWGNRLATYSAPQPGVRFMVKICPIEMRLKRWERKXCNPNSLPVLHRMHG

SEQ ID NO: 60220 - DNA, 732 bp, Zea mays
  misc_feature: Ceres CLONE 1518908
  misc_feature: Encodes the peptide sequence at SEQ ID NO. 60221
  misc_feature (199)..(199): n is a, c, t, g, unknown, or other
  misc_feature (290)..(290): n is a, c, t, g, unknown, or other
  misc_feature (293)..(293): n is a, c, t, g, unknown, or other
  misc_feature (377)..(377): n is a, c, t, g, unknown, or other
  misc_feature (378)..(378): n is a, c, t, g, unknown, or other
  misc_feature (381)..(381): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (682)..(682): n is a, c, t, g, unknown, or other
  misc_feature (696)..(696): n is a, c, t, g, unknown, or other
  misc_feature (702)..(702): n is a, c, t, g, unknown, or other
  misc_feature (707)..(707): n is a, c, t, g, unknown, or other
  misc_feature (725)..(725): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (732)..(732): n is a, c, t, g, unknown, or other
cgggcgctctagaactagtggattccccgcggctggcggaattcctctcaccccccagaaaaattccttctcgccgataagcagcagctcatcacctgaaggagagcagcccggaggagggggagcaagcagcagccgtccgtggaagaagatgtcgtacctgctgccgcatctgcactcggggtgggcggtggaccangccatcctcgccgaggaggagcgcctcgtcatcatccgcttcggccatgactgggacgagacctgcatgcacatggatgaggtgctggcanccntagctgagaccttattgaactttgcgggcatctaccttgttgaaattttttaccccccccatttggagaacgaaaggggacctnnacnacccctcccccnnnatgttcttcttcccgaaaaagcacatcttggttggtctcgggggggggaaacaacaccagatctcctgggccctgaaggaaaaaccaaaattcctcccccttgtggagacccctatccggggccccccggaaaggcctgtttctgttgtttgttcccagcgaatactccccccattccgtttctaaggaggggggccttccccctttggagtgcattgggggaggtttaaccggacccgttctcccccaggggggtcccctacgggtgtttggcgaacccctggganttccacgtttgggngggganaaaancctacccccactgtgggnannnaan

SEQ ID NO: 60221 - protein, 157 aa, Zea mays
  misc_feature: Ceres CLONE 1518908
  misc_feature (4)..(133): Pfam Name: DIM1 Pfam Description: Mitosis protein DIM1
  misc_feature (16)..(16): Xaa is any aa, unknown, or other
  misc_feature (47)..(47): Xaa is any aa, unknown, or other
  misc_feature (48)..(48): Xaa is any aa, unknown, or other
  misc_feature (76)..(76): Xaa is any aa, unknown, or other
  misc_feature (77)..(77): Xaa is any aa, unknown, or other
  misc_feature (81)..(81): Xaa is any aa, unknown, or other
  misc_feature (82)..(82): Xaa is any aa, unknown, or other
MSYLLPHLHSGWAVDXAILAEEERLVIIRFGHDWDETCMHMDEVLAXXAETLLNFAGIYLVEIFYPPHLENERGPXXPLPXXVLLPEKAHLGWSRGGETTPDLLGPEGKTKIPPPCGDPYPGPPGKACFCCLFPANTPPIPFLRRGAFPLWSALGEV

SEQ ID NO: 60222 - DNA, 720 bp, Zea mays
  misc_feature: Ceres CLONE 1518910
  misc_feature: Encodes the peptide sequence at SEQ ID NO. 60223
  misc_feature (681)..(681): n is a, c, t, g, unknown, or other
ggagctccccgcggtggcggccgctctagaactagtggatcccccgggctgcaggaattcgtctcacccctagaaaaaactccccatccccacccacccacgccgacgagcaaaccctagcgagcgagagagcccggagccgagagaccagccagccatggcgctgcgtgccctgtacaacgagatccggagcatgaaggtccgcgacgtgccggcttacctgaagccgcgcttgacctgggacaacgtcaagaagagcgccgaccaggccgtcgaccgctacatcgagaagtacatcgacacgagctcgccggaccctctctaccacgtctgcatcggagggatgatcttctcctacttcgtcaatctgccctgggagcgcgcccacctcgcccacctcgaggagatggagaggaccggtgggaagcactagatccgctgccccgtccctcgccggcagcgcgggaggacgggtgactttcatggggtccattcaggctgatggcttctgttttcttctgctgttgagctactggagtcatggtactttggtcgttggttttgtaccagacagcaagaactgtccagcttattgtcttggtcctcgcgtcttgtcataagtaactcaaacaaaagagtgcatgcattgtgattaaaacgttttcaagcattgagacgaantatccctttttttttggaatttttaaaaaaaaagaaaaa

SEQ ID NO: 60223 - protein, 91 aa, Zea mays; identical to SEQ ID NO: 44946
  misc_feature: Ceres CLONE 1518910

SEQ ID NO: 60224 - DNA, 718 bp, Zea mays
  misc_feature: Ceres CLONE 1518911
  misc_feature: Encodes the peptide sequence at SEQ ID NO. 60225
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
ctccccgcggtggcggccgctctagaactagtggatcccccgggctgcaggaattcgtctcacccctagaaaaaaaattgttgtacaatgccattgtacacaattcctttcttgttttccacatcgtaattttcttctatttctttatccatatagaactttcttgtcatttcttgtttttggtctcatataatcaaggaaggggtataaactaaaatccagtcaaatttcacctataaaagaaagactactattccttagtaatgtataggaagaaggggtcatcttttttagggataggaaaatctcgtctatacggttcattctatatatatataatatttattttgtttttttagttaggaatttcgcctaaacaaaagaaatacaaaggatcttgggcaagagtatctgatcatatatgtattccaatacggaaggaggaattttcatgcgggatataaaaacatatctctctgtagcacccgtgctaagtactctatggtttggggctttagcaggtttattgatagaaaatcatcgtttattcccagatgcttggtcattcccttttttttaatnnnctagtatcctatgcgagagaagaattcttcgtgaatgacgaaaatttccctttttgaattcttttttagtatatgacgcaaaaaaaaaaaaaacgagacgctcgaggtaccaattcgccctatagtgagtcgaa

SEQ ID NO: 60225 - protein, 52 aa, Zea mays
  misc_feature: Ceres CLONE 1518911
  misc_feature (11)..(47): Pfam Name: PSI_PsaJ Pfam Description: Photosystem I reaction centre subunit IX / PsaJ
MYSNTEGGIFMRDIKTYLSVAPVLSTLWFGALAGLLIENHRLFPDAWSFPFF

SEQ ID NO: 60226 - DNA, 748 bp, Zea mays
  misc_feature: Ceres CLONE 1518912
  misc_feature (468)..(468): n is a, c, t, g, unknown, or other
  misc_feature (469)..(469): n is a, c, t, g, unknown, or other
  misc_feature (471)..(471): n is a, c, t, g, unknown, or other
  misc_feature (485)..(485): n is a, c, t, g, unknown, or other
  misc_feature (488)..(488): n is a, c, t, g, unknown, or other
  misc_feature (585)..(585): n is a, c, t, g, unknown, or other
agctccccgcggtggcggccgctctagaactagtggatcccccgggctgcaggaattcgtctcacccctagaaaaactcccactcttgatattctgggttgccttggctgttctgttggcttatgcatgatgagtgggatcaagatgtttagcaagcttcaagttgatgtcggattccatgaggtgcactgcaacgggatatttattcattcaattccatagcggcacaggagagatgaggcgaagccaagaaaaagtggatgtgtgtgtgtgtgtgtttgtaagttaaagggccaaaatgtatttcttgtctggtagtatatagcagctctacaacactttggtgaacttagttactgcaaattacgcaattacagttgcaccttttgtattttatagcacacccagacttctattggattctatgactgcccctcttgtagtacacgcaaggcttcactggtaaannanacttgcccactggnccntccaactattgtcttgggaccctgtgtaatccttgctatatggatctgaccgtggtcatgtatttcacgaaccctggattatcctttttatgtgctnaaaaagcgaaggggttggcggggccccttttcccccctaagtggggcctaattacggcgcgccattagggcccttttttttgaccgccggtggaggggagaaaccgcggggtttaaccaatattatcccccttggaaaaccccccccttttccgaggggggga

SEQ ID NO: 60227 - DNA, 705 bp, Zea mays
  misc_feature: Ceres CLONE 1518914
  misc_feature: Encodes the peptide sequence at SEQ ID NO. 60228
  misc_feature (223)..(223): n is a, c, t, g, unknown, or other
  misc_feature (295)..(295): n is a, c, t, g, unknown, or other
  misc_feature (376)..(376): n is a, c, t, g, unknown, or other
  misc_feature (377)..(377): n is a, c, t, g, unknown, or other
  misc_feature (378)..(378): n is a, c, t, g, unknown, or other
  misc_feature (379)..(379): n is a, c, t, g, unknown, or other
  misc_feature (380)..(380): n is a, c, t, g, unknown, or other
  misc_feature (381)..(381): n is a, c, t, g, unknown, or other
  misc_feature (382)..(382): n is a, c, t, g, unknown, or other
  misc_feature (384)..(384): n is a, c, t, g, unknown, or other
  misc_feature (390)..(390): n is a, c, t, g, unknown, or other
tccccgcggtggcggccgctctagaactagtggatttcttgggctgcaggaattcgtctcagccgtagagaaaagcagcagcagcacagtcatccacactaacgaacgaactcttgctccgatcacgagctagctgaggtcgacgatggcggctgtgctgaacagcaggaagacggcgcaggcggtggtggccgtgctggtggcggcggcccttctggcttcntccacttcggcggcgatcacctgcgggcaggtggggtcgtctctggcgccgtgcatcccggacgcgacgggnagggccaccgcgctccccgcgtcgtgctgcaccggcctcaagagcttttttttccccccacccacgggggcagaaggggannnnnnntncccctnccttcacaaccttctctacatctacaaaagccctcccccttggccccggcgccgccattcctcggaaagtgcggccctcccctcctattccccctttagccagttggccgactgcgtgccggtcgtttttgcgttcctcccgcccctccgctgggggctgggtggcgcgcgcggcccggttccgccctcctccccgcggcttttacgctcctcgtccgcactcggccccggccctccgccctttgcccgctctcaggccgcgctcgtgctccccgcttctgcggtgcccgggcggcggggccccttccccgctcg

SEQ ID NO: 60228 - protein, 186 aa, Zea mays
  misc_feature: Ceres CLONE 1518914
  misc_feature (77)..(77): Xaa is any aa, unknown, or other
  misc_feature (78)..(78): Xaa is any aa, unknown, or other
  misc_feature (79)..(79): Xaa is any aa, unknown, or other
  misc_feature (80)..(80): Xaa is any aa, unknown, or other
  misc_feature (82)..(82): Xaa is any aa, unknown, or other
MAAVLNSRKTAQAVVAVLVAAALLASSTSAAITCGQVGSSLAPCIPDATGRATALPASCCTGLKSFFFPPPTGAEGXXXXPXLHNLLYIYKSPPPWPRRRHSSESAALPSYSPFSQLADCVPVVFAFLPPLRWGLGGARGPVPPSSPRLLRSSSALGPGPPPFARSQAALVLPASAVPGRRGPFPA

SEQ ID NO: 60229 - DNA, 822 bp, Zea mays
  misc_feature: Ceres CLONE 1518915
  misc_feature: Encodes the peptide sequence at SEQ ID NO. 60230
  misc_feature (258)..(258): n is a, c, t, g, unknown, or other
  misc_feature (479)..(479): n is a, c, t, g, unknown, or other
ggagctccccgcggtggcggccgctctagaactagtggatcccccgggctgcaggaattcgtctcacccctagaaaaaccaaaccctagcccagagcagccgcatcgaactctacctgcctttctctcgtccctggcggcggcggcaggatggcggcttctactgcgaggacggtgaaggatgtgaacccccacgagtttgtcaaggcctactccgcccatctcaaacgctccggcaagatggagcttcctgagtggnttgacattgtgaagactgcgaggttcaaggaactccctccttatgaccctgactggtactacatcagggctgcttctggtggaaggaagatcttctttgagaaaagggcattggtgttgggtggtttccgaaagatttatgggggggcgggcggaagcattgggttcacgccccccctccctttctgcaagaagaaggggggggccattttcccgcaaacntccctccccccaaccggcagggaaaagggggcatcctttgagtggttcaatccccaaggggtgggaaggggggcattccccctccccgagggaaagggcgtggaatctggattccgggtgggactggaaaagggcttgcttgtttgaaagccttggagacaaccccccataatttggggtttccaataatgtcacccgttttcgttttgttggccccgggcgcaaccttttaatctgcagcgtgtgggattaagaattttttggggaaagaaagcaacccagagggctgtcggacctataggtgaaaaaaagagatgttcccccgagagcacccaaatcgccc

SEQ ID NO: 60230 - protein, 158 aa, Zea mays
  misc_feature: Ceres CLONE 1518915
  misc_feature (7)..(121): Pfam Name: Ribosomal_S19e Pfam Description: Ribosomal protein S19e
  misc_feature (37)..(37): Xaa is any aa, unknown, or other
MAASTARTVKDVNPHEFVKAYSAHLKRSGKMELPEWXDIVKTARFKELPPYDPDWYYIRAASGGRKIFFEKRALVLGGFRKIYGGAGGSIGFTPPLPFCKKKGGAIFPQTSLPPTGREKGASFEWFNPQGVGRGAFPLPEGKGVESGFRVGLEKGLLV

SEQ ID NO: 60231 - DNA, 893 bp, Zea mays
  misc_feature: Ceres CLONE 1518916-R
  misc_feature (561)..(561): n is a, c, t, g, unknown, or other
  misc_feature (576)..(576): n is a, c, t, g, unknown, or other
  misc_feature (857)..(857): n is a, c, t, g, unknown, or other
tcgagcgtctcgtttttttttttttttttctccaacattagattttttttctttgtgttttttgtacatcctccatggttgcattatcgaatgaattaacagccaaactccctcgttggggagagagaaaaaaaacaagaattcgtttcgacaatcctccgtctccgatgtccacaggaaccccaatcgggcatgacccaaaagaagccaggaaccctgccaagcaaatcgccaccgggcgatccgggtgggtagcaaccgagatccaaatcacagcgcgatgttgaggcgctcggagtccgtgccgccgagcccgaaccaggaggccgggttcgacttctccgcctcctcggatggggacgggcgggcgttgggggcgcgctccacgaggaggtccttgcgcttggacaggaaacggtggagcgacgccttccgggcgatatgcaggtcctctcaacggagccatgagacagggccaggggatacggggcctctgggtcagctgtgaggggaaataaatccgctgcctactgcaccggggaggcctggaacacgaggcanctggcggcatagaanatggctagcggcgcccccctgttatgctgaccgctgacatctactgccccctcgcggcggacggctccttgctagagccgacgtcaccgccgtgcatgacgatcatcgtctcgcctagggagcgctaagtaggggccccgctgacgccagtcgagctcggtcctgagtgatgggtcagcaccccgcagtcgcgcgaactccagctgtagcctaagtgtcaacccctgtgccttctatcgatgatcccactaagctgggttctctcatgcccgcctcggtcnggaacgcctgcccgggtgctcatgatctgcagggcg

SEQ ID NO: 60232 - DNA, 705 bp, Zea mays
  misc_feature: Ceres CLONE 1518918
  misc_feature: Encodes the peptide sequence at SEQ ID NO. 60233
  misc_feature (410)..(410): n is a, c, t, g, unknown, or other
aaagctggagctccccgcggtggcggccgctctagaactagtggatcccccgggctgcaggaattcgtctcacccctagaaaaaaccaccctaaacccaagcagggaagcgcaagcgaagacacatttggctcactcacttacacgctcactcatagattgtcctgtccgtccatcatctctagctagcagctaccagtgagagcggcaagcgacaccacaaccagaccaccaccaacgccgagctgtgagataggatgggcaagctgtggacgatcctcactcacctccactcccttgcagggccaacggtgatgctgctgtaccctctgtacgcgtccgtgcgggcgatggagagcccgtccaagctggacgacgagcagtggctcgcctactggatcctctactccntcgtcacgctcatggagatgctcctcgagtccctcatatactggatccccatctgggacgagctcaagctgctgttcatcgcggggctcgggctccccaacttcagggggcgccgccttcatctacaaacaatttcggggccgagcagcttccgaaaccaggcctccccgcccgcgggttccctaaaggtcgtctttccccgtcttccaaaggacagggaaaaccccagaaaaaagttccttgccttttttacccccccaaaaaggacttgaacctttcgaaaagggggtgcgag

SEQ ID NO: 60233 - protein, 141 aa, Zea mays
  misc_feature: Ceres CLONE 1518918
  misc_feature (4)..(101): Pfam Name: TB2_DP1_HVA22 Pfam Description: TB2/DP1, HVA22 family
  misc_feature (52)..(52): Xaa is any aa, unknown, or other
MGKLWTILTHLHSLAGPTVMLLYPLYASVRAMESPSKLDDEQWLAYWILYSXVTLMEMLLESLIYWIPIWDELKLLFIAGLGLPNFRGRRLHLQTISGPSSFRNQASPPAGSLKVVFPRLPKDRENPRKKFLAFFTPPKRT

SEQ ID NO: 60234 - DNA, 728 bp, Zea mays
  misc_feature: Ceres CLONE 1518919
  misc_feature: Translation starting site: 325
  misc_feature (407)..(407): n is a, c, t, g, unknown, or other
atcgctggagctccccgcggtggcggccgctctagaactagtggatccccccgggctgcaggaattcgtctcacccctagaaaaaaggggacaggcacagccgcacagccgccgcccctccatccacctctccacaccatctgacgctgctcccaccgaggtctccaaggctcactcctcaccagcttctgctctctccctcctcatctctgctctgctctggaccgttaactctccagctccccctcgctccgttcccttccgcccaaatcactgggaccaccaccgccttcttcaagatcggcgggcgggcaccggccggcgatgacatccaccgtcaccacaaccgttgggtgcggggggctccccgtccgcccgttgtcgacagcgaccagaggacgcccacncaaatgcgccgtccgagcccaggccgcgggagcggatgcctccaatgataagtccggtggaggtcatgcgcaagttctccaaacattacgcccgccgcttcaaaaacttttttttgcgccgacaaaacaagccctgccgtcgccataaggggatacccttggaagccccctatgccctggaattagaaagacaagctggggaaggaaccaaagagttttgaatttcccagcctcccctggggggaaagaaagaatgccccctttgtgctttttcttcccccaaaaaagactttggcgggaaagaaaagtttaacccctcag

SEQ ID NO: 60235 - DNA, 721 bp, Zea mays
  misc_feature: Ceres CLONE 1518922
  misc_feature: Encodes the peptide sequence at SEQ ID NO. 60236
  misc_feature (541)..(541): n is a, c, t, g, unknown, or other
ctccccgcggtggcggccgctctagaactagtggatcccccgggctgcaggaattcgtctcacccctagaaaacccacccatccaccgagctgccctgctacacggtcccctgccaagatccatcttcccggttacgccgcctgatcgaagtgaacaagcaaggaagagccatggcgagcgagcacgcggcggggggcgaggctaagcatgaccagaagcagagcctgatggacaaggcgaaggggttcgttgtggagaagatcgcgcacatccccaagcccgaggcgacgctggacggcgtgacgttcaagggcctgagccgggagtgcatcacgctgcacagcagcgtgaacgtgtccaacccctacgaccaccgcctccccatctgcgaggtgacctacacgctccggtgcgccggcaaggaggtggcgtccggcaccatgccggaccccggctggatcgccgccagcggctccaccgcgctggagatccccgccaaggtgccctacgacttcctcgtctccctcgtcagggacgtcnggcgggactgggacatcgactacgagctccaggtcggggctcacgtcgacctccccatcgtcgggaactttcacatcccgctctccacctccggcgagttcaagctccccaccctcaaggactttgtctgatctagtatagctcgctttgcctggtgttctgtgcgggcgcgcaccagcg

SEQ ID NO: 60236 - protein, 166 aa, Zea mays
  misc_feature: Ceres CLONE 1518922
  misc_feature (17)..(166): Pfam Name: LEA_2 Pfam Description: Late embryogenesis abundant protein
  misc_feature (124)..(124): Xaa is any aa, unknown, or other
MASEHAAGGEAKHDQKQSLMDKAKGFVVEKIAHIPKPEATLDGVTFKGLSRECITLHSSVNVSNPYDHRLPICEVTYTLRCAGKEVASGTMPDPGWIAASGSTALEIPAKVPYDFLVSLVRDVXRDWDIDYELQVGAHVDLPIVGNFHIPLSTSGEFKLPTLKDFV

SEQ ID NO: 60237 - DNA, 683 bp, Zea mays
  misc_feature: Ceres CLONE 1518925
  misc_feature: Encodes the peptide sequence at SEQ ID NO. 60238
  misc_feature (444)..(444): n is a, c, t, g, unknown, or other
  misc_feature (644)..(644): n is a, c, t, g, unknown, or other
tggagctccccgcggtggcggccgctctagaactagtggatcccccgggctgcaggaattcgtctcacccctagaaaaaaacaatgctacttgagctcccacaactctactactacgtgccccggcggtttgttgaggactttggtgaccttgtgggtcttgtcagcaatttggatttgcatcacaagattgcggtcccaatgttcttcttggcaatggactcgactcaaaattttgactctgatgctctggctggaaaagtgttcaggccacaattgccagctaaggcgacgttctcatctatttatacggctcaagcacctgctgtttcccctgtgaaagctatgaatgagattgatttcataagggtgatgcgcctaatgtccataggagacctacttctgatggacttggtttaaaggtgtaatgttcacctgaagggcnaccttatccttgtggccttgaggaccgagtagaaaaggcatagttttgagtaatcaggtgtttttgaaattcaataatcttggccatacggaaactgattatcccgcggctggtgaaattgggggaccattactgaaaggttactttggaatcggtcggaccagctttcctgcataaagaaaggacggctttgtcaaaanaatccaggaaaaaaagctctccctggacccgatattttt

SEQ ID NO: 60238 - protein, 111 aa, Zea mays
  misc_feature: Ceres CLONE 1518925
MLLELPQLYYYVPRRFVEDFGDLVGLVSNLDLHHKIAVPMFFLAMDSTQNFDSDALAGKVFRPQLPAKATFSSIYTAQAPAVSPVKAMNEIDFIRVMRLMSIGDLLLMDLV

SEQ ID NO: 60239 - DNA, 779 bp, Zea mays
  misc_feature: Ceres CLONE 1518927
  misc_feature: Encodes the peptide sequence at SEQ ID NO. 60240
aaatgctggagctcacgcggtggcggcgctctagactagtggagtcctgggctgcaggattcgtctcacccctagaaaaaatcagtttggtgctgctgggatgggggcatatggtggccttggaatgggtggaggctccatgtaccgcatgcaacagggagcagggggggctgcctgcaggtgcatattgtggaggagcaaactccccccctccaggctatggttttcccagggtcacaaccctccgggtggaagtgtttcccgatgggtcgcggccgctgggtttcccccggggggggggacacctcccgcccggtttcttgcttaggcaggctcaccgctagtgggggaaccacattgtttttggaattttccgccggggggggggggggcgggggtcccggggggtaaaaacggcccccccccccctaaccatacggaaataaatccccttgcgcccacattaggcgcggcgcgtaggagggcaggtgggcaaagcgagccggcgccaccgcgttctgcggtgttaggcgccatgtaccccccgtccgccctggcctattacccccagaggtaagccccgacgagtgcacgtggagcagcactattacaactccacgcctgctcccccctccccacccgatgtcaaaacccgcccgggcgggacgcagaagaagtgggcgtcccccgccctctagttagcccgccgccccccgtagcccccgtgcgcgggttataaacggcggcccgagcaggaggtttttcccgcgccccgcgtg

SEQ ID NO: 60240 - protein, 113 aa, Zea mays
  misc_feature: Ceres CLONE 1518927
MLELTRWRRSRLVESWAAGFVSPLEKISLVLLGWGHMVALEWVEAPCTACNREQGGLPAGAYCGGANSPPPGYGFPRVTTLRVEVFPDGSRPLGFPRGGGHLPPGFLLRQAHR

SEQ ID NO: 60241 - DNA, 647 bp, Zea mays
  misc_feature: Ceres CLONE 1518929
  misc_feature (275)..(275): n is a, c, t, g, unknown, or other
tccccgcggtggcggccgctctagaactagtggatcccccgggctgcaggaattcgtctcacccctagaaaaatcgacggccggcgcgttggttgccctgtccctttttgccgtctcccgtttacatgaacagggaagcttatcgctgcattggtcgccgtgtttggcgtcctcctcacagatacgagcaggagctccacatggtggggtcacctctagcaacacggagagaggaataccgcccgataggccgacgatcacctccaccaagtgcngaatcggtatcttcgaccgtaaatacgtgaaactagtgcaagcgactgcattgtgctcctcatcgaccgcctagatcactcctacagcactgtaacagagtctggagaccacatcgcagaacatggcaccggagctcctccaaggaacgaaggtccgccaggtgctgcatgctgatggcggtcgcagtcgcaccaattgctactgctactgatctccgggctcttgactgctgagcaacacatatctgcttgctgtggtggacgattcacccagtatatgctgagtctgatactcactggggtcgtgcaagcctggctcaagctgttgcctgcacttggacttggatcttcaatgcggtatgatggttagcc

SEQ ID NO: 60242 - DNA, 672 bp, Zea mays
  misc_feature: Ceres CLONE 1518930
  misc_feature: Encodes the peptide sequence at SEQ ID NO. 60243
ctggagctccccgcggtggcggccgctctagaactagtggatcccccgggctgcaggaattcgtctcacccctagaaaaaatccactgcggcacgcgtcccgcctctggtttgcttgcctcccagatcttgccaactaattggaggcagccgagctgatctcccatcccgcaacgcgccgtctcgacggcggatcgttttcttctgcttctactgcgtgatctttgggcaagaagataagacacgtccaagcgtcgccacagtcaaggtgagaagaaaagctccccctctcctgcagtcctgttactccagttggttcgccgcagtgcagtgtttgtctttgctcggtaacgtgcgtgctccattcatccatggcgcagcaaacccattcggtatcggtagtgaccgaattttgtaactgcgtcatgcagggcggcttggttgcagtcaagatggggaaggacagagaatctgccaagctgaaagaggagaaggggtccaaggatgagatccatatgaaggtcaagagcaagggcgagccgtccggcgaggaagacggcaaggaggaggtcgaggtagagattgaggccaagtttgttgagaaggaagaggtcacatgctcgggtgacggtgcgggaggaaagggtacccagaagaaggatactaaaaaaaa

SEQ ID NO: 60243 - protein, 100 aa, Zea mays
  misc_feature: Ceres CLONE 1518930
MAQQTHSVSVVTEFCNCVMQGGLVAVKMGKDRESAKLKEEKGSKDEIHMKVKSKGEPSGEEDGKEEVEVEIEAKFVEKEEVTCSGDGAGGKGTQKKDTKK

SEQ ID NO: 60244 - DNA, 709 bp, Zea mays
  misc_feature: Ceres CLONE 1518934
  misc_feature: Encodes the peptide sequence at SEQ ID NO. 60245
  misc_feature (379)..(379): n is a, c, t, g, unknown, or other
  misc_feature (380)..(380): n is a, c, t, g, unknown, or other
  misc_feature (454)..(454): n is a, c, t, g, unknown, or other
  misc_feature (462)..(462): n is a, c, t, g, unknown, or other
  misc_feature (467)..(467): n is a, c, t, g, unknown, or other
  misc_feature (468)..(468): n is a, c, t, g, unknown, or other
  misc_feature (469)..(469): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (474)..(474): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (486)..(486): n is a, c, t, g, unknown, or other
  misc_feature (487)..(487): n is a, c, t, g, unknown, or other
  misc_feature (490)..(490): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (510)..(510): n is a, c, t, g, unknown, or other
  misc_feature (531)..(531): n is a, c, t, g, unknown, or other
  misc_feature (532)..(532): n is a, c, t, g, unknown, or other
  misc_feature (534)..(534): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (569)..(569): n is a, c, t, g, unknown, or other
gcggtggcggccgctctagaactagtggatcccccgggctgcaggaattcgtctcacccctagaaaaaaaggcggtgctgggccagctcggcggcgacgcggtggcgccgggcctgcacctgcagcacgagatggccgccggcgctgtcgtcgcttcgtccgcttggatgaatcacttctaggggacattagttcagcgaacctaagtatgtgattggttgcgtatattatggggaatacatacatacatatatacataattgtgtggtgaaacatttgtgtgtgaggcaaggagtagagcatctgagcatgcgtcattttttctgttgctgccgatcgatttggacgaaaaggccatgaggcaggggagtaactctgnntatatatggctgctcaagtgtgtgtacattcagatgcaaaggcatgtcatgagcgatgatcaggaagatttccngatgggtnaaaannnnnnnnnnnnnnnnnnannaantnnnnnannnnnaaataatnaataaaaaaaaaaaaaatttnnanannnnnnnnnnnnnnnnnnnnnnnannnccttttnttgaaatagaatttattggggggcgcccggggggcccctttccccctatggggggggaaaaagcgggggccaacgcgcggttttttcaaagggggggggggggaaaaccccgggtgttaccaaataagagcccttgggac

SEQ ID NO: 60245 - protein, 59 aa, Zea mays
  misc_feature: Ceres CLONE 1518934
GGGRSRTSGSPGLQEFVSPLEKKAVLGQLGGDAVAPGLHLQHEMAAGAVVASSAWMNHF

SEQ ID NO: 60246 - DNA, 893 bp, Zea mays
  misc_feature: Ceres CLONE 1518935
  misc_feature: Encodes the peptide sequence at SEQ ID NO. 60247
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (893)..(893): n is a, c, t, g, unknown, or other
gggggggggaattttttctcttatttatcccannnnnnnnnnnnnnnnnnnnaaaaactggagctccccgcggtggcggccgctctagaactagtggatcccccgggctgcaggaattcgtctcacccctagaaaaaatctgaacaaagagcaggaagctgaccagaccaatttccgtgacctatctaccaatactgatctcgaagttcacgaaaaaatgtctctcctggaatggtttgccaatgaataccagaagtttggttgcttcctggagtttgtggacaacaggtctccggagggatcccagttctggcgaggattttctcgccgtgtttgtgatgctgccctaccagctgggaattatggtttattggctcagctttccgccccccaccaatggcgattgatggtttgtggctagggcggggggcccaccccccccccccaccttatttttaaaggggacgggacccccacaccgcccaaagagagagaaaaagcagggggctccggtagtccctaacggcccgcccaatataagtccgccggctgtttgtccggcgtcgtcgccggggggtaagagagattcgccttgtaacggagcgatgtggggccgcgaatccaccgcgccggccgccccctcgttaagagcaagtgcttgtagcggagggttggtcgccccggggggccagatgcgcctatttccctcattcctggcgcgcgccccgccgagtgatggtctccgttccttagcgacgatatgttcgcgcgcgcccccgtattttggctggaagtatattctcaccccgccgcacgagagtgcggagggcagatgctttgtacgacaccggcatgctcccgcaacttatccgatatgtattaccacgatagtn

SEQ ID NO: 60247 - protein, 67 aa, Zea mays
  misc_feature: Ceres CLONE 1518935
MSLLEWFANEYQKFGCFLEFVDNRSPEGSQFWRGFSRRVCDAALPAGNYGLLAQLSAPHQWRLMVCG

SEQ ID NO: 60248 - DNA, 711 bp, Zea mays
  misc_feature: Ceres CLONE 1518936
  misc_feature: Encodes the peptide sequence at SEQ ID NO. 60249
ctccccgcggtggcggccgctctagaactagtggaacccccgggctgcaggaattcgtctcacccctagaaaaaagcttccactacaacagcatcatccgatcgccgagcgtgcgtgctctagcttctagcaatagcagcgaggagacggtccaggatggatcaaaacaacagcaacaggcagcagccagcaggcgccgccgccaccacccgcgggctacccgacggcaggcgccgaacagcagggaggcaccggcaggaagcagggaccccgggggaaaacaaacctccgcgcggggagaagggcttcatcgaaggatgcatcgcggcgctctgctgctgctggatctgcgagatgtgctgcgactaggcagcccccccttccctccgccgccaggctttgaagcctttgacagaacggagaatctgctcccccatagctgcagttgtgctgcacgacttgttgagctgttgtgtgtgtccatctcgtactttttatttgtattagtagtagctgtgatgacgatgcatgggctgctctgtcttctgcagctctagcatacctcactactacgtgtgcgtgttgtaccgttttggtatggatggtgacttgaaagggtgccgctggtgatttgaaaaaaaaaaaaaaacaaaacgctcgaggtacccattcccccttatagtgaatcgtattcgcccgctcccctggccc

SEQ ID NO: 60249 - protein, 70 aa, Zea mays
  misc_feature: Ceres CLONE 1518936
MDQNNSNRQQPAGAAATTRGLPDGRRRTAGRHRQEAGTPGENKPPRGEKGFIEGCIAALCCCWICEMCCD

SEQ ID NO: 60250 - DNA, 677 bp, Zea mays
  misc_feature: Ceres CLONE 1518937
  misc_feature: Translation starting site: 239
  misc_feature (54)..(54): n is a, c, t, g, unknown, or other
  misc_feature (251)..(251): n is a, c, t, g, unknown, or other
  misc_feature (308)..(308): n is a, c, t, g, unknown, or other
  misc_feature (388)..(388): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
aaagctggagctcaccgcggtggcggccgctctagaactagtggatttcttggnctgcaggaattcgtctcacccctagaaaaaaagaaacagagagagcggttctacgtccgagtcgtcgcatcaggtcccctcgattcgccggcggcggcgccaccaaccaagctcatacatctgaattgactagtccaactcagggatttctttggggaccaatcaaactcaagaactaagtttcatgtctgatctcnacgtccagcttccatctgcttttgatccgtttgcagaggcaaatgctgaggactccngtgctgggtgctggatcaaaggactatgtgcacgtgcgtattcagcagcgcaacggaaggaaaagtccgacgactgttcnnnnctttaaaaaaaaatacacctaccacaagatcctccaggaatctcaaaaagaaattcctgctgcaatgggaccttgaatccagggatcccaaacctgggccaaggttatttcaacttggcaagggggatcacccccaaaaaagggcccccgactttttccaagccccagcccccgaaattcggggaaaaaaaagaaaagcatttagttattttccgcggttttttaaacccggaaaattgttaaaagtgtttttttgggtttgccctatcccataatggaaccgcag

SEQ ID NO: 60251 - DNA, 699 bp, Zea mays
  misc_feature: Ceres CLONE 1518938
  misc_feature: Encodes the peptide sequence at SEQ ID NO. 60252
  misc_feature (414)..(414): n is a, c, t, g, unknown, or other
  misc_feature (427)..(427): n is a, c, t, g, unknown, or other
  misc_feature (433)..(433): n is a, c, t, g, unknown, or other
  misc_feature (434)..(434): n is a, c, t, g, unknown, or other
  misc_feature (436)..(436): n is a, c, t, g, unknown, or other
  misc_feature (450)..(450): n is a, c, t, g, unknown, or other
  misc_feature (467)..(467): n is a, c, t, g, unknown, or other
  misc_feature (468)..(468): n is a, c, t, g, unknown, or other
  misc_feature (478)..(478): n is a, c, t, g, unknown, or other
  misc_feature (505)..(505): n is a, c, t, g, unknown, or other
  misc_feature (506)..(506): n is a, c, t, g, unknown, or other
  misc_feature (527)..(527): n is a, c, t, g, unknown, or other
  misc_feature (538)..(538): n is a, c, t, g, unknown, or other
  misc_feature (539)..(539): n is a, c, t, g, unknown, or other
  misc_feature (543)..(543): n is a, c, t, g, unknown, or other
  misc_feature (589)..(589): n is a, c, t, g, unknown, or other
  misc_feature (590)..(590): n is a, c, t, g, unknown, or other
  misc_feature (598)..(598): n is a, c, t, g, unknown, or other
  misc_feature (621)..(621): n is a, c, t, g, unknown, or other
agagctggagctcaccgcggtggcggccgctctagactagtggagtcctcggtctgcagaatcgtctcacccttaggagtccacaacaccagaatccgcgaatcacagacgcgtctatctcagcttgctgcactgcactaccctgccctgccatcatatcgtacgtgagcccggccgagcgagagcgagggagaggcatggctgctccgaagctcgcgacgctggcgctggccgtgctcctggcggcgaccgtggtggctcccccggccgcggtgcgcgcggcgatgtcgggctccaccgtgtacagcacgctgatgccgtgcctgcccttcgtccagatgggcggggccatgccgccccggccggggtggggggggatcctaagcctggctggggagggggaccacccccccncaccggccggccnaattgnngntgtgctcaggaacngcgccaacggcgcccanngggagggggngcctgcgaagacgccggcccggccggnntgcgcagcaggggggggggtnggcccggcccnnccanacaccgccccccgaggttgggcgcgcccccccctcgggccacatgnntggccgcngagtttttacccgccgccgcggncaaagaaggccgcgggacgcgccagggggggccacggaagaacagcccccccgatgggttgcgcggagaggaagagag

SEQ ID NO: 60252 - protein, 167 aa, Zea mays
  misc_feature: Ceres CLONE 1518938
  misc_feature (73)..(73): Xaa is any aa, unknown, or other
  misc_feature (77)..(77): Xaa is any aa, unknown, or other
  misc_feature (79)..(79): Xaa is any aa, unknown, or other
  misc_feature (80)..(80): Xaa is any aa, unknown, or other
  misc_feature (85)..(85): Xaa is any aa, unknown, or other
  misc_feature (90)..(90): Xaa is any aa, unknown, or other
  misc_feature (91)..(91): Xaa is any aa, unknown, or other
  misc_feature (94)..(94): Xaa is any aa, unknown, or other
  misc_feature (103)..(103): Xaa is any aa, unknown, or other
  misc_feature (114)..(114): Xaa is any aa, unknown, or other
  misc_feature (116)..(116): Xaa is any aa, unknown, or other
  misc_feature (131)..(131): Xaa is any aa, unknown, or other
  misc_feature (134)..(134): Xaa is any aa, unknown, or other
  misc_feature (142)..(142): Xaa is any aa, unknown, or other
MAAPKLATLALAVLLAATVVAPPAAVRAAMSGSTVYSTLMPCLPFVQMGGAMPPRPGWGGILSLAGEGDHPPXPAGXIXXVLRNXANGAXXEGXPAKTPARPXCAAGGGVGPAXPXTAPRGWARPPLGPHXWPXSFYPPPRXKKAAGRARGGHGRTAPPMGCAERKR

SEQ ID NO: 60253 - DNA, 685 bp, Zea mays
  misc_feature: Ceres CLONE 1518939
  misc_feature (509)..(509): n is a, c, t, g, unknown, or other
ccccgcggtggcggccgctctagaactagtggatcccccgggctgcaggaattcgtctcacccctagaaaaaaccacaccacacgcgccgccgccgccgctgccgagggctcgtgggtgcccgaccccgtcacgggccactaccgccccgccaactgggccgccgccgtcgaccccgccgacctccgcgccgctcacctcgcccgcacctacgcccgggcctgagcggccccggctcccttcaccctgctccgcctcgtctcgtatgacatacgcgcaccgtacgtaccagggtgagacgaggtgaggggtcggggttcgtgtggcgaacggcgtgttgagccacgcgcgcgtgcgcccgcgctctgtgacgcccggaacgttcttgggagagcgcgagcgaggtcttgtctctttctcgtgcgggtcgctgtgccatgtgatgtgatgtggacgtggatcgtttttggtccgaccacgggagaagagcgggctgtggtcgccgtcccngccgtgtgtgggctggatgggctgctttcttgggcctctcctatatatcagatgtactccctccaaggagcaaggtttccgctaccttttcgtaatcgctaaagttacgggtaggaccgttctttactaataaaaggctggcgtttcttcaaaaaaaaaaaaaaaacgagacggcc

SEQ ID NO: 60254 - DNA, 698 bp, Zea mays
  misc_feature: Ceres CLONE 1518940
  misc_feature: Encodes the peptide sequence at SEQ ID NO. 60255
  misc_feature (43)..(43): n is a, c, t, g, unknown, or other
  misc_feature (66)..(66): n is a, c, t, g, unknown, or other
  misc_feature (199)..(199): n is a, c, t, g, unknown, or other
  misc_feature (300)..(300): n is a, c, t, g, unknown, or other
tccccgcggtggcggccgctctagactagtggatttcttcggnctgcagaatcgtctcatcttagngaagctccgccggctcctccactcagaaaacccagccgccgccgcatcggcctcccaggtaagcaggagcgtccaccccagccgccgccatgaagcgcaacccccgcgtcacgagctcccgccggaagtgccncaaggcgcacttcacggccccgtcctccgtccgccgcgtgctcatgtccgcggcgctatcgagcgaacttctccttccccccagggggcggtgcccccccnatcctcagggactacaaggtgcaggtcccgtgcggcccctccattttttttctccccccgggggggcaagaaagggggcctccttaataacctccccccccccccccgtccttcataccacatgggacgggccccccccggggggggggtggcaccctctctctgggggtgttttggcgaatagcacgcgttccccgaccccggccggtttccccccacctctgggggactagggggcggctcccccgtccagagtcgagggggtgggtacccatggacgtgcgccgcggccttgcgcgcgggatattttctgccgcccgcggtgcctttcccgcccgtcggtggctgttttaccgtcgaaccccggctcgttttgttttttcacccccctgccgact

SEQ ID NO: 60255 - protein, 125 aa, Zea mays
  misc_feature: Ceres CLONE 1518940
  misc_feature (15)..(15): Xaa is any aa, unknown, or other
  misc_feature (49)..(49): Xaa is any aa, unknown, or other
MKRNPRVTSSRRKCXKAHFTAPSSVRRVLMSAALSSELLLPPRGRCPPXPQGLQGAGPVRPLHFFSPPGGARKGASLITSPPPPVLHTTWDGPPPGGGWHPLSGGVLANSTRSPTPAGFPPPLGD

SEQ ID NO: 60256 - DNA, 645 bp, Zea mays
  misc_feature: Ceres CLONE 1518941
  misc_feature: Encodes the peptide sequence at SEQ ID NO. 60257
  misc_feature (399)..(399): n is a, c, t, g, unknown, or other
gctctagaactagtggatcccccgggctgcaggaattcgtctcacccctagaaaaaaggcacttacctgcagtcaccactcccaagccagtacccacagtcctacgagcagtcgcacgcaagtgtcaagagacaaaacggtcgacatggctcgcacgcaatctgccgtagcggtcgccgtggtggccgcggtgctgctgctggcagcggcggcgacgacctcggaggccgccatcacctgcgggcaggtgagctccgccatcgcgccctgcctctccctacgccgcggcacggggtccggcccctccgcgtcctgctgtagcggcgtcaggaaccctcagagcgccgccagcaccgccgccgacaggcgcgccgcctgcaactgccctcagaccgccgncaagggcgtcagcgggctcaaacgccggaacgccgccagaatcccctccaagtgggggtcagaatccctaaccattagaacctcaccgaatggtccgggggactaaaacctaaacaacccgaaaagggcccctgataattaaaaacattccccgtccccgcggcggaaaacaaacgccgccggaaataccacacccccgggaagacaaggcactgccccggtatgaaaaaaaaaaacccccggggg

SEQ ID NO: 60257 - protein, 119 aa, Zea mays
  misc_feature: Ceres CLONE 1518941
  misc_feature (32)..(112): Pfam Name: Tryp_alpha_amyl Pfam Description: Protease inhibitor/seed storage/LTP family
  misc_feature (85)..(85): Xaa is any aa, unknown, or other
MARTQSAVAVAVVAAVLLLAAAATTSEAAITCGQVSSAIAPCLSLRRGTGSGPSASCCSGVRNPQSAASTAADRRAACNCPQTAXKGVSGLKRRNAARIPSKWGSESLTIRTSPNGPGD

SEQ ID NO: 60258 - DNA, 699 bp, Zea mays
  misc_feature: Ceres CLONE 1518943
  misc_feature: Encodes the peptide sequence at SEQ ID NO. 60259
  misc_feature (417)..(417): n is a, c, t, g, unknown, or other
aagctggagctccccgcggtggcggccgctctagaactagtggatcccccgggctgcaggaattcgtctcacccctagaaaaaattttccatcctgtcgtgggatcccagccaccgccgctagaagaagagctcggcgattcccaggtcccgcgagaatatgccgaagcagatccatgagattaaggacttcctcctcaccgcgaggaggaaggatgcccgctcagtgaagatcaagaggagtaaggatgttgtcaagttcaaggtgcgctgctccaagtacttgtacacgctctgcgtcttcgatgctgagaaggcaaacaagttgaagcaatctcttcccccaggtttgaccgtcgaggaggtctgattggatacatggcaacgccgagttgaactacccaagcttccccctcantagcagagcatgctactctatgtacttttggaacctaagctattagacctgtcagtgttggatgtctggatcttgcatttttggagaaatacccatttacctcgttcaaggatgcaagtatatttcttgtttaactgcacattactttatatttatgccctgttcctacctttcctctacagaaaaaaaaaaaaaaaaccagacgctcgaggtacccaattcgcccctaagggagtcgtattacccccgctccctggccgtcgttttacaacctccggactg

SEQ ID NO: 60259 - protein, 69 aa, Zea mays; identical to SEQ ID NO: 8575
  misc_feature: Ceres CLONE 1518943
  misc_feature (2)..(69): Pfam Name: Ribosomal_L38e Pfam Description: Ribosomal L38e protein family

SEQ ID NO: 60260 - DNA, 609 bp, Zea mays
  misc_feature: Ceres CLONE 1518945
  misc_feature: Encodes the peptide sequence at SEQ ID NO. 60261
  misc_feature (123)..(123): n is a, c, t, g, unknown, or other
  misc_feature (310)..(310): n is a, c, t, g, unknown, or other
  misc_feature (312)..(312): n is a, c, t, g, unknown, or other
  misc_feature (321)..(321): n is a, c, t, g, unknown, or other
  misc_feature (331)..(331): n is a, c, t, g, unknown, or other
  misc_feature (375)..(375): n is a, c, t, g, unknown, or other
ccgcggtggcggccgctctagaactagtggatcccccgggctgcaggaattcgtctcacccctagaaaaactacgggccgccgccagcatcaagctccccgaccaaaccctactcgtaccccngccgccgccgcagccgcagccgcggccacaccagcaagcagaactagcagccatgccgcccaaattggacccctctcaggtggtggaggtcttcgtccgcgtgacgggaggcgaggtcggcgcggcgtcgtcctggcccccagatcggccgctcgtctctccccgagagaatcgcgagacatcgccnangagaccgcnaggactggangggctcgcgtcacgtcaagctcaccgtgcagaaccggcaggcanggtctccgtcgtcccctccgcgcggggctcgtcatcaaggcgctcaaggaccccaaaaggaccggaaaaagggtcagaaattctagcaagggggaacatcagcctcgaagagtcttttaaatcgcaagaccttggggaaaagggccatgggcaaggaatgggcccgaaccctcaagggaatccggggaactggctcaacgctggggggccccctccatgggaaggacccccagg

SEQ ID NO: 60261 - protein, 144 aa, Zea mays
  misc_feature: Ceres CLONE 1518945
  misc_feature (46)..(46): Xaa is any aa, unknown, or other
  misc_feature (49)..(49): Xaa is any aa, unknown, or other
  misc_feature (52)..(52): Xaa is any aa, unknown, or other
  misc_feature (67)..(67): Xaa is any aa, unknown, or other
MPPKLDPSQVVEVFVRVTGGEVGAASSWPPDRPLVSPRENRETSPXRPXGLXGLASRQAHRAEPAGXVSVVPSARGSSSRRSRTPKGPEKGSEILARGNISLEESFKSQDLGEKGHGQGMGPNPQGNPGNWLNAGGPPPWEGPP

SEQ ID NO: 60262 - DNA, 697 bp, Zea mays
  misc_feature: Ceres CLONE 1518950
  misc_feature: Encodes the peptide sequence at SEQ ID NO. 60263
  misc_feature (535)..(535): n is a, c, t, g, unknown, or other
  misc_feature (553)..(553): n is a, c, t, g, unknown, or other
  misc_feature (659)..(659): n is a, c, t, g, unknown, or other
gcggtggcggccgctctagaactagtggatcccccgggctgcaggaattcgtctcacccctagaaaaactagcagccacccggttctccctcgctccagatctcccttcgcagccggccagggaccccttcacagcgcgggagatggctgatcaggaggccccagttgcagttgaggcaccaaccccagttcttggagagccaatggacttgatgactgcgctgcagctggtgatgaagaagtcaagtgctcatgatggacttgtgaagggtcttcgcgaggctgccaaggccattgagaagcatgctgctcagctttgcgttcttgctgaggactgtgaccagccagattatgtcaagctggtgaaggcgctctgtgctgaacacaatgttcaccttgtcactgttcctgctgctaagactcttggcgagtgggctgggctttgcaagattgactccgagggcaaggcaaggaaggttgtaggctgctcctgtgtcgttgtcaaggactacggtgaagaatctgagggccttancatagtgcaggagtatgntcagtcgcactagatgtaacacgtttcagtatactttacatttggatctgggcttaatattatgcttgcgtcttgggcttgctaggagattaggaacatttactancagagcccatgaggatatgagcatttggaattctaatg

SEQ ID NO: 60263 - protein, 140 aa, Zea mays
  misc_feature: Ceres CLONE 1518950
  misc_feature (25)..(120): Pfam Name: Ribosomal_L7Ae Pfam Description: Ribosomal protein L7Ae/L30e/S12e/Gadd45 family
  misc_feature (131)..(131): Xaa is any aa, unknown, or other
  misc_feature (137)..(137): Xaa is any aa, unknown, or other
MADQEAPVAVEAPTPVLGEPMDLMTALQLVMKKSSAHDGLVKGLREAAKAIEKHAAQLCVLAEDCDQPDYVKLVKALCAEHNVHLVTVPAAKTLGEWAGLCKIDSEGKARKVVGCSCVVVKDYGEESEGLXIVQEYXQSH

SEQ ID NO: 60264 - DNA, 639 bp, Zea mays
  misc_feature: Ceres CLONE 1518951
  misc_feature: Encodes the peptide sequence at SEQ ID NO. 60265
  misc_feature (313)..(313): n is a, c, t, g, unknown, or other
  misc_feature (334)..(334): n is a, c, t, g, unknown, or other
aaagctggagctccccgcggtggcggccgctctagaactagtggatcccccgggctgcaggaattcgtctcacccctagaaaaaacggcataccacactagagccgccgccgccgccgtttcgcgcaccgtaccctagccctcgtcagcggcggcttcgagctcatccagccatgacgttcaagcggaggaatggcggacgcaacaagcacgggcgcggccacgtcaagtacatccgctgctccaactgcgccaagtgctgccccaaggataaggctatcaagcggttcttggtgaggaacattgttgagcangctgccgtgagagatgtgcangaggcctgtgtacatgatggatatgttctacccaaattgtatgcaaagggtcatcactgtgtctcatgtgcaatccatgcgcacattgttcggggtccgctctcgtgagaccaagaggaaccgtgagcccccgcagcgcttcagaccccgggatgattgcccaaggccttggtcaggtcccgccgcggccaagggggggcaatttcctgaaattgcaactgctgctgctcccccaacctaaagttccgaaatatagtttcggggcttattttttggaaaaaatttccctgttttggaaaacactt

SEQ ID NO: 60265 - protein, 89 aa, Zea mays
  misc_feature: Ceres CLONE 1518951
  misc_feature (1)..(90): Pfam Name: Ribosomal_S26e Pfam Description: Ribosomal protein S26e
  misc_feature (47)..(47): Xaa is any aa, unknown, or other
  misc_feature (54)..(54): Xaa is any aa, unknown, or other
MTFKRRNGGRNKHGRGHVKYIRCSNCAKCCPKDKAIKRFLVRNIVEXAAVRDVXEACVHDGYVLPKLYAKGHHCVSCAIHAHIVRGPLS

SEQ ID NO: 60266 - DNA, 516 bp, Zea mays
  misc_feature: Ceres CLONE 1518954
  misc_feature (209)..(209): n is a, c, t, g, unknown, or other
ggcggccgctctgactagtggatcccccgggctgcggattcgtctcacccctagaaaaatcgcatcctccaccacgcaccccaccaacccatacccataccagaggctctctgattttacttctcagcggtagatcggctgagcgagcgagcgagcgaggcacacgggagctagctaaacagagcaccacggaatagaaagcagatgcngacgcacgcgactgctcgactcatctcgcattatctgccgcgtcgggccttctcaagttcggtggcggtgagtccggattggcttatccccctttttgggtacctccccggggtttatttacccggctggggcctcccaaataccgggcggggcgattaattgaaagggcccccaggggattccctgggggggggaacccggggccccccgtcttaaaaaaaaaacccccccccccccggggtaaaaggcccccgccccccccggggggaaaaacggggttcccccccccttgttttttttctggaa

SEQ ID NO: 60267 - DNA, 700 bp, Zea mays
  misc_feature: Ceres CLONE 1518959
  misc_feature (127)..(127): n is a, c, t, g, unknown, or other
  misc_feature (129)..(129): n is a, c, t, g, unknown, or other
  misc_feature (130)..(130): n is a, c, t, g, unknown, or other
  misc_feature (145)..(145): n is a, c, t, g, unknown, or other
  misc_feature (151)..(151): n is a, c, t, g, unknown, or other
  misc_feature (162)..(162): n is a, c, t, g, unknown, or other
  misc_feature (251)..(251): n is a, c, t, g, unknown, or other
  misc_feature (275)..(275): n is a, c, t, g, unknown, or other
  misc_feature (283)..(283): n is a, c, t, g, unknown, or other
  misc_feature (284)..(284): n is a, c, t, g, unknown, or other
  misc_feature (285)..(285): n is a, c, t, g, unknown, or other
  misc_feature (286)..(286): n is a, c, t, g, unknown, or other
  misc_feature (288)..(288): n is a, c, t, g, unknown, or other
  misc_feature (289)..(289): n is a, c, t, g, unknown, or other
  misc_feature (290)..(290): n is a, c, t, g, unknown, or other
  misc_feature (291)..(291): n is a, c, t, g, unknown, or other
  misc_feature (308)..(308): n is a, c, t, g, unknown, or other
  misc_feature (309)..(309): n is a, c, t, g, unknown, or other
  misc_feature (313)..(313): n is a, c, t, g, unknown, or other
  misc_feature (336)..(336): n is a, c, t, g, unknown, or other
  misc_feature (337)..(337): n is a, c, t, g, unknown, or other
  misc_feature (338)..(338): n is a, c, t, g, unknown, or other
  misc_feature (339)..(339): n is a, c, t, g, unknown, or other
  misc_feature (340)..(340): n is a, c, t, g, unknown, or other
  misc_feature (341)..(341): n is a, c, t, g, unknown, or other
  misc_feature (342)..(342): n is a, c, t, g, unknown, or other
  misc_feature (343)..(343): n is a, c, t, g, unknown, or other
  misc_feature (345)..(345): n is a, c, t, g, unknown, or other
ccggcagttcctctcacccctagaaaaaacctcagcactagtctcctcttcgcacgagcgcaataccatccacccaccagttcgaagcggaggcgaccggtttcctgcggcgggagatgtcaggcangnnctaagggcgcaaggngctcgnaaaaggcggcnccaaacgtcaccggaaggtgctgcccccaacatccaggggattacgaagccgggtatcctaatttttgcccccaggggggggggagaancccatctcttctcttttttttaanaaaaaaannnnannnngaaaatttttttccttnncctnttacgggggtagttgggggggannnnnnnncnccccccccctttttttttactaaaaaaaaaaataaaaccccccccaccacggggggggacatttttttagttttgctctattttgttcctttgcaaacgtcttttcttcagcctctaataaataaattcatttatctcgatcttcgcttacaagtctttcaagaccgcgaccgcctctctctctcccttcctctcctccgcttgagtgtcgcttttcgccgttggtgaattaccaccacccttccatctcctatcttctctctgctcacgttcccataccggggccgtcgcggcggcgcctgccccgccccccgggtgcccgccgtcgccaactaccccacatccggcgctcttc

SEQ ID NO: 60268 - DNA, 842 bp, Zea mays
  misc_feature: Ceres CLONE 1518960
  misc_feature: Encodes the peptide sequence at SEQ ID NO. 60269
  misc_feature (344)..(344): n is a, c, t, g, unknown, or other
  misc_feature (346)..(346): n is a, c, t, g, unknown, or other
  misc_feature (347)..(347): n is a, c, t, g, unknown, or other
  misc_feature (348)..(348): n is a, c, t, g, unknown, or other
  misc_feature (350)..(350): n is a, c, t, g, unknown, or other
  misc_feature (355)..(355): n is a, c, t, g, unknown, or other
  misc_feature (400)..(400): n is a, c, t, g, unknown, or other
aagctggagctccccgcggtggcggccgctctataactagtggatcccccgggctgcaggaattcttctcacccctagaaaaaaaggacggcatccactactccgccgtcaccgtgcagctcccggggggcgagcgcgtgccgttcctcttcaccggcaagcagctcgtcgccaccggcaagcccgagagcttcagcgggcccttcctcgtgcccagctaccgtggctcctccttactcgaccccaggggccgcggcggctccaccggctacaacaacgccgtcccgctccccgccgggggaagaggtgacaaagaggagctctcgagggagaacatcaagaangnnngnttccncccaccgaaaaccccaccccccagggggggtggggaggggtcccnaaaaaccccccaaaccccccccccccccttagaagaatggtgggggtctctcggaaaaaagaaacccaaggcgccccacgcccccccaagggaaggtcccacaacccacatggggcccgagagatacttccccgccccccaagcggaatgtcagattgtcctcacttcgccgaggggtgtgcccgaccctgtctgttgttggtcgcacctcggggacaagcgtcttatggttaccccatccctaaaaaggctttgctcgatagtcctcagccggagaaacatggctcatctccactggggttgtgcttcgatggcccaaatatctctctctgagggggtttgtaaaagaaaaacaagagagctagactctcacgtaaagagccgtccgcgcaggcgtgcccctcagagcgggacgcacgccacccagcaccgaggactcggc

SEQ ID NO: 60269 - protein, 280 aa, Zea mays
  misc_feature: Ceres CLONE 1518960
  misc_feature (5)..(151): Pfam Name: MSP Pfam Description: Manganese-stabilising protein / photosystem II polypeptide
  misc_feature (114)..(114): Xaa is any aa, unknown, or other
  misc_feature (115)..(115): Xaa is any aa, unknown, or other
  misc_feature (116)..(116): Xaa is any aa, unknown, or other
  misc_feature (118)..(118): Xaa is any aa, unknown, or other
  misc_feature (133)..(133): Xaa is any aa, unknown, or other
AGAPRGGGRSITSGSPGLQEFFSPLEKKDGIHYSAVTVQLPGGERVPFLFTGKQLVATGKPESFSGPFLVPSYRGSSLLDPRGRGGSTGYNNAVPLPAGGRGDKEELSRENIKXXXFXPPKTPPPRGGGEGSXKTPQTPPPPLEEWWGSLGKKKPKAPHAPPREGPTTHMGPERYFPAPQAECQIVLTSPRGVPDPVCCWSHLGDKRLMVTPSLKRLCSIVLSRRNMAHLHWGCASMAQISLSEGVCKRKTRELDSHVKSRPRRRAPQSGTHATQHRGLG

SEQ ID NO: 60270 - DNA, 777 bp, Zea mays
  misc_feature: Ceres CLONE 1518962
  misc_feature: Encodes the peptide sequence at SEQ ID NO. 60271
tccccgcggtggcggccgctctatactagtggatcccccgggctgcaggaattcgtctcacccctagaaaaagaagtttcggcggcggcgtaggtagcggcggtctcaaccccaggcgagctcggctccggtcacccgtcgatccacgcaaccatgtcgaggaggaagaccagggagcccaaggaggagaacgttacccttggacccactgtccgtgaaggagagtttgtctttggtgttgctcacatctttgcatccttcaatgacaccttcattcatgtcactgatttgtctgcgaagggaaactttggtttcggatcactgggggcataaaagctaaggctgaatctgaagacatcgctccttggggtggtacccctggtggttcacaacccccccccgtgtttgcaaggaagttccgggatccccgcgcttgcaaatttaaccttcttggccacttggagggccaaaagaaccaagaacccccggaccccggggggcccagtccgggctcccagggggccctttgctccgttctggggaatgaaaatttggaccccatttgagggaatgttaccccccggttcccccttggaaagccccccccaaaaaaggggggttaagaaggggaaaggagggtttttaaccctttttcccctgggatattggccggcccttttcccctgggccccccggggtaaggttttgtgtaaattaaccgggcccaagggaggtttaattttgcccccttttggcccccgggggcgggattttttt

SEQ ID NO: 60271 - protein, 59 aa, Zea mays
  misc_feature: Ceres CLONE 1518962
MSRRKTREPKEENVTLGPTVREGEFVFGVAHIFASFNDTFIHVTDLSAKGNFGFGSLGA

SEQ ID NO: 60272 - DNA, 726 bp, Zea mays
  misc_feature: Ceres CLONE 1518964
  misc_feature: Translation starting site: 129
ctcaccgcggtggcggccgctctagaactagtggatcccccgggctgcaggaattcgtctcacccctagaaaaaatccgcgccagtccaaccaagtcagcacccgcgcgcggcaaggagttcacgcccatggcgagcaccaacatggcgtcggccacctcgcggttcatgctggccgcgggcgtgcccactgccagtagcggcagcggccgcgtcagcttcgcctcggcgcccaaccggcttggcaggaggcttgtggtccgggccgatgaggagttcccggcagagccggcgcccacggcggaaggggagggcgccgtggccaccaagcccaaggccgagaagccgccgccgatcgggcccaagaggggcgccaaggtgaagatcctgaggcgggagtcctactggtacaacgggatcggcaacgtcgtcaccgtcgatcaggatcctaacacccgttacccggtgggtggtgcggttcaacaaggtgaactacgccggcgtgtctaccaacaactacgccttggacgagatcctcgaggtgaaatgagtgaggccagtctgctaaagacccatgctcctgtgtgatttgtagttgtgaagtgaggctgctgcctagctgctagcgtcacacatcaatcttggtatagcttaatctcccacatcatcatgtaatttattgcatgcttcattcaccgtggactcaataatctctcttgctctaaaa

SEQ ID NO: 60273 - DNA, 720 bp, Zea mays
  misc_feature: Ceres CLONE 1518965
  misc_feature: Encodes the peptide sequence at SEQ ID NO. 60274
  misc_feature (497)..(497): n is a, c, t, g, unknown, or other
  misc_feature (529)..(529): n is a, c, t, g, unknown, or other
  misc_feature (593)..(593): n is a, c, t, g, unknown, or other
  misc_feature (622)..(622): n is a, c, t, g, unknown, or other
  misc_feature (641)..(641): n is a, c, t, g, unknown, or other
  misc_feature (719)..(719): n is a, c, t, g, unknown, or other
ctcacggcggtggcggccgctctagaactagtggatcccccgggctgcaggaattcgtctcacccctagaaaaactagcttgcagcgccgcctggatcgagcagccgagcgactaagcgaagactcccttttccccgagcacaagagaaccatggcggcggcggcagtttacggcggcttcaaagggaagcttggcgtcgaggatgcccccgagctgcagctcaaccgcatccgcatcacactctcatccaagaacgtcaagaacttggagaaagtttgtgcggatttggtaaagggagccaaggacaagcatttgagggttaagggacctgtccggatccctactaaggttctccacatcaccactcgcaagtccccttgcggtgaaggaacaaacacatgggatcggtttgagttccgcattcacaagagggtgattgacctaatcagctcccctgatgtggtgaagcagatcacctccatcacaattgagcccnggtgttgaggttgaagtgaccattgccgacgntgtaggacgtgaagtttcagcatgtcatcgacaatctttttctttgtgctccctgtgtgctcgncagagagattttgaatttatatagcatancagacttccttcccccccntatatctatgctagctgtttgtctgatctatggcctggtcaactgaaattttgatcagtatctttatgtgtgctaatng

SEQ ID NO: 60274 - protein, 117 aa, Zea mays
  misc_feature: Ceres CLONE 1518965
  misc_feature (26)..(115): Pfam Name: Ribosomal_S10 Pfam Description: Ribosomal protein S10p/S20e
  misc_feature (116)..(116): Xaa is any aa, unknown, or other
MAAAAVYGGFKGKLGVEDAPELQLNRIRITLSSKNVKNLEKVCADLVKGAKDKHLRVKGPVRIPTKVLHITTRKSPCGEGTNTWDRFEFRIHKRVIDLISSPDVVKQITSITIEPXC

SEQ ID NO: 60275 - DNA, 694 bp, Zea mays
  misc_feature: Ceres CLONE 1518966
  misc_feature: Translation starting site: 186
aaagctggagctccccgcggtggcggccgctctagaactagtggatcccccgggctgcaggaattcgtctcacccctagaaaaagtcatcagaatcagaccaccacacgcccgaggcccgactgcaagcgcctgagcccaagacccatgggcatggccgccgccaccgtctgatcgtcactgcccatggctgatgggctctggaagcccctctgcgcatgcagtaacgcgctttctctccgggtcgacgagggttcgctccgtatattgctcaccacgattaacatggccggctctcggatctcctcgtctaattatcacaccaacgaggagtggctcgcgacggatgccctgtcatccgcgcttatgctgccggatgcctcggaagcagcgccggcgatctccattgtcgctcaataacttcctcctcaatatcgtctactgtggcgtggtgctcgctttcatctgaggcagctatgtatccttctctaacttcaatacaaactggcttggctgagctttctgcgcctttgctttgttgatgacctacccctgggatctggatctctccccaccaagtgcattccgacgaaaaaggtcaaacattgattgatggtgtcatttcaatttacatgcctttctgctgaataaaaacgatccccagccgctattggaaccaaataaccccttaacgc

SEQ ID NO: 60276 - DNA, 561 bp, Zea mays
  misc_feature: Ceres CLONE 1518973
  misc_feature: Translation starting site: 91
  misc_feature: SWISSPROT Homolog: EC 5.4.99.12 tRNA-pseudouridine synthase I
  misc_feature (247)..(247): n is a, c, t, g, unknown, or other
  misc_feature (319)..(319): n is a, c, t, g, unknown, or other
  misc_feature (321)..(321): n is a, c, t, g, unknown, or other
  misc_feature (322)..(322): n is a, c, t, g, unknown, or other
  misc_feature (326)..(326): n is a, c, t, g, unknown, or other
  misc_feature (327)..(327): n is a, c, t, g, unknown, or other
  misc_feature (328)..(328): n is a, c, t, g, unknown, or other
  misc_feature (329)..(329): n is a, c, t, g, unknown, or other
  misc_feature (330)..(330): n is a, c, t, g, unknown, or other
  misc_feature (342)..(342): n is a, c, t, g, unknown, or other
  misc_feature (343)..(343): n is a, c, t, g, unknown, or other
  misc_feature (389)..(389): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
  misc_feature (406)..(406): n is a, c, t, g, unknown, or other
  misc_feature (407)..(407): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (431)..(431): n is a, c, t, g, unknown, or other
  misc_feature (432)..(432): n is a, c, t, g, unknown, or other
  misc_feature (434)..(434): n is a, c, t, g, unknown, or other
  misc_feature (440)..(440): n is a, c, t, g, unknown, or other
  misc_feature (441)..(441): n is a, c, t, g, unknown, or other
  misc_feature (457)..(457): n is a, c, t, g, unknown, or other
  misc_feature (462)..(462): n is a, c, t, g, unknown, or other
  misc_feature (463)..(463): n is a, c, t, g, unknown, or other
  misc_feature (464)..(464): n is a, c, t, g, unknown, or other
  misc_feature (468)..(468): n is a, c, t, g, unknown, or other
  misc_feature (477)..(477): n is a, c, t, g, unknown, or other
  misc_feature (484)..(484): n is a, c, t, g, unknown, or other
  misc_feature (493)..(493): n is a, c, t, g, unknown, or other
  misc_feature (513)..(513): n is a, c, t, g, unknown, or other
ctccccgcggtggcggccgctctagaactagtggatcccccgggctgcaggaattcgtctcacccctagaaaaaacttaatccccatgccatgcaggaggctgcaaattattttgttggaatccatgacttcacgtcttttgctaatgctgcacataatgacggtgagcgcaggcccacaaagaagataacacgttttgatgttactgaaatgggtgctgtcttacagctcgaggttgaaggcaccnggttttctgtacagacaagtgaggaacatggttgctttgctgcttcagtcggaaggagcacttcttctgaantnntccnnnnntttttccccaannccggagatccattttggccggccccaaggggaacccgtaaaagaanaactctgggnnnnnncnnaaaaaaaaaaaaagaggnnngtgnntngcgcgnnggccgcccccccctcncttcnnnttgntggccccgncccccgnacgacgggnaacggaaacgatctcccctnttaccccccccgcctccgcccctatttattatttcatccccccggcac

SEQ ID NO: 60277 - DNA, 617 bp, Zea mays
  misc_feature: Ceres CLONE 1518974
  misc_feature: Encodes the peptide sequence at SEQ ID NO. 60278
  misc_feature (415)..(415): n is a, c, t, g, unknown, or other
tggagctccccgcggtggcggccgctctagaactagtggatcccccgggctgcaggaattcgtctcacccctagaaaaaatctttcccccgtcctccctcgccttcgccttcgccggcaggagatttccaccaccaccgccgaaccgccccgaccctcctcccctctcgcgctatggcccagactgttgtgctcaaggttggcatgtcctgtgagggctgtgttggagctgtcaagcgggtcctcggcaagatggaaggcgtcgagtcctacgacgtagacatcatggaacagaaggtcaccgtgaagggcaatgtgacacctgacgccgtcctgcaaactgtttccaagactggcaagaagacttcgttctgggaggctgaggccgtgacaagtgaatcccccacaccctcccngtgccaccgcctggacaggttcgatgaatttggaaaattgccccggcaggggggcaaaaaaaaaaatggaaatgtttttgcctggggatcttttcaaaaaaatttgcaaaccgctaggcccccgggcttttaacatttttaacaggtggccatttccccgggattgtgggaaagtttttctccccataaagtgggggaaaag

SEQ ID NO: 60278 - protein, 124 aa, Zea mays
  misc_feature: Ceres CLONE 1518974
  misc_feature (5)..(66): Pfam Name: HMA Pfam Description: Heavy-metal-associated domain
  misc_feature: SWISSPROT Homolog: EC 3.6.3.4 Copper-exporting ATPase
  misc_feature (81)..(81): Xaa is any aa, unknown, or other
MAQTVVLKVGMSCEGCVGAVKRVLGKMEGVESYDVDIMEQKVTVKGNVTPDAVLQTVSKTGKKTSFWEAEAVTSESPTPSXCHRLDRFDEFGKLPRQGGKKKNGNVFAWGSFQKNLQTARPPGF

SEQ ID NO: 60279 - DNA, 661 bp, Zea mays
  misc_feature: Ceres CLONE 1518977
  misc_feature (53)..(53): n is a, c, t, g, unknown, or other
  misc_feature (109)..(109): n is a, c, t, g, unknown, or other
  misc_feature (118)..(118): n is a, c, t, g, unknown, or other
aaagctggagctccaccgcggtggcggccgctctagaactagtggatcccccngggctgcaggaattcgtctcacccctagaaaaaaaaaaaaaaaaaaaaaaaaaaanaaaaaaaanaaaaaaaaggccagacagaagacaacccgtcagcccctctcgtttttcatccgccttcgcctccaaccgcgtgcgctccacgcctcctccaggaaagcgagagcttctgcataagaacaacaaatcaaaagcgtgatcagctcggtgccaacaaaacctcaacaaccaagtttcatgtcttgatcttcgacgtccagcttccatctgcctttgatccgtttgctgaggcaaatgctgaggactctggtgctggtcctggaacgaaggattatgtgcatgtgcgcatccagcagcgcaacggcacaaagagtctgactacagtccagggtctgaaggaaggagtcagctataacaagatcctcaaggatctgaagaaggaattctgctgcaatggtactgtatttcaagaccccgaacttgggccgggtcattcacctcccagggggaccagcccaaaaaagttggctcctttcccaaattcgggctgggaattgccaaaaaaaaagaaaattccagaattcccgggggttctaaggggcacct

SEQ ID NO: 60280 - DNA, 705 bp, Zea mays
  misc_feature: Ceres CLONE 1518979
ctccccgcggtggcggccgctctagaactagtggatcccccgggctgcaggaattcgtctcacccctagaaaaaaaaaggatctttctctgtgaagagagtgcaagcagacgggcggtctgaactgatgccgtgttgattcgtctgcagttacatgccttccttcgggcgggcagccgagagaaagcagcacattactcgctacgtctgtcctatttgctcttaatatctttttgagtttgccaaagtactggtgctgtgatgaagatgctcaactatttctatgtctggacatctgagagtcatttctgtgattggtttacgcatcattctgagctccgaacaattatatctttttatcaatttactgttgcgcctggcttatattcttctgtgagaagggctcaatcatcgattgaagcacgcccacagatcctgagacagcaaagctggtgcaaacatcaagatgggtaacttacaaccctgtgcagccttgcattgcactggagtcaaatggtttaatcgaaattacttcataatagtttttctgatacagttcactccgtttgtcaacgctcatgatgacggcaagtgatgtgcaaatctctatccgacacacttaatgggatttactgcatgtgtggactagtctccgcttattatctgatgcttttgacaggcgctgcttcatttttcatataaaaaa

SEQ ID NO: 60281 - DNA, 723 bp, Zea mays
  misc_feature: Ceres CLONE 1518980
  misc_feature: Encodes the peptide sequence at SEQ ID NO. 60282
  misc_feature (366)..(366): n is a, c, t, g, unknown, or other
  misc_feature (448)..(448): n is a, c, t, g, unknown, or other
  misc_feature (449)..(449): n is a, c, t, g, unknown, or other
  misc_feature (480)..(480): n is a, c, t, g, unknown, or other
  misc_feature (548)..(548): n is a, c, t, g, unknown, or other
  misc_feature (598)..(598): n is a, c, t, g, unknown, or other
acccgcggtggcggccgctctagaactagtggatcccccgggctgcaggaattcgtctcacccctagaaaaaggcgtatccctaatcccacctccagtctctgggcaccaaatttccggcggcgatggcggcggctgtggcgaggtcagggttccggcgcatgttctccgtctctgccttcgcgccgccgaaggcgcccgccgcgcgccccaaggccgacccatcccccaacctcttcgtctccggcttaagcaagcgtaccacaagtgaaggacttagagaagcctttgcggagtttggtgaagttttgcatgctcgagttgtgaccgatcgtgtcagtgggttttctaagggatttggctttgntaggtatgctacgaccgaagaggcagccaagggaatagagggaaaggatggaaagttccttgatggatggggtatttttgcnngatacgctaaacccagaccaccaccggaggnaacaggggatgaattcgcagccccagcagtcatggggagctccatcaggttcctggggtgcacagtanatgaagtgatattgtgagagcccctccctgtcccagcctaggggtcgtancggatcgtgagggatgattttgtgtggtgtgtcgcaggggtgaaatgctttgtgtcccatattcctacgtggttgggggtgtcccttgctcccgtcacctcttcccatgatttggtacgggggga

SEQ ID NO: 60282 - protein, 146 aa, Zea mays
  misc_feature: Ceres CLONE 1518980
  misc_feature (37)..(108): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (81)..(81): Xaa is any aa, unknown, or other
  misc_feature (109)..(109): Xaa is any aa, unknown, or other
  misc_feature (119)..(119): Xaa is any aa, unknown, or other
  misc_feature (142)..(142): Xaa is any aa, unknown, or other
MAAAVARSGFRRMFSVSAFAPPKAPAARPKADPSPNLFVSGLSKRTTSEGLREAFAEFGEVLHARVVTDRVSGFSKGFGFXRYATTEEAAKGIEGKDGKFLDGWGIFAXYAKPRPPPEXTGDEFAAPAVMGSSIRFLGCTVXEVIL

SEQ ID NO: 60283 - DNA, 980 bp, Zea mays
  misc_feature: Ceres CLONE 1518982-R
ctcgagcgtctcgtttttttttttttttttctttaccggaactttttcgaatttttttttgttgttttaagttgaactttgtacatatgtttattgttcatttttttattggaagataacaaggaattacttgatagatccgaaccttcatggtcttctgggagccatgggacctttttttaacagcaacttatccacaaatcaacaaccagtttttcatagcaccaagtctataatggttttcaaatccacagcagtaagacgagtccatgatgcatgatcctgatgccgagaaagcccgatccttgatcgcactcaaggctcatttcacttgtatttttagcctgcagatcccacctgaatgcagggggggcccactctagaaaaatttggtttgagtcttgaataaaaaaatccttgcgcgaaaaacttgggctgaggaaaggagaccatttggatatccgaagatcaaagcgtcttctggcacatcttttcttctggtgtccaaaatcggggaatcataggctcccccgtaagaaaaacaatcttccctccgagggagggctgttttcctggaaggcccttctcaaaaatgggtaagaggggcatcccacccccctggaggacaaaaaaccaatattttctcggggtaccttggggggtttccccccatatataaatgtttaaagaatagaagtggggagagcgtttctttccaaaggagaaagaggggggagaggagagttttcaccccccccccccggcagtaatattgtggtgggcgaaaaagaccctgtaaggtaccgcggaggttgcccctcaccacggtgaagaagttctttgttgtatatcccaccaacaccgccgttattggcacgactagatcgtaacgtttacgggttgcctatatttgcggcctccccgcaaaataaaattatttatatattcgcggaaaaagagacagcagactaaaaaattag

SEQ ID NO: 60284 - DNA, 733 bp, Zea mays
  misc_feature: Ceres CLONE 1518986
  misc_feature: Encodes the peptide sequence at SEQ ID NO. 60285
  misc_feature (733)..(733): n is a, c, t, g, unknown, or other
ccaagctggagctccccgcggtggcggccgctctagactagtggatcccccgggctgcaggaattcgtctcacccctagaaaaacgaacatgatgaagccatcgtgtgtactgcttctttccagccttcttgtagccactcttgcagctactttttcgtcctctcctccgtattccgtcggcaagcacccagggtggctgctggttctaggtcgcaaaggcagagaattcggccagtcgtcagggtaccattattacccgcatcagagcaagccacccgtgtttcccgggaaatggcttaatggcatttacaacacaccccaagcaaggagccaaacggccgaagacaaaagggccgaatgcgaaattttgtgataggtatcacagcataggggggggaggggggtggccctccaaaatattctaagagcaaggggggccccccccccccccccaacaattaaaatagtcttatgtatgatgaagatgccaccccatcccggccaggagtccttcgttcccccgcggctttcacatattctggggggcgcgccgctgttttcggtacgcgcggtgcgttgccccaggccgctcccccgcctttcctggcgcgtagtttctcgcgctgtaccctttatatttttttggtgcccgtccgctacgtcggggtcgtttgtagtgggcgtgtggccaatccgcgcattgccggtattaacacaccattacaccgtaan

SEQ ID NO: 60285 - protein, 94 aa, Zea mays
  misc_feature: Ceres CLONE 1518986
MMKPSCVLLLSSLLVATLAATFSSSPPYSVGKHPGWLLVLGRKGREFGQSSGYHYYPHQSKPPVFPGKWLNGIYNTPQARSQTAEDKRAECEIL

SEQ ID NO: 60286 - DNA, 692 bp, Zea mays
  misc_feature: Ceres CLONE 1518987
  misc_feature: Encodes the peptide sequence at SEQ ID NO. 60287
aaagctggagctccccgcggtggcggccgctctagaactagtggatcccccgggctgcaggaattcgtctcacccctagaaaaaaccacacacgtcgtcgcgtacgcacgatcgatcttcttctggcactcgccgttgccagatacatggagggaaggaggcgtcggtcgccgtgccacggaagccgccggcggcggcttggggagatggctttggggcggaaagttcgcgagctccggcggctggtgcccggcgccgcggcgatgcctgccgagcgcctgctcctccgtaccgccgactacatcgtgcgtctccgggcgagggtcgagcttcttagggcgctgtcggagctcatcgccgcgactaaccatggcggggattggtggcggcgacggccatcacgacggtgacaccactagccatccctagctagtgctgggcctcagctcccgctatgtgatttggtgtggccgtacaaatcgtccacagccgaaggatcctggttatttgctgagttttaagcctgcaggccatgtataaatccatcaacccccgtttaattgttaaacggacctcccgaaaccccgcccggggggaaccatcttgccccccccgaaatttggttcccttccattccccaaaaaattttcccccctttaaaaaaaaaaaaaaacaagaccttcggggccccc

SEQ ID NO: 60287 - protein, 87 aa, Zea mays
  misc_feature: Ceres CLONE 1518987
MEGRRRRSPCHGSRRRRLGEMALGRKVRELRRLVPGAAAMPAERLLLRTADYIVRLRARVELLRALSELIAATNHGGDWWRRRPSRR

SEQ ID NO: 60288 - DNA, 783 bp, Zea mays
  misc_feature: Ceres CLONE 1518991
  misc_feature (415)..(415): n is a, c, t, g, unknown, or other
aaagctggagctccccgcggtggcggccgctctagactagtggatcccccgggctgcaggaattcgtctcacccctagaaaaaacgttgcttgctcccaagatcaagcgcctcccgcctccagcactcttaactcaggggacacgatcgccatggccgccacatcgaccgccgccgccgtgctgtgcccgccgtccgtggccgggctccgcctggcgccgtctcccggccgggcccgcttgccctaccgcgcagcccggcgaccgacctactgccccgcgccgtcctttccgggccggacctcaccgcgcattctttccccccccccttgtccccccccccctttcaaggtagaggttttatttgttatgggggggggggacccccccaccttctttaaaaaataaaggggaganacggcggccaagccgcagaaggaaaagagtgggcgaggtgagttgatacagagatggatgttataggccgccccgctttcccgtccaaccccgcccctgcagggacacctagacaagccgttactccctttacccccccccccccgcgctgtttacccaccagccatatccccctttccgatttccggccgcctccttcttatcctttttttttccccccacccttcatgcagcaccctgcccctcccctggtcttttgcgcggccgccaagggacgcgtcttgtccctctcccccgccaataaacatatctcacatattatcccacctcgacaccctcccgcgttgtctgattgtctccgtattatg

SEQ ID NO: 60289 - DNA, 655 bp, Zea mays
  misc_feature: Ceres CLONE 1518993
  misc_feature: Translation starting site: 218
  misc_feature (543)..(543): n is a, c, t, g, unknown, or other
  misc_feature (615)..(615): n is a, c, t, g, unknown, or other
ctccccgcggtggcggccgctctagaactagtggatcccccgggctgcaggaattcgtctcacccctagaaaaaacccacgccgtcggatcctcctgccctccccacgtccacctctctccgccgaagaatcggcggcggcggcggcggcggcgagcgccttcccttgtcaaaatccacccggcggcagagcagagcctcgttgctgaggaggggagatggcaggcatgaccgatatgccgatgaggccggcgcggccgggcccgccgatgcagcaccggggccctccgccgatggcgcgcctccgccccgaaccaatcgaccgcgagaagacctgccctctgctgctcagggttttcacaagggttgctggtcaccaccaaaatgaagagttttctgtgagagggaaagaccaaaggatgaagttcagatttacacatggaaggatgccactctccgtgagcttactgatcttgtgaaagaggttgctcttccagcaaggaaaggaacgcgaggctttcttttgcatttgtatacccagacnagaatggtcgtttttgtgtcagaacagtgggttcgaccttcgcttatggccatggaggaggtgatgatgccnaaactcttgcagaagctggggttccagattggcgattatt

SEQ ID NO: 60290 - DNA, 652 bp, Zea mays
  misc_feature: Ceres CLONE 1518996
  misc_feature: Encodes the peptide sequence at SEQ ID NO. 60291
  misc_feature (557)..(557): n is a, c, t, g, unknown, or other
aagctggagctccccgcggtggcggccgctctagaactagtggatcccccgggctgcaggaattcgtctcacccctagaaaaactctgccgtcgcctgtccactttccccgtgcttctccgccgtcgaggccgcgtcccagtgcgaagagactccgactcagatggccagccgctgggtccggcccgagcgcaggtgtacccgctgttcgcggcgacgggcgtggccgtcggcatctgcgggtttcagctcttccggaacatcactggcaacccggaagtcagggtaaacaaggcagggagggcagctggtgtgcttgagaaccatgaggaggggagacgttacgccatgcatggcctaagaagctttgtgcacgacaagactcctgagatcatgcctgcagttaaacagttcttcactgaccctaagtgaagcatgttgattggcatactactactactacttgctactggggatttttacactttgctggcaactcattatggtggggacatccatgacctctaaaagtactttgagcgctttggggatactggnaattgtatgatgggggaaaaagtttgaatcgcccctgctggaaggtcaaattcatccggcaatcggaatttcccccccctttcgggaaaaaattt

SEQ ID NO: 60291 - protein, 142 aa, Zea mays
  misc_feature: Ceres CLONE 1518996
  misc_feature (62)..(143): Pfam Name: B12D Pfam Description: B12D protein
AGAPRGGGRSRTSGSPGLQEFVSPLEKLCRRLSTFPVLLRRRGRVPVRRDSDSDGQPLGPARAQVYPLFAATGVAVGICGFQLFRNITGNPEVRVNKAGRAAGVLENHEEGRRYAMHGLRSFVHDKTPEIMPAVKQFFTDPK

SEQ ID NO: 60292 - DNA, 700 bp, Zea mays
  misc_feature: Ceres CLONE 1518997
  misc_feature: Encodes the peptide sequence at SEQ ID NO. 60293
  misc_feature (289)..(289): n is a, c, t, g, unknown, or other
  misc_feature (466)..(466): n is a, c, t, g, unknown, or other
  misc_feature (467)..(467): n is a, c, t, g, unknown, or other
  misc_feature (532)..(532): n is a, c, t, g, unknown, or other
  misc_feature (571)..(571): n is a, c, t, g, unknown, or other
ccccgcggtggcggccgctctagaactagtggatcccccgggctgcaggaattcgtctcacccctagaaaaaagcactagtctcctcttcgcacgagcgcaacaccatccacccaccagttcgaagcggaggcgaccggcaacctgcggcggagatgtcaggcaggggcaagggcggcaaggggctcgggaagggcggcgcgaagcgtcaccggaaggtgctgcgcgacaacatccaggggatcacgaagccggcgatccggaggctggcgaggaggggtggcgtgaancgcatctccgggctgatctacgaggagacccgcggcgtgctcaagatctttctcgagaatgtcatccgcgacgctgtgacctacacggagcacgcccgtcgcaaaaccgtcaccgttatggacgtcgtgtacgccctcaaacgccagggccgcactctctatggcttcggcggctanngtaggtgtgggtaattgcctgtccaggtgtctcggatctgtggtactagtttggctgcttccctnggttctattgtaatattggggaaactggttgctttgccncctggaatccggcttcctggggctgtaaaccccctggtccatgggatggattgggacgggaaaaagaagttggccggttaattttcccaaaaaaaaaaaaaacaaacctccagtcccaattcccctaag

SEQ ID NO: 60293 - protein, 108 aa, Zea mays
  misc_feature: Ceres CLONE 1518997
  misc_feature (25)..(94): Pfam Name: Histone Pfam Description: Core histone H2A/H2B/H3/H4
  misc_feature (45)..(45): Xaa is any aa, unknown, or other
  misc_feature (104)..(104): Xaa is any aa, unknown, or other
  misc_feature (105)..(105): Xaa is any aa, unknown, or other
MSGRGKGGKGLGKGGAKRHRKVLRDNIQGITKPAIRRLARRGGVXRISGLIYEETRGVLKIFLENVIRDAVTYTEHARRKTVTVMDVVYALKRQGRTLYGFGGXXRCG

SEQ ID NO: 60294 - DNA, 793 bp, Zea mays
  misc_feature: Ceres CLONE 1519000
  misc_feature (343)..(343): n is a, c, t, g, unknown, or other
  misc_feature (357)..(357): n is a, c, t, g, unknown, or other
  misc_feature (360)..(360): n is a, c, t, g, unknown, or other
  misc_feature (643)..(643): n is a, c, t, g, unknown, or other
  misc_feature (793)..(793): n is a, c, t, g, unknown, or other
tagctggagctccccgcggtggcggccgctctagaactagtggatcccccgggctgcaggaattcgtctcacccctagaaaaactccaaaccctagcccagagcagccgcatcgaactctacctgcctttctctcgtccctggcggcggcggcagggatggcggcttctactgcgaggacggtgaaggatgtgaaacccccccgagtttggtcagggctactcccgcccatctaaaacgttcccggcaagaaggactttcccggaggggcttcagcattctgaaggagcgcgccggttcaaaggaacccccctcccttagggacccggaacggggaactaccnatcaaggggggttntcngccagccacccaaccgaacccccccccccccgaacgggggggggggggggggttcccacccccatttatgaaaaaacatatccccccccccggtggggtgggggggggggtggccccccccagaagcatccaaaaaaggaattgtggtggggccctccggggttgcggccccccgcccccgtttaagaagggtttcttagacagcccatgccgctcaataggcgccgcctggtatgttttgtgcgcccggggcgcctcccggggggggggagggagccccacncgaattcccccccccccccgtccacaaagagaggggtgggccccccccctttgggggggcgtcctgagaattgtagaggagtccaccacgggccccgccgggacgcgcgttgggcgcgcttttggggaaagtggggccccccagcccccn

SEQ ID NO: 60295 - DNA, 687 bp, Zea mays
  misc_feature: Ceres CLONE 1519004
  misc_feature: Pfam Name: Adap_comp_sub Pfam Description: Adaptor complexes medium subunit family
  misc_feature (531)..(531): n is a, c, t, g, unknown, or other
caaagctggagctccccgcggtggcggccgctctagaactagtggatcccccgggctgcaggaattcgtctcacccctagaaaaaaaaaaaaagcataacagcggaagaaggggccccagaaaagaaggcgccgatacgggtgaaatttgagataccatatttcaccgtatcaggtattcaggtccgttatctgaagataattgaaaagagtggttatcaggcactcccctgggttagatatatcacaatggctggtgaatatgagctgagacttatatgagttctcttctctggctgccggacgacttttgaagctgcaggacactaaagatacatatttgctatcgacacagcgaacaatttttatttggatgttggcccggaagtcttctgccgaccatacaaggtcctcccctccccgtggtggggcttgctgttcatcttgttaggctcaccttaccgtggttattgtaagttacaaatcaagtacagtttttggaggaaggatattcagttttcaggtcacttgnatttgtaatgaattaattttgggggaccaaactagaattgtttcgttctgtaatacaccgaaaacttggctgattttgagtcaaaaaaccatgcccttctgcaattaattctgggtggggggttaaaaaaaaaaaaaaaaacaaaccctccgggtc

SEQ ID NO: 60296 - DNA, 663 bp, Zea mays
  misc_feature: Ceres CLONE 1519010
  misc_feature: Encodes the peptide sequence at SEQ ID NO. 60297
  misc_feature (408)..(408): n is a, c, t, g, unknown, or other
  misc_feature (437)..(437): n is a, c, t, g, unknown, or other
  misc_feature (438)..(438): n is a, c, t, g, unknown, or other
  misc_feature (446)..(446): n is a, c, t, g, unknown, or other
  misc_feature (449)..(449): n is a, c, t, g, unknown, or other
  misc_feature (450)..(450): n is a, c, t, g, unknown, or other
  misc_feature (454)..(454): n is a, c, t, g, unknown, or other
  misc_feature (460)..(460): n is a, c, t, g, unknown, or other
ggagctccccgcggtggcggccgctctagaactagtggatcccccgggctgcaggaattcgtctcacccctagaaaaagtgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacgggcaggagctgggacggccncacatcaccgtcaacgaggcccagtcccnngcgcgccntgnnagcngccgcngtgggtaccggtggtggccgtggaggcggcggctacggcggtggcggggcgccttgatggccgccggcgcctacggcggggggcggcggggggttaccggggggggggggggggcttaggggggggggggggggggggttccgcggggggggcaaccctggggggggggggtttctggaaacccctcaaggggggaagtgggg

SEQ ID NO: 60297 - protein, 133 aa, Zea mays
  misc_feature: Ceres CLONE 1519010
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (87)..(87): Xaa is any aa, unknown, or other
  misc_feature (90)..(90): Xaa is any aa, unknown, or other
  misc_feature (91)..(91): Xaa is any aa, unknown, or other
  misc_feature (93)..(93): Xaa is any aa, unknown, or other
  misc_feature (95)..(95): Xaa is any aa, unknown, or other
MAASDVEYRCFVGGLAWATDDHSLHNAFSTYGEVLESKIILDRETQRSRGFGFVTFSTEEAMRNAIEGMNGQELGRPHITVNEAQSXARXXSXRXGYRWWPWRRRLRRWRGALMAAGAYGGGRRGVTGGGGGA

SEQ ID NO: 60298 - DNA, 692 bp, Zea mays
  misc_feature: Ceres CLONE 1519011
  misc_feature: Encodes the peptide sequence at SEQ ID NO. 60299
  misc_feature (357)..(357): n is a, c, t, g, unknown, or other
  misc_feature (428)..(428): n is a, c, t, g, unknown, or other
  misc_feature (499)..(499): n is a, c, t, g, unknown, or other
ctccccgcggtggcggccgctctagaactagtggatcccccgggctgcaggaattcgtctcacccctagaaaaaaaaggaaaggacaaaggagcggcggcgaggtctatggcgtcgacggcggggtacctggcgcggcgggcggcgcaaaaggagcgggtgcgcctgctctaccgcagggcgctcaaggacacgctcaactgggccgtccaccgccacctcttctaccaggacgcgtcggatctccgggacaagttcgaggccaaccgacacgtggataacctggacgtggtcgataggctcatcgacgatgcggaggctcagtacaggaacttccagcaccccgatccctacattngtccatgggcaccaggcggcactaaattcacaagaaacccccctcccactcaagggatcgagatcatctancattatgggcagggagaccccagtaacagagtcctgcaagcgggggcagaacttccacagttccaaatcancttcctgttaaatcgagtttgtgtacgagaaatagaatggaaaatactggactccatcatgcttctcatttgcttggtctggaaatccaatgctcctcatccagggccaattgagttaaaaaaaaaaaaaaacgaggccctcagggacccaattccccctaaagggagccaattaccgccctcctgggccccc

SEQ ID NO: 60299 - protein, 195 aa, Zea mays
  misc_feature: Ceres CLONE 1519011
  misc_feature (13)..(78): Pfam Name: Complex1_LYR Pfam Description: Complex 1 protein (LYR family)
  misc_feature (84)..(84): Xaa is any aa, unknown, or other
  misc_feature (107)..(107): Xaa is any aa, unknown, or other
  misc_feature (131)..(131): Xaa is any aa, unknown, or other
MASTAGYLARRAAQKERVRLLYRRALKDTLNWAVHRHLFYQDASDLRDKFEANRHVDNLDVVDRLIDDAEAQYRNFQHPDPYIXPWAPGGTKFTRNPPPTQGIEIIXHYGQGDPSNRVLQAGAELPQFQIXFLLNRVCVREIEWKILDSIMLLICLVWKSNAPHPGPIELKKKKNEALRDPIPPKGSQLPPSWAP

SEQ ID NO: 60300 - DNA, 683 bp, Zea mays
  misc_feature: Ceres CLONE 1519012
  misc_feature: Encodes the peptide sequence at SEQ ID NO. 60301
  misc_feature (600)..(600): n is a, c, t, g, unknown, or other
ctccccgcggtggcggccgctctagaactagtggatcccccgggctgcaggaattcgtctcacccctagaaaaacctagaaaaaagacgcagctcgctctcctctcagcccccacccatcgagccgctagcgccagcgcccggcggcggtatggaggctggtggcgaggagttcgcgatcggcgtggtgctctccgccaagaccaccctgggggaggagttcgagggccagatcgtcgccttcgatcgaccctccaacctcctcgttatccaggagggtgtggggagggcggagagcggggagcggcggaacgtgagggtgctgaaggcgaactacatccgggagttctctgtgctcagcaagggagacgaccctctcgatcctgccggttgcatgctggaccttaactccatttatgcccgggaggatgctgcactcaggcaagcagagattgaagctgagaaaattggtgttggtgtcaccccagaagctcaaatatattcgatgcgctgtccaagacgcttccggtgcagtgggacaagactgacattgttgtaatgaaggaggttcgtgtacgcagcccgtacctgcctgaaaatngtagtggaggaacagctgcaccaaacgaacgcgttaagaaagtgattgacttttaaaaggaaaagataacttcacgtcgccct

SEQ ID NO: 60301 - protein, 135 aa, Zea mays
  misc_feature: Ceres CLONE 1519012
MEAGGEEFAIGVVLSAKTTLGEEFEGQIVAFDRPSNLLVIQEGVGRAESGERRNVRVLKANYIREFSVLSKGDDPLDPAGCMLDLNSIYAREDAALRQAEIEAEKIGVGVTPEAQIYSMRCPRRFRCSGTRLTLL

SEQ ID NO: 60302 - DNA, 665 bp, Zea mays
  misc_feature: Ceres CLONE 1519014
  misc_feature: Encodes the peptide sequence at SEQ ID NO. 60303
  misc_feature (437)..(437): n is a, c, t, g, unknown, or other
  misc_feature (519)..(519): n is a, c, t, g, unknown, or other
  misc_feature (586)..(586): n is a, c, t, g, unknown, or other
ctccccgcggtggcggccgctctagaactagtggatcccccgggctgcaggaattcgtctcacccctagaaaaaacgcacgccgccgcagccgccgccgctacagcccgcacctcgcttcctctcccgtcgccgagatgacgaagcgaaccaagaaggccggaattgttggcaaatatggaaccaggtatggtgctagcttgcgtaagcaaatcaagaagatggaggtatctcagcactccaagtatttctgtgagttctgtgggaagtttgctgtgaagaggaaagcggttgggatttggggatgcaaggactgtgggaaggtcaaggccggtggtgcttataccatgaacactgctagtgcggtcactgtcaggagcacgatccgtcgcttgagggagcagactgaagcatgatccgtcgcttgtcaggcatacntgggtccactatatttggctgtttagccgagacagtactccagcattttttgggtatgctctaggatctctaaaaagtgggntgctaagatttctacttgttttaccgtgtgaaaatttcacaagtgaaatctgatcctattactatcntgatgacctcaaatttgcttccggttttctaaaaaaaaaaaaaaaaaaccgaaaccttcgaggtaaccaaattccccct

SEQ ID NO: 60303 - protein, 92 aa, Zea mays; identical to SEQ ID NO: 7812
  misc_feature: Ceres CLONE 1519014
  misc_feature (2)..(91): Pfam Name: Ribosomal_L37ae Pfam Description: Ribosomal L37ae protein family

SEQ ID NO: 60304 - DNA, 685 bp, Zea mays
  misc_feature: Ceres CLONE 1519015
  misc_feature: Pfam Name: Nop Pfam Description: Putative snoRNA binding domain
ctggagctccccgcggtggcggccgctctagaactagtggatcccccgggctgcaggaattcgtctcacccctagaaaaaagaagttagtgaccttgacttatcgaatatcagagagctatgtgatcaagtgctggccctttctgagtacagagcccaactgtatgactatttaagaagcaggatgaacactattgcaccaaatttgacagcactggtgggtgaattagttggtgctcgccttattgcacatggtggaagttagttaaatttggccaagcagcctgttagcacaattcagatacttggtgcagagaaagctttattcagagctctaaagacaaagcattctacacctaagtatggcctcatctaccatgcatccttaattggcaaggcttctcaaaagcacaagggaaaaatctctcgttctcttgctgcacaaacagctcttgctatccggtatgatgcccttggagatggtgaggacaactccattggcactgagagtcgacttaagcttgagacacggcttcaagttcttgaggatagagaacttgtgaaatctgctggttcacaaaggtgaaacctaatatactagtgtatgacaatgaccggaagaatggtactggggctataacaactcctgctaatacatataaccctgcagctgatctggaactcac

SEQ ID NO: 60305 - DNA, 584 bp, Zea mays
  misc_feature: Ceres CLONE 1519016
ctggagctccccgcggtggcggccgctctagaactagtggatcccccgggctgcaggaattcgtctcacccctagaaaaagagccagccagtcagccagcaagtcgcttgggcgccatctctctagagcttcgtaccctcgaagagagatccggcgcggcccaataaacaccctgcttactacagactcgcagatgggcggcctcaggatgaagttcgtcgccgtctccgcgatgggcgctccgcttgtggcgtccgtcgcagccgacgaggatcacacccagatccgtagtcgatgcgggtgcctgaagtctagcgcggctcactgacagcgcactgtcatactctactgttatcgcgatgatgcgtgaatctgctcaaaaatcatcctctgccaggacactgactccactgtgaagccacgtgctctaacccagggcttccgactgggctgtaccatggaagggaccctcgcgggggggaactacatgttttcaattggagcccccctcccgggtttaaaaaaaccatggttttccccctcctgccaatcccaccccgggagggggtttgggggtattaaaa

SEQ ID NO: 60306 - DNA, 676 bp, Zea mays
  misc_feature: Ceres CLONE 1519018
  misc_feature: Encodes the peptide sequence at SEQ ID NO. 60307
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
agctccccgcggtggcggccgctctagaactagtggatcccccgggctgcaggaattcgtctcacccctagaaaaaagcgatcgcagagagttgcgcccggaccccggaccgcgccgacccggctcgcaaactcctccacaaccctcgtcgccgccggctgctccacccccgccaccgccatgggtaaattccgcaagcttggccgcaattactcccaacgcctctgcatgctcaggacgatggtgtcgcagctggtgaagcacgagcgcatcgagaccaccgttgccaaggcgaaggaggttcggcggaaggcggatcagatggtgcagctagggaaggagggtactcagcatgcagcaagacgtgctgctgcctttgttcggggtgatgatgtcgttcataagctatttactgagctggccttccgctacagagatcgagctgggggctacacaagaatgttaagaacaggatacgtgttggtgatgctgctccaatggcatacatcgagttcgtggacagggagaatgagcttcgagaggcaaacnnntgcacgcgcccgcgcctcacgagcccctcttgatcatgggccaagtcacgtgctagccacagtgggcaggacctaaatcaccaaaacctcggaatcgacggcttatgagctagtatacctatgtt

SEQ ID NO: 60307 - protein, 148 aa, Zea mays
  misc_feature: Ceres CLONE 1519018
  misc_feature (17)..(105): Pfam Name: Ribosomal_L17 Pfam Description: Ribosomal protein L17
  misc_feature (124)..(124): Xaa is any aa, unknown, or other
MGKFRKLGRNYSQRLCMLRTMVSQLVKHERIETTVAKAKEVRRKADQMVQLGKEGTQHAARRAAAFVRGDDVVHKLFTELAFRYRDRAGGYTRMLRTGYVLVMLLQWHTSSSWTGRMSFERQTXARARASRAPLDHGPSHVLATVGRT

SEQ ID NO: 60308 - DNA, 692 bp, Zea mays
  misc_feature: Ceres CLONE 1519020
  misc_feature: Encodes the peptide sequence at SEQ ID NO. 60309
  misc_feature (496)..(496): n is a, c, t, g, unknown, or other
  misc_feature (526)..(526): n is a, c, t, g, unknown, or other
  misc_feature (544)..(544): n is a, c, t, g, unknown, or other
  misc_feature (556)..(556): n is a, c, t, g, unknown, or other
tcaccgcggtggcggccgctctagaactagtggatcccccgggctgcaggaattcgtctcacccctagaaaaaattcacgcacctagggttttcgcgccgccgccgcagccgcaacaatgccgtcgcacaagaccttccggatcaagaagaagctggcgaagaagatgcgccagaaccgccccatcccctactggatccgcatgcgcactgacaataccatcaggtacaacgccaagcgcaggcactggcgccgcaccaagctcggcttctgagcgtcgggattggccggctgctgcgtcggaaggctagggtctaagagctatcttctgttttatcattgtctctgtttctgtaagctagcaagggatgctgtgatgcttttattaagattctgatgcccggtgaccttaaaagaaaaatggccgtactgtgttggaccccaagaatcctggcgcaattgctatgctaagtaaccaaccctttatcttattatanatcgtgggtttcagtgggtctgacgtcccncaaacccagaccccacgngtcgaaaccatntgttttgcgttacacgcaaaatcattcgctatccgccaacaaatatcttggccccccccgggggaacccccaatttcccccccaacttgaggggccggaattttcccccgccgcctccccgtgtccccgtttcctt

SEQ ID NO: 60309 - protein, 51 aa, Zea mays; identical to SEQ ID NO: 2355
  misc_feature: Ceres CLONE 1519020
  misc_feature (9)..(51): Pfam Name: Ribosomal_L39 Pfam Description: Ribosomal L39 protein

SEQ ID NO: 60310 - DNA, 672 bp, Zea mays
  misc_feature: Ceres CLONE 1519021
  misc_feature: Encodes the peptide sequence at SEQ ID NO. 60311
  misc_feature (672)..(672): n is a, c, t, g, unknown, or other
ggagctccccgcggtggcggccgctctagaactagtggatcccccgggctgcaggaattcgtctcacccctagaaaaaaagcgttccagatcgtactggaccaatctgccaccacactttgatcacacacaggaagttgagatcagaaaaatgcaggctgccgctactgccgccgggttctcggccgtgctgcccgccaagggcaggccggcggcgaggagcagggtggtggcccgtgtccccgccacaaggaggagcgtccgtgtagctgccgtcgtcgcgaccgaggccgcgcaaatcgactacagctcaagcgtctcggtgttcccgatggaggcctgcgacctgcttggtggcgacgcgtgcaacgggcccatgttccccgaggccaaacccgccctcggcggcggcggcggccaacaaggagtgtggtccggggtgaaaagggactaccttgtcctacgaccaagccaaaaaacggggtttccccggccaaaggcttggaaaataacgtttggccggccaagtttctgcgaagagggccctgtaaccagaagcgggttttcttccaggggaattttggccccccccccttaaaaaaacccccccaaaccccacccccttgttttggggggccccgcccccccaatatatgtgcccctgtttgttggn

SEQ ID NO: 60311 - protein, 148 aa, Zea mays
  misc_feature: Ceres CLONE 1519021
  misc_feature (1)..(116): Pfam Name: Lir1 Pfam Description: Light regulated protein Lir1
MQAAATAAGFSAVLPAKGRPAARSRVVARVPATRRSVRVAAVVATEAAQIDYSSSVSVFPMEACDLLGGDACNGPMFPEAKPALGGGGGQQGVWSGVKRDYLVLRPSQKTGFPRPKAWKITFGRPSFCEEGPVTRSGFSSRGILAPPP

SEQ ID NO: 60312 - DNA, 708 bp, Zea mays
  misc_feature: Ceres CLONE 1519022
  misc_feature: Encodes the peptide sequence at SEQ ID NO. 60313
  misc_feature (401)..(401): n is a, c, t, g, unknown, or other
  misc_feature (404)..(404): n is a, c, t, g, unknown, or other
  misc_feature (455)..(455): n is a, c, t, g, unknown, or other
  misc_feature (479)..(479): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
tggagctccccgcggtggcggccgctctagaactagtggatcccccgggctgcaggaattcgtctcacccctagaaaaagacaagcaccgaagacggcttgacgcccgaatccagaccctcgtctgttatggcggcggcggaggcggcgccaccgccgatactcgagctggacccgtcgcacgatcgagccgtcagcgttgtcgaggacatcgtgcgtctagagcggaggatctttccgaagcacgagtcgctggcgcggtccctgcacgacgagctaaagcggcggaactccgggctgatctacaagacgtccagcgccgacgagggggaggtcatcgggtatgccatgtacacatgcaacacatccctctgcgctaccatcaccaagctcgccgtgaanganaactgcaggcggcatggccacggcgaagcgctgctgccccccccattgaancggtgccggcggcggaaagtccancggctctcccctcacgtcgaccccacaaggacggctgccctggccctnnncctaggcgtcagtcacccgtagtatacctgagcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 60313 - protein, 140 aa, Zea mays
  misc_feature: Ceres CLONE 1519022
  misc_feature (91)..(91): Xaa is any aa, unknown, or other
  misc_feature (92)..(92): Xaa is any aa, unknown, or other
  misc_feature (109)..(109): Xaa is any aa, unknown, or other
  misc_feature (117)..(117): Xaa is any aa, unknown, or other
  misc_feature (134)..(134): Xaa is any aa, unknown, or other
MAAAEAAPPPILELDPSHDRAVSVVEDIVRLERRIFPKHESLARSLHDELKRRNSGLIYKTSSADEGEVIGYAMYTCNTSLCATITKLAVXXNCRRHGHGEALLPPPLXRCRRRKVXRLSPHVDPTRTAALALXLGVSHP

SEQ ID NO: 60314 - DNA, 677 bp, Zea mays
  misc_feature: Ceres CLONE 1519023
  misc_feature: Encodes the peptide sequence at SEQ ID NO. 60315
  misc_feature (514)..(514): n is a, c, t, g, unknown, or other
  misc_feature (628)..(628): n is a, c, t, g, unknown, or other
  misc_feature (677)..(677): n is a, c, t, g, unknown, or other
tccccgcggtggcggccgctctagaactagtggatcccccgggctgcaggaattcgtctcacccctagaaaaaagccaagcaaataagacgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacggctgcagctgcggtggcaactgcaagtgcgacccctgcaactgctgatcacatcgatcgacgaccatggatatgattattatctatctagcttgtggtggtggttgaaacataataagcgaggccgagctggctgccatacataggtattgtgtggtgtgtgtgagagaaagagaaacagagntcttcagtttgctatctctctctgcatggtttgcgtcagtctttgtgctcatggacgtacgtgggtctacttgcatggtggttgatcaatgccatctgctgtaaccaaaaatanttgctcccaccatgaatggatttgaacctatataatatctaaacccggn

SEQ ID NO: 60315 - protein, 76 aa, Zea mays; identical to SEQ ID NO: 8464
  misc_feature: Ceres CLONE 1519023
  misc_feature (1)..(76): Pfam Name: Metallothio_2 Pfam Description: Metallothionein

SEQ ID NO: 60316 - DNA, 688 bp, Zea mays
  misc_feature: Ceres CLONE 1519029
  misc_feature: Encodes the peptide sequence at SEQ ID NO. 60317
  misc_feature (495)..(495): n is a, c, t, g, unknown, or other
tggagctccccgcggtggcggccgctctagaactagtggatcccccgggctgcaggaattcgtctcacccctagaaaaaactgcgccatgggctccgcgccgtcgtcgtcccaatccccgtcgccgcacacgccttcaggacaaacccaagggaaagcagattataaatcactgagtgaagaggagtggaagaagcgcctgactgaagagcagtattatgttactcggcagaagggcactgaaagagcattcactggggaatactggaatactaaaaccccaggcatttatcagtgtgtctgctgcgacacccctctgtttcagtcatcaaccaaatttgatagtggtactgggtggccatcctattataaaccaattggtgaaaatgtcaagagcaagcttgatatgtcaatcatttttatgccccggacccgagtgctctgtgcaacctgtgatgctcatctggggcatgtcttcgatgacgggccaccaccnacaggaaggagaactgtatcaatagtgcatctctgaaattgaggccccataggtgctggaatctttagcagaagtcaactataccgctggcggccctagtaaacttcgggggtatgtaattaacccactccagtggaccaaattaataatccccttggaagggaaaaaaaggtttccaaaccgaataaagtta

SEQ ID NO: 60317 - protein, 147 aa, Zea mays
  misc_feature: Ceres CLONE 1519029
  misc_feature (31)..(147): Pfam Name: SelR Pfam Description: SelR domain
  misc_feature: SWISSPROT Homolog: EC 1.8.4.12 Peptide-methionine (R)-S-oxide reductase
  misc_feature: The sequence is a functional homolog of SEQ ID NO 12 in US patent 7220585
MGSAPSSSQSPSPHTPSGQTQGKADYKSLSEEEWKKRLTEEQYYVTRQKGTERAFTGEYWNTKTPGIYQCVCCDTPLFQSSTKFDSGTGWPSYYKPIGENVKSKLDMSIIFMPRTRVLCATCDAHLGHVFDDGPPPTGRRTVSIVHL

SEQ ID NO: 60318 - DNA, 613 bp, Zea mays
  misc_feature: Ceres CLONE 1519033
  misc_feature: Translation starting site: 362
  misc_feature: SWISSPROT Homolog: EC 5.2.1.8 Peptidylprolyl isomerase
  misc_feature (438)..(438): n is a, c, t, g, unknown, or other
  misc_feature (439)..(439): n is a, c, t, g, unknown, or other
  misc_feature (455)..(455): n is a, c, t, g, unknown, or other
  misc_feature (458)..(458): n is a, c, t, g, unknown, or other
  misc_feature (459)..(459): n is a, c, t, g, unknown, or other
  misc_feature (471)..(471): n is a, c, t, g, unknown, or other
  misc_feature (484)..(484): n is a, c, t, g, unknown, or other
  misc_feature (485)..(485): n is a, c, t, g, unknown, or other
  misc_feature (489)..(489): n is a, c, t, g, unknown, or other
ctggagctccccgcggtggcggccgctctagaactagtggatcccccgggctgcaggaattcgtctcacccctagaaaaagtgctttcttagaggtgggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcgcacctacggcgaggtcctcgagtccaagatcatcctcgatcgggagacgcagaggtcccgcggcttcggcttcgtcaccttctcccacgaggaggcgatgcggaacgccatcgagggcatgaacgggcaggagctggacggcccgcacatcacccgtcacgaggcccagtcccnncggcgccgtggaagcngcnngcgtgggtaccngtggtgcccgtgnnagcngcggctacggcggtggcgggcgccttgatggccgtggcggctacgggcgtgggcgcggctacggtggcggcggcgctaccgtggttggtgcggcggctaccgcggtggcaaccggggccgcggt

SEQ ID NO: 60319 - DNA, 658 bp, Zea mays
  misc_feature: Ceres CLONE 1519034
  misc_feature: Encodes the peptide sequence at SEQ ID NO. 60320
  misc_feature (494)..(494): n is a, c, t, g, unknown, or other
  misc_feature (580)..(580): n is a, c, t, g, unknown, or other
  misc_feature (584)..(584): n is a, c, t, g, unknown, or other
ctccccgcggtggcggccgctctagaactagtggatcccccgggctgcaggaattcgtctcacccctagaaaaaagcactcgtcagcccatatcagatcgactgctaagagagtcgtcccagactatcccgccgggtagctaaccttatcttcccatggagccagcgaagctcgcagctttccttgccgtcgctgccgtcgcctacgctgttgccgtcgcaccggctgccgcggaatactccggcggcgcgaccgccccagaaagctgccagacgcaaatcatgtacttcaccaactgcctggcccgtgatgagatccgcgggcagtgctgtagcgtggtcgagagccgcgagtgcctctgccagctgaagcgggaggtggcgctgccctgcagcctgcatcgccaccatcaacgcagatgctccaaggaagggtcgcctccacggtcggtgaagctggccgagctgcagcgcctcccatgctttcagacactncagtgctaggagcccgtacgaggtcgtatttttgttttgtgtacgtgtgcttttgtttgtttcacaattgttccttggtactgttnattncccattcagcttgctatggatgtaggcaaaaaaaaaaaaaaaacgagacgctcgaagtacccaattcgccctaa

SEQ ID NO: 60320 - protein, 115 aa, Zea mays
  misc_feature: Ceres CLONE 1519034
MEPAKLAAFLAVAAVAYAVAVAPAAAEYSGGATAPESCQTQIMYFTNCLARDEIRGQCCSVVESRECLCQLKREVALPCSLHRHHQRRCSKEGSPPRSVKLAELQRLPCFQTLQC

SEQ ID NO: 60321 - DNA, 613 bp, Zea mays
  misc_feature: Ceres CLONE 1519035
  misc_feature (314)..(314): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (612)..(612): n is a, c, t, g, unknown, or other
ggagctccccgcggtggcggccgctctagaactagtggatcccccgggctgcaggattcgtctcacccctagaaaaaagcaaggccaagaatgccacacccacccatggcgctcctcctctccccgaccgtttccttcctggtctcctcgtgtgctccacgccctcgagctctctccgctgccgccaatgtatcctaccccgcctcaagtgctgcaaatgcaagaatcctgatcctccccaacagtaaccccctcctgaaatgtgaactgccttacccggttggctttttttttccccccggaaaaaaaaaaanaagagcgggggttttttttttgcccccccccccccccgcgaaaaggggtttttacaaccgtgggggggggggaaacccccccagaagaggtctcaaaaacccccccccccccaaaatatgggtgggggggcccccccccccctttcttttaataaaaaaaaaaaaaaannnnnngnnnnnnnnnnnnnnnnggcggcnnnnaaaaaacgctgcagaaaaatttttttttttataaaaaaaaaggagaggggcggcccgcgtgtttttcttttttccttacaagaaaaaaattttatgng

SEQ ID NO: 60322 - DNA, 714 bp, Zea mays
  misc_feature: Ceres CLONE 1519037
  misc_feature: Encodes the peptide sequence at SEQ ID NO. 60323
  misc_feature (226)..(226): n is a, c, t, g, unknown, or other
  misc_feature (330)..(330): n is a, c, t, g, unknown, or other
  misc_feature (399)..(399): n is a, c, t, g, unknown, or other
  misc_feature (400)..(400): n is a, c, t, g, unknown, or other
  misc_feature (475)..(475): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (666)..(666): n is a, c, t, g, unknown, or other
  misc_feature (671)..(671): n is a, c, t, g, unknown, or other
  misc_feature (674)..(674): n is a, c, t, g, unknown, or other
  misc_feature (692)..(692): n is a, c, t, g, unknown, or other
  misc_feature (714)..(714): n is a, c, t, g, unknown, or other
acagctggagctccccgcggtggcggccgctctagaactagtggatcccccgggctgcaggaattcgtctcacccctagaaaaaagcagcagcacagtcatccacactaacgaacgaactgaggtcgacgacgactgatcgagcagcgacgatggcggctgtgctgaacagcaggaagacgccgcaggtggttgccgtgctggtggcggcggcgctgctggcgtcntccgcttcggcggcgatcacctgcgggcaggtggggtcgtcgctggctccgtgcatcccgtacgcgacggggagggccagcgcgctccccgcgtcgtgctgcancggcgtcaagagcctcaacagcgcggcgcggacccccgcggaccgcgggggggggtgcccctccctcannaccctccccaacagcgttcagagcgtcacactggggcaccgtccccgccatccccgggaagggcggcgttctcgntcggattccccatcagaatgtcccccgacggcacaaggaatacctaatttttcccacgaccgagtctaaagggcctccggaagttaaccggttctccccgggcggttnnnaaagtgatgaagcccgggaaagaaaaaaaatcaggcctcgggggtattggccaggaagacgcctgcagaattctgtcttantatanagncgggccggggggggcccntttgtggaagtgcaatgggggn

SEQ ID NO: 60323 - protein, 130 aa, Zea mays
  misc_feature: Ceres CLONE 1519037
  misc_feature (60)..(60): Xaa is any aa, unknown, or other
  misc_feature (83)..(83): Xaa is any aa, unknown, or other
MAAVLNSRKTPQVVAVLVAAALLASSASAAITCGQVGSSLAPCIPYATGRASALPASCCXGVKSLNSAARTPADRGGGCPSLXTLPNSVQSVTLGHRPRHPREGRRSRSDSPSECPPTAQGIPNFSHDRV

SEQ ID NO: 60324 - DNA, 673 bp, Zea mays
  misc_feature: Ceres CLONE 1519040
  misc_feature: Translation starting site: 142
  misc_feature: SWISSPROT Homolog: EC 1.8.1.8 Protein-disulfide reductase
  misc_feature (406)..(406): n is a, c, t, g, unknown, or other
  misc_feature (407)..(407): n is a, c, t, g, unknown, or other
  misc_feature (420)..(420): n is a, c, t, g, unknown, or other
  misc_feature (433)..(433): n is a, c, t, g, unknown, or other
  misc_feature (464)..(464): n is a, c, t, g, unknown, or other
  misc_feature (492)..(492): n is a, c, t, g, unknown, or other
aaagctggagctccccgcggtggcggccgctctagaactagtggatcccccgggctgcaggaattcgtctcacccctagaaaaaattcactcacccacctagctagtcatcactagtcacgttcgtccaccagagacaacaatggccatggagacgtgcttcagagcgtgggcgctgcacgcccccgctggcagcaaggacaggctcctcgtcggcaacctggtgctgccgtcgaagcgggcgctcgcgccgctgtccgtgggccgcgtcgccacgcgccggccgcggcacgtctgccagtccaagaacgcagtggacgaagttgtggtggcggacgagaagaaactggacgggttggtgatggcgtgcgagacgccggtgctgggtgaagttctgggcgccgtgnntgcgggcgtgccngatgatcgcgccngtgatcgacgagctggccaaggactacgccnggcagatcacgtgctgcaaggtgaacancgacgacagcccccacgtggcgtctacctacggcatccgcagcatccccaccgtgctcatcttcaagggcggccagaaaaaggaaagcgtcatcggggcccgtccgaagtcccacgctcaccaccttaatcgaaaatacatccgaagttcatgagcaagccatgccatgccctggaaactt

SEQ ID NO: 60325 - DNA, 667 bp, Zea mays
  misc_feature: Ceres CLONE 1519042
  misc_feature: Encodes the peptide sequence at SEQ ID NO. 60326
ggagctccccgcggtggcggccgctctagaactagtggatcccccgggctgcaggaattcgtctcacccctagaaaaaacaacaccagaatccgcgaatcacagacgcgtctatctcagcttgctgcactgcactaccctgccctgccatcatatcgtacgtgagcccggccgagcgagagcgagggagaggcatggctgctccgaagctcgcgacgctggcgctggccgtgctcctggcggcgaccgtggtggctcccccggccgcggtgcgcgcggcgatgtcgtgctccaccgtgtacagcacgctgatgccgtgcctgccgttcgtccagatgggcggggccatgccgccccagccgtgctgcggcggcatccgcagcctgctgcagcaggccaacaacacccccgaccgccgcaccatctgcggctgcctcaagaacgtcgccaacggcgccaaacgggagcggcacctacatcagccgcgccgccgcgctgcccagcaagtgcggcgtcgccctggccgtacagatcagcacccacgtttactgcaacacgattaaattaagtgatgaggcctccctggtcccctcccggggcaagaaaatctttccatgggcccttgcggaaaaaaaaaaaaaaaaaggcgccccgggtttttttacccc

SEQ ID NO: 60326 - protein, 122 aa, Zea mays
  misc_feature: Ceres CLONE 1519042
  misc_feature (32)..(117): Pfam Name: Tryp_alpha_amyl Pfam Description: Protease inhibitor/seed storage/LTP family
MAAPKLATLALAVLLAATVVAPPAAVRAAMSCSTVYSTLMPCLPFVQMGGAMPPQPCCGGIRSLLQQANNTPDRRTICGCLKNVANGAKRERHLHQPRRRAAQQVRRRPGRTDQHPRLLQHD

SEQ ID NO: 60327 - DNA, 588 bp, Zea mays
  misc_feature: Ceres CLONE 1519043
  misc_feature (132)..(132): n is a, c, t, g, unknown, or other
  misc_feature (149)..(149): n is a, c, t, g, unknown, or other
  misc_feature (178)..(178): n is a, c, t, g, unknown, or other
  misc_feature (184)..(184): n is a, c, t, g, unknown, or other
  misc_feature (185)..(185): n is a, c, t, g, unknown, or other
  misc_feature (205)..(205): n is a, c, t, g, unknown, or other
  misc_feature (206)..(206): n is a, c, t, g, unknown, or other
  misc_feature (217)..(217): n is a, c, t, g, unknown, or other
  misc_feature (218)..(218): n is a, c, t, g, unknown, or other
  misc_feature (224)..(224): n is a, c, t, g, unknown, or other
  misc_feature (239)..(239): n is a, c, t, g, unknown, or other
  misc_feature (273)..(273): n is a, c, t, g, unknown, or other
  misc_feature (274)..(274): n is a, c, t, g, unknown, or other
  misc_feature (302)..(302): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
ccacccgcggtggcggccgctctagaactagtggatcccccgggctgcaggaattcgtctcacccctagaaaaaattcgttgcagtagtcgcagctgacggacgactgaaccaccgacagacaacatggccngcctccgcctccaccgntctccgggggcctcgccggcgcctccctnggccanngccgcccggcgttctccacnncagcttcacgnncggggncaagccccgggtggntcggcgaaagaaacccccccctgaatggaagcanngaaaacctgggaaaaaaggaatgggcangaaatcacccttgccctttgaacgttttttttcccccccccgcgagaaaattggggggttttttcagaggaggggggaacccccctaaaggggccccccccccccccgccttttttggggggcccccccnnnncnnnnccccccgggggggggggggggggtaaaaaaaacccccccccccaaaaaaaaaaaaaaaaaacaacccgcggggggggttttttttttttcccccggggggggggggggggggggggggcgccctccccccccccccgccccccccccc

SEQ ID NO: 60328 - DNA, 686 bp, Zea mays
  misc_feature: Ceres CLONE 1519045
  misc_feature: Encodes the peptide sequence at SEQ ID NO. 60329
  misc_feature (503)..(503): n is a, c, t, g, unknown, or other
  misc_feature (597)..(597): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (643)..(643): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
ggagctccccgcggtggcggccgctctagaactagtggatcccccgggctgcaggaattcgtctcacccctagaaaaaatcccactcgcgccatcacccgacgcaaagaccactctcagccagcctcaaggcgcgcgcaacgccgctcctgcgcttgcgtgggtcgtcggcatggacaagcaggatgagaggaagaagccccacgggaaaacagaccccaagaggggcgacatcatgaagcggatcataaaggacctcaccggcggcggcaacgacggcggcggcggtgccagtgacggtggtggtaacagcggctccggctccacccccgctggcgccgactgacgcacatggcgcgtgcgtacccagttacgacggcaggggcgagcggtgagcccccgtgaatccgtgatggtttgtgtagttgttgctttctcgaatctggttatctggcaaggctagctgccggctgcgtatcgtacgttagtgtagggggcggtcancgttcggatggccggatgggtggtgtgcaatttaagactgtgctgtgtaacacttgggctcaataattggggatgatcaatcgatggggccgcnacccccgcacccattttgcgtccnnnnaaaaaaaaaaaaaaaaaanagaaaaaaaaaaccccggagannnaaaaaaaaaaaagaaagca

SEQ ID NO: 60329 - protein, 57 aa, Zea mays
  misc_feature: Ceres CLONE 1519045
MDKQDERKKPHGKTDPKRGDIMKRIIKDLTGGGNDGGGGASDGGGNSGSGSTPAGAD

SEQ ID NO: 60330 - DNA, 716 bp, Zea mays
  misc_feature: Ceres CLONE 1519049
  misc_feature: Encodes the peptide sequence at SEQ ID NO. 60331
  misc_feature (528)..(528): n is a, c, t, g, unknown, or other
  misc_feature (549)..(549): n is a, c, t, g, unknown, or other
  misc_feature (573)..(573): n is a, c, t, g, unknown, or other
ctggagctccccgcggtggcggccgctctagaactagtggatcccccgggctgcaggaattcgtctcacccctagaaaaaatccacaacactcatcgatctacacacatacatagtttcttctactacacgacgacaaacatggggaagcctgcgaagatcggagagtggggtggatacgccggcgatcgtcgggatctgagggctactccggaccggctgatcgaggtgaaggtcacggcggacaacagcagctgcatccgctccatctccttcatctacatcggagccgatggcaaaccgtacgaggaggggccatggggtttcggccatgctggcacggagtacaagattgatctgtgcaggttcgacgagagcttgacggagatctccgggaccacgggcccagccctacacatttgacatctggtcaagtctctcaaattcgtcaccaacaaacgcgcttacggaccgtacggcagggacgagggcaccccgttcccgtgtcaaggtgatgaaacaacgccancgtcgctggcttcttttgccngtttcttgaaatgccctggacccnatcgggctctacgtgaaccccccacttataactaaaccgatggatccgaacatctggatggcttgcaattccaatatgcatggctcctggcctgcttgaaccaaatttaaatgctaaaaaatacgcccctggtggctccaagt

SEQ ID NO: 60331 - protein, 93 aa, Zea mays
  misc_feature: Ceres CLONE 1519049
MGKPAKIGEWGGYAGDRRDLRATPDRLIEVKVTADNSSCIRSISFIYIGADGKPYEEGPWGFGHAGTEYKIDLCRFDESLTEISGTTGPALHI

SEQ ID NO: 60332 - DNA, 617 bp, Zea mays
  misc_feature: Ceres CLONE 1519052
  misc_feature: Encodes the peptide sequence at SEQ ID NO. 60333
  misc_feature (349)..(349): n is a, c, t, g, unknown, or other
ggagctccccgcggtggcggccgctctagaactagtggatcccccgggctgcaggaattcgtctcacccctagaaaaagtcctcggccttctgatggccgcctccctgtcgtgccagtgccacggcgcgcgcgacgtccccgcggagaagcccctccggccacagaacgtgttcgggttcggcggcttctacccgggccccaccgtcaactgggtgttcccgggccccaacggcgtcaccccgcaggtcggcttcggcgggatgccgggctctagcgccttcccgggcggcggtggcgtggtcggcatccacggtggtgctggtgctggtgccggtgccggtgccgtgncgaagaagccgtgagaggaggtggccgtgtgtctgtgagcttgcgatgctttgtgagagtgttgtcagtacgtgcataagcgagtctgtgtcttgtctttgctgcgctggctgtcgagacttcattctctacgtgtctcgggtcccttttatcctgaggatttgggggcaaggacttctttctcatcaatgggacccggctgctaggtgaattttcgaaccctttttcttccgggcggggttattccattccggattggaccccccaa

SEQ ID NO: 60333 - protein, 120 aa, Zea mays
  misc_feature: Ceres CLONE 1519052
  misc_feature (117)..(117): Xaa is any aa, unknown, or other
GAPRGGGRSRTSGSPGLQEFVSPLEKVLGLLMAASLSCQCHGARDVPAEKPLRPQNVFGFGGFYPGPTVNWVFPGPNGVTPQVGFGGMPGSSAFPGGGGVVGIHGGAGAGAGAGAVXKKP

SEQ ID NO: 60334 - DNA, 676 bp, Zea mays
  misc_feature: Ceres CLONE 1519054
  misc_feature: Encodes the peptide sequence at SEQ ID NO. 60335
ctccccgcggtggcggccgctctagaactagtggatcccccgggctgcaggaattcgtctcacccctagaaaaacccaccacaccaaaacccgcatccataaacaagaaaaagaaaagaaaacccccgctgccagcgacagaagaggaaggggtcccttctccttggttgcgttgcgcctccctcctgtctgcgtgcgtgcaatcgacgcagaggcgcgggcgctcgcaccaccacgaccacgacccgatggctttcatgcgctcccgctcaaatgcatcttctggcatgggagttgctcctaacattagggagacattcgtcgagcttcaaatgaagaaggcattccgatatgttatcttcgaaggggaagagaagcaaaagcaggtggttgtggaaaagacaggggctactactgaaagctatgatgactttttggcctctctcccagagaatgactgccgatatgcgctgtatgattttgattttgttactggggagaatgtgcagaaaagcaagattttcttcattgcctggtccccatcgacatcccgcatacgtgctaagatgcttgtactccccctccaaagaccgcatctagtacgaagcttgacgggttcccttaccaaatccggggaaccgaccccttcggaaggggacatccaaggttttccggg

SEQ ID NO: 60335 - protein, 142 aa, Zea mays
  misc_feature: Ceres CLONE 1519054
  misc_feature (18)..(139): Pfam Name: Cofilin_ADF Pfam Description: Cofilin/tropomyosin-type actin-binding protein
MAFMRSRSNASSGMGVAPNIRETFVELQMKKAFRYVIFEGEEKQKQVVVEKTGATTESYDDFLASLPENDCRYALYDFDFVTGENVQKSKIFFIAWSPSTSRIRAKMLVLPLQRPHLVRSLTGSLTKSGEPTPSEGDIQGFP

SEQ ID NO: 60336 - DNA, 894 bp, Zea mays
  misc_feature: Ceres CLONE 1519055-R
  misc_feature (657)..(657): n is a, c, t, g, unknown, or other
  misc_feature (754)..(754): n is a, c, t, g, unknown, or other
agcgtctcgtttttttttttttttttcctgtaaaagacctggaaactttggatgctatctcaaccatctcgttatctgatttcagcgatcagtgatgactgtcccccctttctcggtgttgcaatgaacagattcgttttctgtttttgtccaaaaagtgagaatacatgtcatctcatatatcgtgttgtaatctgtcattgctgaaacattaacttgtccttgctttgcagaattttccagggtgtataacaaatttatgcatcgacagcgtatctaactttgttgttcacataggactgagatctcttgcttgctccgaagacatagcatattttttcctcattgcctaatctatcaatgcttcagccaatcgaaaatatactcggttggcttatttgggttatcttcctcaagatcttccgggtctggatcggactcgtgtggctactcctgaggcggagcttggtctatcacttcctcttgaacatcaacataatgattggtgtttgcacatgtatgacgctatggtgtcttccttgagctgaactcatggaatatggcgcgactcctctcccgtatgtggatgttcaattcgatggcgcaattcaccggatgaccgcttggaaatcttctccttcttgagcgtcacgaacnattaggagcccctttcacggtgcttcaggctactttcaggggaaccatctttactacgcggatggtggaggttaaacacggcagaatctgagggaangcagggcggtcgtcatcctacggtcaggttttcccgggggggtgcggaaaacggggccaaagtttttccttatgggggggggaaaggaaaatcctagggggcccgtggggatatccttagggtctttaggctggcggccc

SEQ ID NO: 60337 - DNA, 631 bp, Zea mays
  misc_feature: Ceres CLONE 1519151
  misc_feature: Encodes the peptide sequence at SEQ ID NO. 60338
aaagctggagctccccgcggtggcggccgctctagaactagtggatcccccgggctgcaggaattcgtctcacccctagaaaaagatcctccgcttcccgtcccagcctcagttggcatcggctacgagcctgcgcaagctcatccgtcagatctcagacttcatgcttggcgcgacacactgagaaggattgcctgaggcagtcaaaggttttcctgacctcagagaaatctgggaagggtgagaagcctggctagggcggctacggattctggaagaccattgggcttggcttctagactcccaggtaagcactcgaatgaacctacattggatataaaggcccattcactggaactggctctatttgaggcgtaattatcgctggcacatgccacactgctaatatgaacagaactatcattgttcgcatgaactacctccactttgtgaagaaatacctgaggtatgagaagaggcactccaacattcctgctcacatctctccatgcatccctgtgaaggaaggtgaccatgtcatcaattggacagtgcaggctcctgtcttcaaactgtgaggttcaatgtcattgaagtcattccaggctggaatccgcagctgctggaaaag

SEQ ID NO: 60338 - protein, 56 aa, Zea mays
  misc_feature: Ceres CLONE 1519151
  misc_feature (1)..(52): Pfam Name: Ribosomal_S17 Pfam Description: Ribosomal protein S17
MNRTIIVRMNYLHFVKKYLRYEKRHSNIPAHISPCIPVKEGDHVINWTVQAPVFKL

SEQ ID NO: 60339 - DNA, 837 bp, Zea mays
  misc_feature: Ceres CLONE 1519194
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (33)..(33): n is a, c, t, g, unknown, or other
  misc_feature (35)..(35): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (366)..(366): n is a, c, t, g, unknown, or other
  misc_feature (720)..(720): n is a, c, t, g, unknown, or other
  misc_feature (837)..(837): n is a, c, t, g, unknown, or other
nnnnnnnnnnnnnnnnnnngggggggttaaaancntctnnnnnnnnnnnnngaaagctggactccccgcggtggcggccgctctagaactagtggatcccccgggctgcaggaattcgtctcacccctagaaaaaacttgtgttgcgtacgtcggtcacatgcattgcatctgcatccggagtagcgagttctagacacagcaggcaacagactgaggtagcccagcgagcgagcgagcaatggcaaccctcagcgccgcccccctcgtcggcgcggccgccgtcgccaggccgtgtcaggctcaaggtttgccgcagctgacggtgagagccgacaaggcccggtggcggcgccgcccactcgangcgggccgagccagccggcgggacggcaacaacgggagcgtcgttcttcgcttccgccccgtggggggggggggggggtggaacacgtttccccccgcgcctggccccccccctgtatcgagcgaaatgctccaacaagaagcggtaccgggtggttctcgccttgtgatcctccactcaaccacacccgggctggggggggggaacccgcgagctcgcgcccgaacttgcgtacactcaattttgtgtttttcttttaactagaggagtgaaagtcccccccaagaccgcgctcggaaggtcctcactcttcttgctggctcccccactcccttttccgatactttatgtctnccgttaattttaatccaccaccccccacaaccccctccttacaatatatacaacatttatctctatcgataatattctaatatctttttcttctctgctcttagaggaatagaggan

SEQ ID NO: 60340 - DNA, 656 bp, Zea mays
  misc_feature: Ceres CLONE 1519196
  misc_feature: Encodes the peptide sequence at SEQ ID NO. 60341
aaagctggagctccccgcggtggcggccgctctagaactagtggatcccccgggctgcaggaattcgtctcacccctagaaaaaaaaaaagctccccaacgaagtgcgagcgaccctcgtccacacgacacgaaccaccaccaccaaccagcagccgcaccacgcacccagcgcaaagcgatggcgtccctcagcatgatggcgtccttcgccaccatggcggtggccacgccatctcgccgcgccaccttcgccgtggtcaggtccgccaaggtctaccgctgccaggagcccgccacactatcaacaaccgaggccaggcccgccgccgagggacgccgcgccgtcatgctctgggctgctgcggcggccgtggtacccgtcggcggagcccgcgccgcaatggcaggccccaacaacggcaccccagaggcaaaaaagaaggacgagctcatctgcgtgaccatgcccaccgacaaggtctggcagaactgaacacgccctcgttgcagctgcagggccggagggatgtatataattaatgtacgtgccacgatgtggctgtccctattgctggctcgagctctacacgcgtgccagacgtgaggccacttcattgcttgcagacagactctgagctgtactaataccaagtg

SEQ ID NO: 60341 - protein, 104 aa, Zea mays
  misc_feature: Ceres CLONE 1519196
MASLSMMASFATMAVATPSRRATFAVVRSAKVYRCQEPATLSTTEARPAAEGRRAVMLWAAAAAVVPVGGARAAMAGPNNGTPEAKKKDELICVTMPTDKVWQN

SEQ ID NO: 60342 - DNA, 660 bp, Zea mays
  misc_feature: Ceres CLONE 1519229
aagctggagctccccgcggtggcggccgctctagaactagtggatcccccgggctgcaggaattcgtctcacccctagaaaaacagcccacatagatctttcccccgtcctccctcgccttcgcctcgccggagggagatttccaccaccaccgccggaccaccccgaccctccttccctctcgcgctatggcccaggactgttgtgctcaagggtggcatgtcctgtgagggctgtgttggagctgtcaagcgcgtcctgagcaagatggaatgcgtcgagtcctaccacatagacatcatgtaacagaaggacaccgtgaaggggaatgtgacacctgacgccgtcctgcaaactgtttccaagactggcaagaagacttcgttctgggaggctgaggccatgacaagtgaatccgccacacctgacggctccaccgcctgacaggttcgatgatctggaagtgcccgccaaaaaaactgtgatgtattttagcttggatctggtacaaataattgcaaactgctagctcgaactcgacattatacacctcgctatgtgtatactgtgcagccctcgcacaaaaacaagaaaacgagacgctccatgtacccagttcgacccatagtgagtcgaattaaccacggctcctggccgtct

SEQ ID NO: 60343 - DNA, 699 bp, Zea mays
  misc_feature: Ceres CLONE 1519234
  misc_feature: Encodes the peptide sequence at SEQ ID NO. 60344
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (74)..(74): n is a, c, t, g, unknown, or other
  misc_feature (85)..(85): n is a, c, t, g, unknown, or other
  misc_feature (86)..(86): n is a, c, t, g, unknown, or other
nnnnnnnnnnnnnnnnnnnnnnnnnnnnnnnnnnnnnnnnnnnnnnnnnnnnnnnnnnnnnnnnnnnnnccccngggggtgtttnnttcaaagctggggctccaccgcggtggcggccgctctagaactagtggatcccccgggctgcaggaattcgtctcacccctagaaaaaactcccttctccgccgccacgctagagaggaagagcgcgcggagagcgagagcccgggagaaacagcggccggcggcaaaatggtgcagcggctcacctaccggaagcgccacagctacgccacaaaatccaatcagacccgcgtggtcaagacccctggtgggaggcttgtgtaccagtacaccaagaagcgcgcgagcggaccgaaatgcccggtcaccgggaagaagatccaaggaattccacacctgagacctgctgagtacaagaggtctaggttgccaaggaaacgcaggactgtgaaccgtccatatggtggtgttctgtctggtaccgcagtcagagagaggatcatccctgcctttttggtcgaggagcaaaagatcgtgaagaagggttttgaagatccaaaagacaagggattagggcttcaaagaactaggcgaaaataggcatccttcccaaatgttcaaggcccccttagaaggatatgggtttaaaattttggaaccggaaagtttgccg

SEQ ID NO: 60344 - protein, 123 aa, Zea mays
  misc_feature: Ceres CLONE 1519234
  misc_feature (5)..(103): Pfam Name: Ribosomal_L34e Pfam Description: Ribosomal protein L34e
MVQRLTYRKRHSYATKSNQTRVVKTPGGRLVYQYTKKRASGPKCPVTGKKIQGIPHLRPAEYKRSRLPRKRRTVNRPYGGVLSGTAVRERIIPAFLVEEQKIVKKGFEDPKDKGLGLQRTRRK

SEQ ID NO: 60345 - DNA, 927 bp, Zea mays
  misc_feature: Ceres CLONE 1519283
  misc_feature (13)..(13): n is a, c, t, g, unknown, or other
  misc_feature (19)..(19): n is a, c, t, g, unknown, or other
  misc_feature (20)..(20): n is a, c, t, g, unknown, or other
  misc_feature (591)..(591): n is a, c, t, g, unknown, or other
tttttgggggggntggttnnttttttttttttttttttttttgttgtgttggtgcaatctggcgtccaccttgatggcggccgctctttaactattggatcccccgggctgcaggaattcgtctcacccctagaaaaaacgccgccggcagcggcggccgaggacctgatcgagatcgtggaggaagggtcggggcggctggacatcactcgggacggggacgacgggtgctacctgtcggcgggcgccatcgcggacgttcgagggggaggacgggggaccactttcggggggggtgcgtgggggagttccatgatacagggctatactcgtctgctcccgcttccctctcttggccggccccacgggttcggccgcctcgtgtctcctcggaacggctctccccgccctgccccggggcggggatgtcatctgttctcggagcgtactctatctatgagcgggggaaggaggtttttattctttctactcttggcgtgcggcctgtccgcccagcccctaagacgtgggctgtcccccttccttttgtttggcccgaaacatattatttcccggtggttgttacccatncgagagcttctatagtggtcgatagccttggagtctcagcaccctgcgcaccacccacctgtgattttgtctattcattgcgtatatctgtctcggggcagatgaccccagccgcgagtccgcccagagatcagagtggaccctagtcggccggcgcccgcacataccagccgtggccagggcggcggcccctcccccccccctcccccttttttgcgctatcgtcgagcttactcgccgggggggtcgctgcttgcgggcttactcctctttcgtgtgctccccctccctctactctgccccccggctcctgcaaccacccggtcgcctttgcgg

SEQ ID NO: 60346 - DNA, 721 bp, Zea mays
  misc_feature: Ceres CLONE 1519284
  misc_feature: Encodes the peptide sequence at SEQ ID NO. 60347
  misc_feature (22)..(22): n is a, c, t, g, unknown, or other
tatccctacacatatttatttncgttcggggctttatttacaaaaagagggtgggggggggggcaagctggagctccccgcggtggcggccgctctagactagtggatcccccgggctgcaggaattcgtctcacccctagaaaaactctctagcattacccggcggcggaagcgtaagcgcaaaacgaagcaagcggccgccatggtgaagggacgcacgggacagcgcgtcaggctctacgtccggggcaccatccttggatacaagaggtccaagtcgaaccagtacgagaccacgtctctcgtgcagatcgagggggtgaacaccaaggaggatgtcgcgtggtacgctggcaaggcgcatggcgtacatctacaagggcgagaccaagagcagtgagacccgctacaggtgcatctggggcaaggtgggggggtccacacggaaactcggggggcggccgtgccaaggtggggtgcaaccgcccgccgggaggcgtgggggggcaaggtccagagtgtgcgtggagccggaggcgcagcgtaaggggggggggggggggggagatggggggatagaaggcggagtgtgggtgtgggcgggggctgtgccggggaagggggaatgagggccgcgcggggtgggggagcggagggggggtggctaggcgggggcgggcggggacgcggaaaggtgccgcgcggaggggagggtgggtg

SEQ ID NO: 60347 - protein, 65 aa, Zea mays
  misc_feature: Ceres CLONE 1519284
  misc_feature (12)..(59): Pfam Name: Ribosomal_L35Ae Pfam Description: Ribosomal protein L35Ae
MVKGRTGQRVRLYVRGTILGYKRSKSNQYETTSLVQIEGVNTKEDVAWYAGKAHGVHLQGRDQEQ

SEQ ID NO: 60348 - DNA, 666 bp, Zea mays
  misc_feature: Ceres CLONE 1519298
  misc_feature: Encodes the peptide sequence at SEQ ID NO. 60349
  misc_feature (666)..(666): n is a, c, t, g, unknown, or other
gctctagaactagtggatcccccgggctgcaggaattcgtctcacccctagaaaaataccaccagtaccacaccactccgcgctagctgaggacggtacagcggcacagaggtgcgacgtacgacgacgacgacgcaggcgccacacatggcatcccagctctccgccgccgtgccccggttccacggcctccggggctacgccgcgcccaggtccgcggtggcagcgctgccgtccgtgagggtgggcaggaagaggtcgtcgtcgcatggcatccgctgcgactacatcggctccgccaccaacctgatcatggtgacgacgacgacgctgatgctgttcgcggggcggggcggggtggcgccgtccgcaaaccccaaggcgacgcctggtctgattctggaggcacgcgactccgggctgcatacggggtgaccccgccgggttcaccctcgcccaaacgttggcctgcggcgccgttcggcacttccctcggcgtcgggctcggggtccgggttcaaaaaacccggtgtccttcaaccagaatcagcgggggaagatcccctaacgccggccgtggttaaggatctggatctcattagacccttggttcgacccccgccgggcccggcccggtgacccttgcaaggtgagtataatttttgn

SEQ ID NO: 60349 - protein, 95 aa, Zea mays
  misc_feature: Ceres CLONE 1519298
MASQLSAAVPRFHGLRGYAAPRSAVAALPSVRVGRKRSSSHGIRCDYIGSATNLIMVTTTTLMLFAGRGGVAPSANPKATPGLILEARDSGLHTG

SEQ ID NO: 60350 - DNA, 538 bp, Zea mays
  misc_feature: Ceres CLONE 1519301
  misc_feature (192)..(192): n is a, c, t, g, unknown, or other
  misc_feature (476)..(476): n is a, c, t, g, unknown, or other
  misc_feature (477)..(477): n is a, c, t, g, unknown, or other
aaagctggagctccaccgcggtggggcggccgctctagaactagtggatcccccgaggctgcagggtattcgtctcacccctagaaaaaaagccactccgaggccaagtctagggtttgggaatctgtaggaggggagaggggagcgcgctcagggtcagggaggcgaagatgatcgagggtggtgctgaancgaccgcctggggaagaagtgcgggtgaagtgcaacgaggacgacacccatcggcgaccctcaagaaaacttgtgggcggccccagaacgggggaccccgccccccgaaaaaaatctccccttcccccgaaaaagggggtgtcccaaacacttcttttccaaaggggggcccccacttttttccccgcttctctttaagggggggcccctcctcccccaaaaaattcctcccccccccccccccccccgggggtgttgtggggggggcccctccccccccacannccccttttttttttataaaaaaaaaaaaaagggggccccccctttttaccccccaccacaa

SEQ ID NO: 60351 - DNA, 675 bp, Zea mays
  misc_feature: Ceres CLONE 1519308
  misc_feature: Encodes the peptide sequence at SEQ ID NO. 60352
aagctggagctccccgcggtggcggccgctctagaactagtggatcccccgggctgcaggaattcgtctcacccctagaaaaaatcacaattcactccactcatcttttcgcgtttagaacctctaaaatttcccccactcgccagtcgcagcagcacctgtagccatggacgccagcggagccggtagcaaggggaagaagggtgcggccgggcgcaaggcaggcggccccaggaagaagtcggtgacgcggtccgtcaaggccgggctgcagttccccgtcggccggatcgggcgctacctgaagaagggccggtacgcgcagcgcgtgggcactggcgcccccgtctacctcgccgccgtcctggagtacctcgccgccgaggttctggagttggcagggaacgcgccaaaagacaacaagaagacgcgcatcatcccgcgccacgtgctcctggcgatccgcaacgacgaggagctcgggaagctgctgggaggcgtcaccatcgcgaacgggggcgtcctccccaacatccactccgtgctcctgcccaagaaggcgggcggataaggcggccagcgcccggcacaaaggagcccaaagcccccccaagaaaggcccccagtcccccccaaaaaggcctaaaaaaagaagggaacttcattttgcccctg

SEQ ID NO: 60352 - protein, 134 aa, Zea mays
  misc_feature: Ceres CLONE 1519308
  misc_feature (29)..(102): Pfam Name: Histone Pfam Description: Core histone H2A/H2B/H3/H4
MDASGAGSKGKKGAAGRKAGGPRKKSVTRSVKAGLQFPVGRIGRYLKKGRYAQRVGTGAPVYLAAVLEYLAAEVLELAGNAPKDNKKTRIIPRHVLLAIRNDEELGKLLGGVTIANGGVLPNIHSVLLPKKAGG

SEQ ID NO: 60353 - DNA, 573 bp, Zea mays
  misc_feature: Ceres CLONE 1519345
atagctggagctccccgcggtggcggccgctctagaactagtggatcccccgggctgcaggaattcgtctcacccctagaaaaaacctcaccactagtctcctcttcgcacgagggcaacaccatccacccaccagttccaagcggaggctaccggaaacctgcctcggagatgtcaggcacgggcaagggctgctaggggctcgcgaacgggcggctcgaagcgtcaccggaaggtgctgcgcgacaacatccaggggatcactaacccggctatccggacgctggctacgaggggtggcttgaaccccatctccggactgatctactacgagaccctcggcgtgctcaagatctttctcgagaatgtcatccgcgacgctgtgacctacacggagcactcccgtcgcaaaatcgtcaccgctatcggacgtcttagtacctccctcaaaacgcccaggggccaggatttcccccttaggttttctcccggggttattttttaagagggggggcggaaatattggcgccttcacaaaaaaggttttttctcccaaaaactcttttgagaaaa

SEQ ID NO: 60354 - DNA, 639 bp, Zea mays
  misc_feature: Ceres CLONE 1519362
  misc_feature: Encodes the peptide sequence at SEQ ID NO. 60355
aaagctggagctccccgcggtggcggccgctctagaactagtggatcccccgggctgcaggaattcgtctcacccctagaaaaagtgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtccccgcgcggccgtggaaggcggcgcggtgggtaccgtgggtggcggtggaggcggcggctacggcggttggcgggcgcccctgatgggcggcggcggctaccgcgggtggcgggcgcggctacggtgggcggggggggctaccggtggtggggggcggcgggcttacggcggtgggcaacccgtggcggggggcttccg

SEQ ID NO: 60355 - protein, 152 aa, Zea mays
  misc_feature: Ceres CLONE 1519362
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAASDVEYRCFVGGLAWATDDHSLHNAFSTYGEVLESKIILDRETQRSRGFGFVTFSTEEAMRNAIEGMNGKELDGRNITVNEAQSPRGRGRRRGGYRGWRWRRRLRRLAGAPDGRRRLPRVAGAATVGGGGYRWWGAAGLRRWATRGGGLP

SEQ ID NO: 60356 - DNA, 671 bp, Zea mays
  misc_feature: Ceres CLONE 1519370
  misc_feature: Encodes the peptide sequence at SEQ ID NO. 60357
ctccccgcggtggcggccgctctagaactagtggatcccccgggctgcaggaattcgtctcacccctagaaaaagcggcggaaggagaagtgcaaggaagcaggcggccaccatggtgaagggacgcacgggacagcgcgtcaggctctacgtccggggcaccatcctcggatacaagaggtccaagtcgaaccagtacgagaccacgtcgctcgttcagatcgagggggtgaacaccaaggaggacgtcgcgtggtacgctggcaagcgcatggcgtacatctacaaggctaagaccaagagcagcgagacccgctacaggtgcatctggggcaaggtcacccgcccgcacggcaactcgggcgtcgtccgcgccaagttcaagtccaacctcccgcctgagtccatggggcgcaaggtcagagtgttcatgtacccgagcagcatctaaggttttttgtggagtaaaggtggactctaaatggccatgcttagttcttctctctgagcttaaaatgccatggtgttggcaacttaagattgttcatgtactgaaccctgtttgaaattctaccaaaattttgttgtccaaccggcctgaaccagttgcccctaatggtaatgcttataaacagagtcttatttccccccccgtggccaaaaaaaaaaaa

SEQ ID NO: 60357 - protein, 112 aa, Zea mays; identical to SEQ ID NO: 59047
  misc_feature: Ceres CLONE 1519370
  misc_feature (12)..(106): Pfam Name: Ribosomal_L35Ae Pfam Description: Ribosomal protein L35Ae

SEQ ID NO: 60358 - DNA, 557 bp, Zea mays
  misc_feature: Ceres CLONE 1519385
  misc_feature (121)..(121): n is a, c, t, g, unknown, or other
  misc_feature (269)..(269): n is a, c, t, g, unknown, or other
aaagctggagctccccgcggtggcggccgctctagaactagtggatcccccgggctgcaggaattcgtctcacccctagaaaaacttccaccacgcagtcactcccgggccgccgccgccngccgcctccgcgtaaaaaccctcagcagggcttcgccgctatcactccaaggggcgcgaccatggtggccacaaagaagacgaagaaatccacggacaacatcaataacaagctgcagcttgttatgaagagtggcaagtacactctncggctacaagacccgtcctcaggaactctccaggaaactctaaagtcgaaagcctaggggaatcattcgcctaaacaaactggccccgccccccttccgaaaggctgaaaatggagtactttgctttggctgggcaaaggcccctgtccccccctttccatggaaaaaatggtcaaccctggaaaccccccggggggaaaaaacttttccggggccccggggcccccaaatttttttggaccccgggggggtttccggatattcccccccaaaaaacaccccccccgg

SEQ ID NO: 60359 - DNA, 831 bp, Zea mays
  misc_feature: Ceres CLONE 1519387
  misc_feature (16)..(16): n is a, c, t, g, unknown, or other
  misc_feature (17)..(17): n is a, c, t, g, unknown, or other
  misc_feature (25)..(25): n is a, c, t, g, unknown, or other
  misc_feature (26)..(26): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (40)..(40): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
tttttttttttttttnntttttttnntaaggggnnnnaantcttttttnnnaaaagccggactccccgtggtggcgggcgctctagaactagtggatcccccgggctgcaggaattcgtctcacccctagaaaaaacatccagtgctctctcctcttgcgattcgctcgctcgatcctagcttcccttccaagaagcgcagcgcccatggccatggccacgcaagcctccgccgccacgcgccacctgctggccgccgcctgggggccaggggcgaacacgcagaaacttaactcgaagttcgtgctgctgttggggtcctcccgggcgtcggcgtcgccccgcgggcccccgaggaggcgtggcgaggcgcccccagggggccccgccccacccagcttgggatccgggatcccccccccccccccccacggggggggggggggggggggccacccatcaaccccatacctgcacaaacggaagggtgtgtgagcaacgaccgatttccgaacttctatccagtcgccgccgcccccctggcaataattttctaaagcgttatagcgatgccactatacgaaacacgcccaacaagaatacctcttgcccccttcgccgccctcgggcccccccttgtggaggatggcttgttcgcctggcccgttggtctcgcgtcctctcggggccgccgatcgcacggttgcacctgattttatcatcgcgcgccccgccgccccgcgccgctggcgcaacaaagctcacacgaatcacccaacacccacacacccttccacccactcccatgcgaacccccacccacataataccg

SEQ ID NO: 60360 - DNA, 791 bp, Zea mays
  misc_feature: Ceres CLONE 1519388
  misc_feature: Encodes the peptide sequence at SEQ ID NO. 60361
  misc_feature (9)..(9): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
ttttttttntnnnnnnnnnnnnnctttgcgggggtgttctcctttttttgtttttttcaaagctggagctccccgcggtggcggccgctctagaactagtggatcccccgggctgcaggaattcgtctcacccctagaaaaaaccactcccagtcccagtctcccaccgtcccacgaaacacactcaactctgccccgaagcggagaaccgccagccagacatgaagagaaccagagcgcagcagcccaaggtcgaggagccgcaggacctcgccgccaacctaaagccgcagcgccgggacaaacagccgaggcagcccaagtcaggcgccaaagcgaagcccgcggcgggcccgcgcgtcgcggcggccacaaccctcgccgccgccgccgccgcagcagcggcagcagcgaatgccggcctcggcccgcgtcggtgggccggggcccggaaaagggctcccaaccgtgcccggacgctcggccctccggcgggggaaaaaaggaacggggaaccccccaactcctcagccccgagccgcccggcgtgaccgggggacccctcgaccccccgcgccttaaccaacccaccctactttgggcggagaccgtggggggcgtttggggaacgatagaaaagaaaagaagggccgttctacgctggggaccctccccctccccgggagataagaagaaaaacacatcttcgcggcggcgccgccccgccggggggtgggccagacccccgagcaagaagagggggtggtgggggccccagtgtggggaaaaaa

SEQ ID NO: 60361 - protein, 109 aa, Zea mays
  misc_feature: Ceres CLONE 1519388
MKRTRAQQPKVEEPQDLAANLKPQRRDKQPRQPKSGAKAKPAAGPRVAAATTLAAAAAAAAAAANAGLGPRRWAGARKRAPNRARTLGPPAGEKRNGEPPNSSAPSRPA

SEQ ID NO: 60362 - DNA, 839 bp, Zea mays
  misc_feature: Ceres CLONE 1519654
  misc_feature: Encodes the peptide sequence at SEQ ID NO. 60363
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (57)..(57): n is a, c, t, g, unknown, or other
ggggacgtgggcggatagggtgctctctatgggggtggtggnnnnnnaccgtattgntaaaactggaactccaccgcggtggcggccgctctagaactagtggatcccccgggctgcaggaattcgtctcacccctagaaaaaagtccatcaggcatccaagcttaaagcaagcagatctaagctccaggcagcgtcgcgacagagtgagtgagtagcacgacaacaacaatggcttccctgaaggccgcgaagcccagcggagttgcggcgcagggcaaggagccggcgcccaagctcagcgagacggcgacgaatccgtcagccgcgaatagcggcggcgttaaaaaagctgagcaaaaacccccgggaaaccaaaaggaaggtgaaagagcaagcaaaccgggcgggcggcggggcaaaaaagtggacgtaccagtaaccggcgggaagtgtgaaatggaagtcttccccaggccaatgcccccaaaccggaactcccatgcccctggttgaatggaaatcgttgggcccgttcccctattgccatgggatccctttcccaatgggggaaacaggcgaaggggtgggtggccttaccccatttcccgtgagtggtgaaatggaaatgccccccgataggaaaactccttcccggaaagaaaaaaacggccttggtggttctgggctccccaaaacagaattaagataacacaacactcgaaaacccggcccccagggggttcgctcgattttgctggcgcccttaaatgaggagggtaccgggatatagaacgcggcggccccacacctggggccgcgaagggattcttaaaaaag

SEQ ID NO: 60363 - protein, 94 aa, Zea mays
  misc_feature: Ceres CLONE 1519654
MASLKAAKPSGVAAQGKEPAPKLSETATNPSAANSGGVKKAEQKPPGNQKEGERASKPGGRRGKKVDVPVTGGKCEMEVFPRPMPPNRNSHAPG

SEQ ID NO: 60364 - DNA, 802 bp, Zea mays
  misc_feature: Ceres CLONE 1519660
  misc_feature: Encodes the peptide sequence at SEQ ID NO. 60365
  misc_feature (1)..(1): n is a, c, t, g, unknown, or other
  misc_feature (44)..(44): n is a, c, t, g, unknown, or other
  misc_feature (49)..(49): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
nggggggcggtttctcgtttctgttccttagtgatcctccctcngtcgnggtttnnnnnnngcatgtgggactccacggggtggcggccgctctagactagtggatcccccgggctgcaagaattcgtctcacccctagaaaaaaaaaaaatgttctaccacttatataaccaggtgtcctacatgtctctcgatcagatttctccattgacattcagcattggcaatacaatgaagcgtatatcagtgattgtttcatcaatcattatcttccacactcctgtccccgctgtcaatgcactgggagctgccattgccatccttgggacattcctgtactctcaggcaaaggccggaagcacacccattgatcacaaacgtctgcccattcaaatatcaagcacttaaatccaattttttcttgccccccccgggcacgaaagaagatgcggggttaaggttttccgttattaaaatctcccccccccacgcgtaggattggggctctgcctggttttcggctcccccgcgactgaatgaactagaaccacggacttcctgcgtgggcctagttgaacgcgcccgctcctctcggtgcccctgtaccttacacccgtctattctgttagaattccgctcagataacgagtgctccgtgcgacggggcgattgtctttagtagcgccgctgtgccggcgaatatccgcctttcttcccggccccacgtcctacattgccacgcagaacttcttgctggaacgcgggcctgtcaaggagaccccccacactctctcaccgcctt

SEQ ID NO: 60365 - protein, 85 aa, Zea mays
  misc_feature: Ceres CLONE 1519660
MFYHLYNQVSYMSLDQISPLTFSIGNTMKRISVIVSSIIIFHTPVPAVNALGAAIAILGTFLYSQAKAGSTPIDHKRLPIQISST

SEQ ID NO: 60366 - DNA, 783 bp, Zea mays
  misc_feature: Ceres CLONE 1519661
  misc_feature (42)..(42): n is a, c, t, g, unknown, or other
  misc_feature (43)..(43): n is a, c, t, g, unknown, or other
  misc_feature (45)..(45): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (91)..(91): n is a, c, t, g, unknown, or other
ggtgaaaaattaagaatattaaaaaacccccacaaaaattgnntngggggaaannnnnnnggatagtggactccacggggtggaggggggnttttttctaccccaatcccccgggctgcaggtatccctctcacccctagaaaaacataggcacattggcatcgactagcaatctcccagagcagcagtcatgtttccagttgtaactgggagtttcagagaaggaaatggattgagttatgaaagagactccttagatcatctgggaatgattcagggataccaacaagtttgcgatcaagataaggatattccaagatgaccagcatcagggaggtataattgctactgaaataaaaaactaaactaagatggggtacatattaacaagactgcgccataaatgggtacaaacctgggtttttccccccccccccgggggagggagggagggggggcaatcccacctcaaaacaaacccccccccccgcacatttgaaacaaatgggaaatggtgcaaacaccgccatagagaatttcttgcgtggtgtgtttagaactgtagaagatgaaagattggatgccggctttgatataaacccccagacctctttcttacttgaggaaggcgttttataaaacactgcgtgttgaggtgtgtcgactaaatttatcctgctggcgtagaaatgtgtggagtaaaaacaggctgggggtcatgattatgtgtgttacagagcgatgtagccgctgatgcccacttacacttgtgatgtatcacca

SEQ ID NO: 60367 - DNA, 841 bp, Zea mays
  misc_feature: Ceres CLONE 1519665
  misc_feature (28)..(28): n is a, c, t, g, unknown, or other
  misc_feature (45)..(45): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
aaagagaggtttccccttttttactacngggggacaattcctctntnnnnnnnnnnnnntaatactggagctccccgcggtggcggccgctctataactagtggatcccccgggctgcaggaattcgtctcacccctagaaaaaagtggtcgtcatctaaccacactaacctagtgttatcccaggttataagtttgttccgttgcggatggtggtaagtgccggtggggtcagccttcttagataagtatatcggatctttagcttcttgattgaagatgggcccttcaggctaggatggatatgagcaaccattaaatgtgttatagggggtggaggtgggggagtgaggggaaaggagtcacctcccgcaaacccctcccatagaacgtcgagtgctactgtgggggttgggcgtgggaaacacatcttccgccctgcgccaccaaggacgagaggggaggggtggggggagagggccgtattttacactttttcccccccccgcggcccaacggagaaagccgcgacgtcaggcgcgatcttgttggcgggccgcatctcggcgcctgcgtgcatatgtgggtgccggcggcgggtgagcaggggtgaggcgggcacggcggcagtaacttctcattagtgcatgggggtaacggagtcgaagtgctataatacctgcagacctagcgggcgtttcgattgccgcgcggagcttgtcgtctagctctggggtggtaagtaagaaatctgtcggcggagctcccgaccggcttcccgcgcggcgggcttcaccgcgcctctgcggtctcagggatcggcgggcgggcgctgaggcgct

SEQ ID NO: 60368 - DNA, 650 bp, Zea mays
  misc_feature: Ceres CLONE 1519667
  misc_feature: SWISSPROT Homolog: EC 3.2.1.23 Beta-galactosidase
caaagctggagctccccgcggtggcggccgctctagaactagtggatcccccgggctgcaggaattcgtctcacccctagaaaaatgcttccgtgtgaaggaaggtgaccatgtcatcattggccagtgcaggcccctgtcaaaaactgtgaggttcaatgtcgttaaagtcattccagctggatccgcagctgctggaaagaaggccttcacagcagcctgagtttatagactatgttccatgagtagtctatagaatgtctttttaattcaaaagaaatctctcttctaggctggtgcttttcgactataatttggagattgttccatgtccgtgcaatcatctgaacatgttactacttattgtaccttgtcgtgcaaagttttgctaagatctctattgtttcctggccgtcgttttacaacgtcgtgactgggaaaaccctggcgttaccctacttaatacacttgcccgagcccctccaggtacccaattccccctaaagggagacgtattacccgcgctcactgcccgtcgttttacaacgccgaaactggaaaaaccctggcgtcacccaacttaatcgccttgcagcacatccccctttcgccagtctgctgattagcgaagaggcccgcacaaatcgccc

SEQ ID NO: 60369 - DNA, 660 bp, Zea mays
  misc_feature: Ceres CLONE 1519668
  misc_feature: SWISSPROT Homolog: EC 3.2.1.23 Beta-galactosidase
  misc_feature (617)..(617): n is a, c, t, g, unknown, or other
  misc_feature (660)..(660): n is a, c, t, g, unknown, or other
aaagctggagctccccgcggtggcggccgctctagaactagtggatcccccgggctgcaggaattcgtctcacccctagaaaaaccctagaaaaaccctagaaaaataaagccagaaattttgggtggtatgttagaggaggaaggaaggaggtgggcgggggattgggttatgcttagtgattctttattgttagataagcattaataaattgctcatttttcttgaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaaccaataggccgaaatcggcaaaatcccttataaatcaaaagaatagaccgagatagggttgagtgttgttccagtttggaacaagagtccactnattaagaacgtggactcccacgtcaaagggcgaaaaaccgtcn

SEQ ID NO: 60370 - DNA, 815 bp, Zea mays
  misc_feature: Ceres CLONE 1519670
  misc_feature (44)..(44): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (815)..(815): n is a, c, t, g, unknown, or other
ctgctagaaaattgttagtctggtgggcttgatattgaagagcnggggtaaannnnnnaaaaatagaactcaccgcggtggcggccgctctattctactggatcccccgggctgcaggaattcctctcacccctagaaaaagcgaccccaggtcagtcgggactacccgctgagtttaagcatataaataagcggaggagaagaaacttacgaggattcccctagtaacggcgagcggaccgggagcagccctggttgaaaatcgggggggctcggcgcctgaaatgtagtatggggagggggcctcaactacagacggggaaaaaggtcgtctaaaaaaggaaaacaagggagggtgaaaaatccaaacaggctacgggaccctggtgaaaccgaggaggaaccgaacaaacaaaatatacgttattttttctgctccacttcttaaaagggggggggattatacttattttctgtggggtttatatttgaccaacagaggagagagaaagcaaacgtctagagtataccggagggtgagaacaacatttaattgttatgtccataatataaatgagtggaaggcaaacaggcctggtggcgtatttactagcaagttgggggaaaaaaaaactaatatcgctagggggatgtctgcctattaaaacttatatggaaataagaacggggagactgggggaaattgttgatggtgagaaatggtagatgagattgcagtgtaggagtgggggtgtggcacaggtggtaaaacagtgatattgttagcttattactaacatttattgtcagaacan

SEQ ID NO: 60371 - DNA, 842 bp, Zea mays
  misc_feature: Ceres CLONE 1519684
  misc_feature (13)..(13): n is a, c, t, g, unknown, or other
  misc_feature (21)..(21): n is a, c, t, g, unknown, or other
  misc_feature (33)..(33): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (50)..(50): n is a, c, t, g, unknown, or other
agattggcgaggngaagaagngaccaatacttnannncttgcacaaaaantttaaaattttaaaactggagctccaccgcggtggcggccgctctagaactagtggatcccccgggctgcaggaattcgtctcacccctagaaaaagatatacctctatagagagagcaggccttaaggtatgcctgtgctgctgtgcagccatttgttgaaataatcgtttcggactctacagtaccgcattatatagtatataatttcatgatgtatattgaataagtacttactgattggttaagcttacctaaaatgaagaaaaataatgtatgttttcgaaacgctccgaggtaacccaaatcaacccttatgtgagacagtatataaaggctgtttacttggtgaaaaatttttcgcaaacgtcccgtgcctctggacaaatcccctgaaccggtaacacaaaagctacagtcggctattgtatgaattatttctctctgtgtatttgctcacccttgaccgttcacataacccttactcaaacgtccccggtcatcacggatgaaaaacaccttgtgcgcacagccgatttttacccatcaatcactcgagcggtggggccgtaggggtataacaggtggggggggcggtgatgaagaattttttgcgttggctaacttccgaactctcataaatgtagttatgttataagagccatattctgttttgtttatacgacacccgaaaaaacgccaaaaaaacacagaaaacaatggtgcctgctaaaaacggatcacgaaacactgttgctcggaataataagggccgggaaagggattgtggtac

SEQ ID NO: 60372 - DNA, 697 bp, Zea mays
  misc_feature: Ceres CLONE 1519708
  misc_feature: Encodes the peptide sequence at SEQ ID NO. 60373
ataagctggagctcaccgcggtggcggccgctctagaactagtggatcccccgggctgcaggaattcgtctcacccctagaaaaagagctgttcgtggggcggatggcgcagctgggcgtggccttctccatcatcggcgagatcatcacggggaagggcgcgctggcgcagctcaacatcgagacgggggtgcccatcaacgagatagagccgctcgtcatcttcaacgtcctcttcttcttcatcgccgccatcaaccccggcaatggcaggttcatcatcggcgaggaagaggaataggctgctggcctcggacatgagtcgtgtgcgtttacttttacctgtgactgtgagtgatcgatcgattgctgtgtatcaattactcgtgatgagacctcgaaggtagggtgtcgcgcccagctgtctgcttgtagaaacaagagcttatatataaattactactagctaataaaagatagttggaccaacttaaatcagaagattgaaaattttccctccacaggaaaaacaaaaaaaacaacgatatggctctatggaacaaaaaataacccgaaaccgccgcgagaatccccattcgccccccaaaaggggacgcggaaataaaccccccccccccttgggaccaaccctttttaacaaccgcccgggtaagggggaaaaaacccgcggggcgtt

SEQ ID NO: 60373 - protein, 65 aa, Zea mays
  misc_feature: Ceres CLONE 1519708
MAQLGVAFSIIGEIITGKGALAQLNIETGVPINEIEPLVIFNVLFFFIAAINPGNGRFIIGEEEE

SEQ ID NO: 60374 - DNA, 643 bp, Zea mays
  misc_feature: Ceres CLONE 1519709
  misc_feature: Encodes the peptide sequence at SEQ ID NO. 60375
atagctggagctccccgcggtggcggccgctctagaactagtggatcccccgggctgcaggaattcgtctcacccctagaaaaaacggatcgaaaacgaattaccctcggtgccctccctctcggcggcggcggcgcaagtccccttcatctccggcgcggcaaatggcaggcggcagggttgcacatgctaccctcaagggccccagcgtggtgaaggagatcttcattggactgaccctgggtctgatcgctggaggtatgtggaagatgcaccactggaacgagcagaggaaaactagatccttctacgacatgcttgacaagggccagatcgtcgtcttcgaggagtaattcccacgtgtcacctcaaaagttttttttttccaggtgtttttgaaaactccctcccgaaaccacgacaaagggaatgctgtgggagatttgccttgaaaattagcataaccctttgagaacccctaaaaaaaaaaaaaaaacgaagaccctcgagggaccccattcgcccttatagtgggtcgtattaccccccgctccctgggccgtcgttttacaacgtcgggaacggggaaaaaccctggcgttacccaactttaatcccccttggaaacaaatccacccttttc

SEQ ID NO: 60375 - protein, 62 aa, Zea mays
  misc_feature: Ceres CLONE 1519709
  misc_feature (2)..(62): Pfam Name: COX5C Pfam Description: Cytochrome c oxidase subunit Vc (COX5C)
  misc_feature: SWISSPROT Homolog: EC 1.9.3.1 Cytochrome-c oxidase
MAGGRVAHATLKGPSVVKEIFIGLTLGLIAGGMWKMHHWNEQRKTRSFYDMLDKGQIVVFEE

SEQ ID NO: 60376 - DNA, 640 bp, Zea mays
  misc_feature: Ceres CLONE 1519711
  misc_feature: Translation starting site: 285
  misc_feature: SWISSPROT Homolog: EC 3.2.1.23 Beta-galactosidase
aaagctggagctccccgcggtggcggccgctctagaactagtggatcccccgggctgcaggaattcgtctcacccctagaaaaaactagaaaaattgaattcattgaagcattgattggtgatgttcaaagtgtagctacagaattttcttctcaatactaggtagcatactagtgtagcagtgtgtaggttcatattcactgtttttcatcgtatccatgaacatttttattgatttacatagtggaatcaagagcttgtgatacgataaaaaccttgaattgatggtaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaaacaataggccgaaatcggcaaaatcccttataaatcaaaagaatagaccgagata

SEQ ID NO: 60377 - DNA, 658 bp, Zea mays
  misc_feature: Ceres CLONE 1519712
  misc_feature: SWISSPROT Homolog: EC 3.2.1.23 Beta-galactosidase
tcaagctggagctcaccgcggtggcggccgctctagaactagtggatcccccgggctgcaggaattcgtctcacccctagaaaaaaaaaaaaaaaccccctagaaaaaaaatttcatcgtgctggggatgggtatgctgaggaggaagagcctacagagggacaaaaggagatccttgaattgagagaacgattaaaagagcagattaggcgaaaggcaaaggctgctgctgcctgcacagctggccgagcatcttcttcacaaatacctcaagccagggagaaatttggctctttctttgggccatccaagccggtgatttctcgtcgagtgatagaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcccagcctgaatggcgaatggaaattgtaagcgttaatatttttgttaaaattcgcgttaaaattttggttaatccgctcatttttttacccataagcccgaaatcggcaaaac

SEQ ID NO: 60378 - DNA, 689 bp, Zea mays
  misc_feature: Ceres CLONE 1519716
  misc_feature: Encodes the peptide sequence at SEQ ID NO. 60379
  misc_feature (255)..(255): n is a, c, t, g, unknown, or other
  misc_feature (258)..(258): n is a, c, t, g, unknown, or other
  misc_feature (689)..(689): n is a, c, t, g, unknown, or other
aaagctggagctccccgcggtggcggccgctctagaactagtggatcccccgggctgcaggaattcccctaacccctagaaaaaaaaagtttaacgatctatgcattcagatgtcctaaaactacagctctccgaactcaatgggagtaacaaccttcgcatctgttgggatatatggcgagctaggaggtatagaaatgtcattgcagaactcaggaaaacgtgcaatggaatttcttgaaatccctcttgaanaanagagagaacaacaaaaaacccaaaatacagtaaatttggtattataggaaaaaaaaacaaaaaaacgagaccctccgaggacccaattcccccctaaagggaggcgtattaccgccggctcactgggccgccctttttaaaaacctcgcgccttgggaaaaaccctgggggttcaccccactttaaaaccgccctggcaaccacaacccccctttttcccccacgtggggggaaaaaatgcaaaaaaggcccccccacccaatttgccccttttcccaaaaaatttgccccccccccctgaaaaggggcaaaaatgggaaaaattttgaaaccccccaaaatatattttgggtctaaaaaatttcccgggataaaaatttttggggaaaaaaagaccccccttttttttaaaccccaaagggcccaaaacn

SEQ ID NO: 60379 - protein, 46 aa, Zea mays
  misc_feature: Ceres CLONE 1519716
MHSDVLKLQLSELNGSNNLRICWDIWRARRYRNVIAELRKTCNGIS

SEQ ID NO: 60380 - DNA, 647 bp, Zea mays
  misc_feature: Ceres CLONE 1519717
  misc_feature (647)..(647): n is a, c, t, g, unknown, or other
aaagctggagctccccgcggtggcggccgctctagaactagtggatcccccgggctgcaagaattcgtctcacccctagaaaaacgaaggcatgtactattctattaaggggagcaagttgaaaattggtgcccactaatagtctggtgatctaacacaatgaaattgtcgacaaggccattatcatcttgcatgttacctccaagcatctcatgtatatctgctaggagaatgctgcacccacgaaaggcattgagtgcaatagaggtgaaggaactgcgcgaagccctttaagttattgctgaaggtttggacctaaattcactcttgtgctagagtttggtgtagccctctattattactccccacaatgttaatggagtgacttagtttgtctaatgcacctcataccgatgtttgaacgtatttgtataaactgtgccctgaacatagtctgtatgatgcaattcctagcgatgtcctttttaaaacaaaataaaaaaccagacccctctaagtcccccaatctcaccctattaaagagtccctattaccgtccgctcatctggtacggttttttttacacccggcgtggaccagaaaaaaacccctgggccgttaccccaatctttaatccaccctttgcn

SEQ ID NO: 60381 - DNA, 670 bp, Zea mays
  misc_feature: Ceres CLONE 1519721
  misc_feature: Translation starting site: 183
  misc_feature: SWISSPROT Homolog: EC 5.2.1.8 Peptidylprolyl isomerase
atagctggagctcaccgcggtggcggccgctctagactagtggatctcttgggctgcaggaattcctctcacccctagaaaaagtgctttcttagaggcgggttggcttctcctccccctccggttcgggttcgggttcgtgaggttctccggggttcgggttcgtgggtgagcggatcgagatggcggcgtctgatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgccggaacgccatcgagggcatgaacggccaagagctggacggccgcaacatcaccgtcaacgaggcccactcccgcggcggccgtggaggcggcggctgtgggtacagtggtggccgtggaggccgcggctaccgcggtggcggggcgccgtgatggcggtggcggctaccgcggtggccgcggctacggggggccgctggcagctacagtggttggtggcaggcggctacggccgtggggcacccgtggcgggcggttactgccaattccgaatgggaaacttggagcaaccctatcccgc

SEQ ID NO: 60382 - DNA, 659 bp, Zea mays
  misc_feature: Ceres CLONE 1519731
  misc_feature: Encodes the peptide sequence at SEQ ID NO. 60383
aagctggagctccccgcggtggcggccgctctagaactagtggatcccccgggctgcaggaattcgtctcacccctagaaaaacatatgcgagcttgctgcggttggggcagatgcatcaggcctcctctgctctcctacacagtcgagataagcgatggtagttagaggtcccctatattctttctagcgtctcaagttccaagatttcatcatatatatgttaccagagagtttactgattgtaaggaataagtattatacatgctgttgagtttttcttttcttttttgttctgttaccataatttttgtttgccttaggggctgctgtcatcacctgccgtatggtttagatttctgatcgacttccaatatgctggaaattgatgtatgagatgtttctttcgttcttcaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcggagaaggccgcaccgatcggcctttccaacagttgcgcagcctgaatggcgaatggaaattgtagcgttaata

SEQ ID NO: 60383 - protein, 87 aa, Zea mays
  misc_feature: Ceres CLONE 1519731
  misc_feature: SWISSPROT Homolog: EC 3.2.1.23 Beta-galactosidase
MYEMFLSFFKKKKKNETLEVPNSPYSESYYARSLAVVLQRRDWENPGVTQLNRLAAHPPFASWRNSGEGRTDRPFQQLRSLNGEWKL

SEQ ID NO: 60384 - DNA, 741 bp, Zea mays
  misc_feature: Ceres CLONE 1519732
  misc_feature (19)..(19): n is a, c, t, g, unknown, or other
  misc_feature (47)..(47): n is a, c, t, g, unknown, or other
  misc_feature (66)..(66): n is a, c, t, g, unknown, or other
  misc_feature (67)..(67): n is a, c, t, g, unknown, or other
  misc_feature (90)..(90): n is a, c, t, g, unknown, or other
  misc_feature (91)..(91): n is a, c, t, g, unknown, or other
ttgtttgttgggtgggggngagctgttttttttttttaagaggtttnggggggcctctttaaaacnngaaaaaattgggtggagtaaganngttatctttgcatcccgcggggaggaggttttcttctcacccctagaaaaattcacaacagataggtttggatgcgcggcaggtgtccttctacgactaaactctactggtggtgagcattaggatcctgtaatgataatagtctttgtcccaagggcacctggaccctgtgattgtgggaatttgcctttgttgggatgcaatgttgggaactgtactaacagagttgttgtgttttgagaacttggtttaaatgttaaggatgtgatgctaaagaaaacaaaaaagtgttggtttttgacacaacttccttgggctcagtggatttttttgccgccctctccacaaagaagggtggggtttttttatattaaaaaaaaaacccccaccccctgggtggttaacctattcccccccagaagggatgtggtatcttatcccccccttcattgtagtgtggtactttgaaaccttcctggtactgggaaaaaaccctactcacttcgcccgaatcttattacgccttatgtaggttatattcacccaatataagcgccgttctgatgtttattgtccacaaaagacaccaaggacctctttcatgccttttccgagatagatatgcgcgacgctctagaaaggatagaaat

SEQ ID NO: 60385 - DNA, 811 bp, Zea mays
  misc_feature: Ceres CLONE 1519740
  misc_feature (1)..(1): n is a, c, t, g, unknown, or other
  misc_feature (2)..(2): n is a, c, t, g, unknown, or other
  misc_feature (26)..(26): n is a, c, t, g, unknown, or other
  misc_feature (28)..(28): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (728)..(728): n is a, c, t, g, unknown, or other
nnttttgggatttgtttttttttttnancccccccccccccnnnnnttggtaannnnnnnnataactggagctccccgcggtggcggccgctctagaactagtggatcccccgggctgcaggaattcgtctcaccccctagaaaaataataatcgaagcaccagatgagttgtcgctttgtaacggaaatgacttgagtgatgccggacactgtggcgtgtgagctttttatgtgaagtgtaacgtggacaggccctgatgcgataaactgtttggacatcgttactgggtcagccaatgagaacctgtagcaaaacaatatgatgttttcttatggtagtttggaatggatggagttaaatgaattgaaccactgcattttttatcaaattaagatctgaaaaaacaaaaaaaaatatttttttttcccccccccccaccggggggagggggggggggggggccctttttttcccctttttaccccccccccccttttttgtggtgtggttctaatagaccccctccctttctttacagcgggtgctcgcgcccctgctaaaacattcctcgccgcggttttccccccacgctgaaagccggtctttggacacactgttgatggcctctcttgtcagtcttccctcgttcctataaccgacccgacgtgatgtttctcattcccacattttctctctttcccctccactcatttatgcccggactcnctattgcgtggtgtacaaatagagaaatccgagcccccccccatccacttcttgtggtgtttaacgcctccagtcgcgcccgc

SEQ ID NO: 60386 - DNA, 666 bp, Zea mays
  misc_feature: Ceres CLONE 1519743
  misc_feature: Encodes the peptide sequence at SEQ ID NO. 60387
aaagctggagctccccgcggtggcggccgctctagaactagtggatcccccgggctgcaggaattcgtctcacccctagaaaaaacgcagctgcgtggtgcgcacaaagcgaactattctttcgccttttactaaagaataccgtgtgtgcgccatacaaagcagcatacgcttatttttggagggtgttttctctttttgagaaggccccacaaactagaaatacccttcaaaaaaaaaaaaaaaaaaaaaaaaaaaaaaaaaaaaaaaaaaaaaaaaaaaaaaaaaaaaaaggaaaaaaaaaaaaaaaaccgagccgctcgaggtacccaattccccctatagtgagtcgtattacgcgcgctcactggccgtcgttttacaacgtcgggactggaaaaaccctggcgttacccaacttaatcgccttgcagcacatccccctttccccagctggcgtaatagcaaaaaggcccgcaccgatcgcccttcccaacagttgcccaccctgaatggcgaatggaaattgtaagcgtaaatattttgtaaaattcccgttaaatttttgttaaatcagctcatttttttaaccaaaaggccgaaatcggaaaaaaccctttataaatcaaaaaaataaacggaaatagggtttgagtggtgttcccc

SEQ ID NO: 60387 - protein, 44 aa, Zea mays
  misc_feature: Ceres CLONE 1519743
KAGAPRGGGRSRTSGSPGLQEFVSPLEKTQLRGAHKANYSFAFY

SEQ ID NO: 60388 - DNA, 841 bp, Zea mays
  misc_feature: Ceres CLONE 1519803
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (30)..(30): n is a, c, t, g, unknown, or other
  misc_feature (31)..(31): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (418)..(418): n is a, c, t, g, unknown, or other
  misc_feature (572)..(572): n is a, c, t, g, unknown, or other
  misc_feature (663)..(663): n is a, c, t, g, unknown, or other
  misc_feature (801)..(801): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
  misc_feature (807)..(807): n is a, c, t, g, unknown, or other
nnnnnnnnnnaaaggtcccaattacttttnnttnnnnnnnnnnnaaaannnnnnaatcctgggcctccccgcggtggcggccgctctagaatagtggatccccccggctgcaggaattcctctcacccctagaaaaaacgatcctgtccctgtccagcaagggagacctggactggaggaggaggacctacctacccggcctccagctctctcgtctcttccgcctgcctgctcgaagctcccatccgatcccccaatgtctgacagcagtccagctcccggcgcttattactccggccctcccgacccgccgccgcccgattctaaccccctttcactttttcccctcgaggggggagggtcctggacactaattttctctttttccttgccgtcgtaattttgtgatttcgcgggncattttttttttcccccccccccccgggggggggggggggggggggctccccccccactcccccccctccctcctcggtttgtttggtggctcgtatgactgcgtctgattttcttatttatatggccactccccgattgcgggggccgggggntgcccctagcggccgcccggccccgccagagggttttgcgggtgcagtcgctccctgagcgtccaattagccgtgcatcctttccttggcntgccgccaaccccgccccctccctttctcggccctttccccccctccccgtgcgccgccgtccgcactctctatcgatgtgttgccctgtccccccccgtgtctgcttcgcttacgtcggccggtccccaccggcggnggnnnntgcttgagagatggacgcccgccgcccctccccc

SEQ ID NO: 60389 - DNA, 852 bp, Zea mays
  misc_feature: Ceres CLONE 1519805
  misc_feature (20)..(20): n is a, c, t, g, unknown, or other
  misc_feature (21)..(21): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (616)..(616): n is a, c, t, g, unknown, or other
  misc_feature (626)..(626): n is a, c, t, g, unknown, or other
  misc_feature (628)..(628): n is a, c, t, g, unknown, or other
  misc_feature (629)..(629): n is a, c, t, g, unknown, or other
  misc_feature (637)..(637): n is a, c, t, g, unknown, or other
  misc_feature (669)..(669): n is a, c, t, g, unknown, or other
  misc_feature (729)..(729): n is a, c, t, g, unknown, or other
  misc_feature (737)..(737): n is a, c, t, g, unknown, or other
  misc_feature (852)..(852): n is a, c, t, g, unknown, or other
ttttcattatattgtcccannatctattttcnnnnccggccnnnnnnnaatgctggagctccccccggtggcggccgctctagaactagtggatcccccgggctgtaggagattcgtctcacccctagaaaaaaccgactggactccggtctatttatcgagtggaacgaagcaagacaagagggaggccgagccgcctagggtagccccgtccggtctcctgcgtccggcgaccgactgcctggcgccggcgaatccatggggtactggtggcaccgcgtcgttctgcagggcggggggcgtggctcggcctcgcgctccgcttccgggttcctccaacccgttcggtgggggctgccacaggaggtgattatcgtgtgagtttcgagtccgcgttgcttggtgtagatatttttcctcccccccccccttgggggggggggggggcgggcgtccgtgtgtctgggtggtaggttttgttccgggtttgtgggatggtgtgttccggcagaccccccccccccaccccgcaatccccggggcgagtagcgcccgctccacgccgacaaggctcgtctttttcttataatgtatggggcgagcgtttttttatttntggtttcccngnnccccgcgntttcctcttgcctttccttcgttttgttctcnctcccattgtcaccccgcctcccttccgcttccttttcacaccccgccctcttcggcgcntcccctcnttcgcccacttttctcccctcgccgccacgcctttttgatttgtctgttgttgccgacttcacagccactgtctacataccctacgatgatcattccttcttccattcctcccgn

SEQ ID NO: 60390 - DNA, 633 bp, Zea mays
  misc_feature: Ceres CLONE 1519806
  misc_feature: Translation starting site: 102
aaagctggagctccccgcggtggcggccgctctagaactagtggatcccccgggctgcaggaattcgtctcacccctagaaaaactactgacgagctcgccatggcctccctctcctctgccgccgtcaccgccccttccttcgccgcaccagcgccagcccgcgccgtggtcagaaggaggtccttcaccgtgcgcgcctctctccgcaaggccaccggcaccgccgccgtggcaatggctgccagcgccctgcttgccggcggtgccatggcccaggaggtgctgctgggcgcaggcgacggcgggctcgtcttcgagccagccagttcacgtcaagccggcgacacatcacattcaagacaacgccggcttcccgcacacgtcgtcttcgacgagacgaggtgccgagcggcgtcgacgccacaagatctcgcaggaggagtacttcaacgcgccaagcgagacctactcccgtaccctcaccgtggcgggaacctacgggcttctaactgcgaacccccatcaaggaacccgggaatgggccggcaaaaatcccccgtccaacctaattaaaaccttgggctttcccatcggaaatcccctttccctgggtataaaccgggttggcctt

SEQ ID NO: 60391 - DNA, 674 bp, Zea mays
  misc_feature: Ceres CLONE 1519809
atagctggagctccccgcggtggcggccgctctagaactagtggatcccccgggctgcaggaattcgtctcacccctagaaaaaaggagctttccagcgccttccagagtttcggaagagtagtaagcgctaaggtgttcgtggacaaagcaacgggcgtcagcaaatgcttcggtttcgtgagctacgactctcctgcctccgcgcaggcagccatcaacaggatgaacggctaccagttaggcggtaaaaaactcaaggtacaactgaagagagaaaacaacaccaagcacagtagtaaaccgttttgacagacaaggcagcagccgtccggtacccggtacatattaattgaccgtcaacacattgcagcagcagcctcagggcctggggagggaagagacccgtgtaccctctttgttcacttcaacattcttggagattcgtcagctcagctcagctcgtgtaattcattgcagcagacataggccgtagcagcagtttgtaccatgatcagatcacttgtacacatgattcattcaattgttactgacagccctctttcatcctagaataattcgcctgtgacaacccttatcatttggctgacgaaatgaagtcaggtaaaacttgttcataaaaaaaaaaaaaaaaaccagacccctgaaggtacc

SEQ ID NO: 60392 - DNA, 661 bp, Zea mays
  misc_feature: Ceres CLONE 1519813
  misc_feature: Encodes the peptide sequence at SEQ ID NO. 60393
  misc_feature (80)..(80): n is a, c, t, g, unknown, or other
  misc_feature (120)..(120): n is a, c, t, g, unknown, or other
  misc_feature (133)..(133): n is a, c, t, g, unknown, or other
  misc_feature (403)..(403): n is a, c, t, g, unknown, or other
acagctggagctccaccgcggtggcggccgctctagaactagtggatccccctgggctgcaggaattcgtctcacccctnagaaaaaaaaaaaaaaaccacaccatctccgcgctagctngaggacggtacangcggcacagaggtgtcgacgtacgacgacgacgacgcaggcgccacacatggcatcccagctctccgccgccgtgccccggttccacggcctccggggctacgccgcgcccaggtccgcggtggcagcgctgccgtccgtgagggtgggcaggaagaggtcgtcgtcgcagggcatccgctgcgactacatcggctccgccaccaacctgatcatggtgacgacgacgacgctgatgctgttcgcggggcggttcgggctggcgccgtcngcgaaccgcaaggcgacggcggggctgaagctggaggcgcgcgactccggcctgcagacgggtgaccccgccgggttcaccctcgccgacacgctggcctgcggcgccgtcggccacatcctcggcgtcggcatcgtgctcgggctcaagaacaccggcgccctcaaccagatcatcggctagatccctacgtcggcgttgttaagaacagactcagcagcctcgatcgcggcgccgggcgggcggtggctgccaggg

SEQ ID NO: 60393 - protein, 134 aa, Zea mays
  misc_feature: Ceres CLONE 1519813
  misc_feature (49)..(129): Pfam Name: PSI_PSAK Pfam Description: Photosystem I psaG / psaK
MASQLSAAVPRFHGLRGYAAPRSAVAALPSVRVGRKRSSSQGIRCDYIGSATNLIMVTTTTLMLFAGRFGLAPSANRKATAGLKLEARDSGLQTGDPAGFTLADTLACGAVGHILGVGIVLGLKNTGALNQIIG

SEQ ID NO: 60394 - DNA, 675 bp, Zea mays
  misc_feature: Ceres CLONE 1519814
  misc_feature: Encodes the peptide sequence at SEQ ID NO. 60395
  misc_feature (675)..(675): n is a, c, t, g, unknown, or other
tggagctccccgcggtggcggccgctctagaactagtggatcccccgggctgcaggaattcgtctcacccctagaaaaaatcgccagacacactatagaccacagccagtcagccacatcactagctagctgtgcagaggcaatggcgtccaaggttgagctggtggtggaggtcaagtccccggctgacaagctgtgggcggcgctgcgcgactccacggagctgttccccaagatcttccccgagcagtacaagagcatcgagaccgtcgagggcgacggcaagtcggccggcaccgtccgcctcctcaagtacaccgaggcggtgccgatgctgacgttcgccaaggagaagcttgagacggcggacgacgagaacaaggtggtgtcgtacagcgtggtggacggcgagctggcggacttctacaagaacttcaagatcacgctgaaggtgactccggcccaagcggacggcgagggcggcgcctttcctccgctgggccatggagttcgacaaggccaacgacccaggtgcccgacccgggacgtcatctaaggagacccgccaccaagacgtttccccaaccctcgaagaactacctcccccaaaaactaaaatggaagcgaccacctgggaaatgggtccccatacaggaacagttttccggtcccatn

SEQ ID NO: 60395 - protein, 137 aa, Zea mays
  misc_feature: Ceres CLONE 1519814
  misc_feature (1)..(126): Pfam Name: Bet_v_I Pfam Description: Pathogenesis-related protein Bet v I family
MASKVELVVEVKSPADKLWAALRDSTELFPKIFPEQYKSIETVEGDGKSAGTVRLLKYTEAVPMLTFAKEKLETADDENKVVSYSVVDGELADFYKNFKITLKVTPAQADGEGGAFPPLGHGVRQGQRPRCPTRDVI

SEQ ID NO: 60396 - DNA, 639 bp, Zea mays
  misc_feature: Ceres CLONE 1519815
  misc_feature: Translation starting site: 198
aagctggagctccccgcggtggcggccgctctagaactagtggatcccccgggctgcaggaattcgtctcacccctagaaaaatcctgacttcgccatccggcgatcaccagagccctagctccggcgtctctagcgatccccaaaacccactccgccgcatttctgccgacttggccggattggtcgcttattgaaatggctacgccacttatagcaggacttgcagttgcagcaactgctcttgctggtcgatatggtgtccaagcatggcaagcttataaaggcaggcctatagttcccaggatgcgcaaattctatgaaggtggctttcaacctacaatgaaaccgaaggaagctgcattaatccttgggtgtcagggaaactgccaacgcagaaatgtaaaagaaggccacaaaggttatggtccccaaccattcagatgccggtgggagccatacctttgggttaaaatttatgaagccaaggatttgttgtcagggaaaaaaaaaagagggggggccggcccttccaattggaaaaataagaaaagcctcctccgctaaaaagggaaaatttttggcccctcaaaaatatgcccttaaaaaaaaccttggaaccccgccgtttaaccttggg

SEQ ID NO: 60397 - DNA, 713 bp, Zea mays
  misc_feature: Ceres CLONE 1519819
  misc_feature: Encodes the peptide sequence at SEQ ID NO. 60398
aagctggagctccccgcggtggcggccgctctagaactagtggatcccccgggctgcaggaattcgtctcacccctagaaaaaatgttcgcggagtacaaggagaggctcgcaggggtcgtcggagacgaggccgccgccgcaggcatcgtggccgaaagcctgttccttgtctgcgccgggtcggacgacatcgccaacaactactacctcgcccccgtcagacctctgcagtacgacatctccgcgtacgtggatttccttgtggagcaggcctgccacttcttgaggcaactgtacccagcagggggccaggagaatcgcggtcctgggggatgcccacccgacgggcggcatgcctcttttttcggcccccccccccgggggggggggggggggggaactgcctaccccccctttgagaaacccccttggcccctattttgttcccacttccacgctccaaaggaaggtaagtcccctgcccccctcccccaaagtgacctcggccccctgcctcgtaaaatattcgcttccccttgtagcaacacctttccccaccgcctctcctccttttactcctctcccttcgccccaaccccttctttcgccataaacccccgcccgtccccttctcgacatgcgccctcccccccctcactcccttgcggcaatcccctttcctccccttttcccaccaccctgagccccccg

SEQ ID NO: 60398 - protein, 237 aa, Zea mays
  misc_feature: Ceres CLONE 1519819
AGAPRGGGRSRTSGSPGLQEFVSPLEKMFAEYKERLAGVVGDEAAAAGIVAESLFLVCAGSDDIANNYYLAPVRPLQYDISAYVDFLVEQACHFLRQLYPAGGQENRGPGGCPPDGRHASFFGPPPRGGGGGGTAYPPFEKPPWPLFCSHFHAPKEGKSPAPLPQSDLGPLPRKIFASPCSNTFPHRLSSFYSSPFAPTPSFAINPRPSPSRHAPSPPSLPCGNPLSSPFPTTLSPP

SEQ ID NO: 60399 - DNA, 694 bp, Zea mays
  misc_feature: Ceres CLONE 1519822
  misc_feature: Encodes the peptide sequence at SEQ ID NO. 60400
acagctggagctccccgcggtggcggccgctctataactagtggatcccccgggctgcaggaattcgtctcacccctagaaaaaaaaaacaccgcaatcttcaatctccccagcaatccctagcagaagccttccatcctcactcgctcgatggcccgtacgaagcagacggcgaggaagtccaccggcggcaaggcgcccaggaagcagctggcgactaaggcggcccgcaagtctgcccctgcgaccggcggagtgaagaagccccaccgcttccgccccggcaccgtcgcgctccgggagatccgcaagtaccagacgagcacggagctgctgatccccacgctgccgttccagcgcctggtgcgggagatcccccaggacttcaggacctacctacgcttccagagctctgcccgcctcgccctgcaggcagcggcttaggcctaccttgtcgggctcttccaggacacccacctctgcgccatcccccgtgatgccgttccccatcatgcccccgggcccccccttttcgcccgccccctccggtggggaaagggcccaaagcggtcatattttcccgctccccattagtcgcgccaatgacccacccatatgcccatcccccggtggtcccggttcctcctcggcattacttcccctcaatcatatattcttcgtttggcctcccctt

SEQ ID NO: 60400 - protein, 97 aa, Zea mays
  misc_feature: Ceres CLONE 1519822
MARTKQTARKSTGGKAPRKQLATKAARKSAPATGGVKKPHRFRPGTVALREIRKYQTSTELLIPTLPFQRLVREIPQDFRTYLRFQSSARLALQAAA

SEQ ID NO: 60401 - DNA, 672 bp, Zea mays
  misc_feature: Ceres CLONE 1519824
  misc_feature: Encodes the peptide sequence at SEQ ID NO. 60402
tggagctccccgcggtggcggccgctctagaactagtggatcccccgggctgcaggaattcgtctcacccctagaaaaagtgctttcttagatgtgggttggccttactcctccccctccggctctggttaccggttcctgaggggtctccaggagttcaaattgtcgtaaggtgtacgggatcgcatatggcgagcgtccggatgcttgaactacccactgctttggtatcgcggtgctcgccgtgggccacttcacacactcactccctacgtaccatgctctttcctgcctatagccaggtcctcgaatccaagatcatcctcgaactgtaaacgccaacgtgccccggacttctgcttcgtcgccttatcaactacatgacgacatgcgcatcgccatctagggaatgaactgcaaggagctctacagctgcacatcaacgactgcagtgctgtcactcagtggcatgtagcatcaacaacctctaagctggagcctggaatctgtgatctactcgacttctgacctcttgatccctgatactactacagtactggcttccgctgctactgatgtcaacccagactacatctgtctgtggcagcgtgctactgtatatgccacccgtgtttgacggtctaaggaaactaccgacggggaactggcttt

SEQ ID NO: 60402 - protein, 48 aa, Zea mays
  misc_feature: Ceres CLONE 1519824
MASVRMLELPTALVSRCSPWATSHTHSLRTMLFPAYSQVLESKIILEL

SEQ ID NO: 60403 - DNA, 665 bp, Zea mays
  misc_feature: Ceres CLONE 1519831
  misc_feature: Encodes the peptide sequence at SEQ ID NO. 60404
  misc_feature (386)..(386): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (393)..(393): n is a, c, t, g, unknown, or other
  misc_feature (395)..(395): n is a, c, t, g, unknown, or other
  misc_feature (396)..(396): n is a, c, t, g, unknown, or other
  misc_feature (398)..(398): n is a, c, t, g, unknown, or other
  misc_feature (402)..(402): n is a, c, t, g, unknown, or other
  misc_feature (612)..(612): n is a, c, t, g, unknown, or other
gagctccccgcggtggcggccgctctagaactagtggatcccccgggctgcaggaattcgtctcacccctagaaaaaagccccactctctccatctagagctccctaactgcaccggccgccacaccaccgtaccccgacccctcgacaacaatggccaccgtcctaggcagcccccgcgcgccggccttcttcttctcgccgtcctccctccgtgccgcgccggcgcccaccgccgtggcgctgcctgcggccaaggtgggcatcatgggccgtagcgccagcagcaggggcaggctgcgcgcgcaggccacctacaacgtgaagctgatcacgccggagggggaggtggatctgccccccccccacgacgggggggggggggancannncnannangacngcttctacctgctctactcctgccgcgcggggtcctgctcctcctgggccggcaaagtcgtctccggctccggggaccattccgaacagaggttccttgaacaagggccagatcgcccgccgggttgggtgttaccctgccaccccctacccttacctctgacggccgttctcggagccttccaaggggggaaggaggttcccggggggnattaaacattccttggccttcctagtcgttaatcccctgcggggccgaacttg

SEQ ID NO: 60404 - protein, 153 aa, Zea mays
  misc_feature: Ceres CLONE 1519831
  misc_feature (78)..(78): Xaa is any aa, unknown, or other
  misc_feature (79)..(79): Xaa is any aa, unknown, or other
  misc_feature (80)..(80): Xaa is any aa, unknown, or other
  misc_feature (81)..(81): Xaa is any aa, unknown, or other
  misc_feature (82)..(82): Xaa is any aa, unknown, or other
  misc_feature (84)..(84): Xaa is any aa, unknown, or other
MATVLGSPRAPAFFFSPSSLRAAPAPTAVALPAAKVGIMGRSASSRGRLRAQATYNVKLITPEGEVDLPPPHDGGGGXXXXXDXFYLLYSCRAGSCSSWAGKVVSGSGDHSEQRFLEQGPDRPPGWVLPCHPLPLPLTAVLGAFQGGKEVPGG

SEQ ID NO: 60405 - DNA, 656 bp, Zea mays
  misc_feature: Ceres CLONE 1519832
  misc_feature: Encodes the peptide sequence at SEQ ID NO. 60406
aaagctggagctccccgcggtggcggccgctctagaactagtggatcccccgggctgcaggaattcgtctcacccctagaaaaagctccctatcccatccatcacaggtagctagcgtacagacgaataatctcctcttcacctcactagctaacaccatctagcagctcgatcgctctgtcctgcaataatggccgctcgctcctcctcccagcagctggtcgcggcggcggtcctggcagcggcgctgctgctgctggccggcgggggccgggacggcgtcggcggctgtgagctgcggcaaagtgacatcctccgaggcgccgtgcctcgggtacactatgggcagaacggcgtcgccctccgcggcgtgctgcagcggggtgcgctcgctcaacagccgcacgtcaccagcaagcggacggcaggccacctgcaactgcctcaagagcatgactggccggctcggcggcggcgtcagcatgtccaacgccgccaacatccccggcaagtgctgcgtctcctgcagcgtgcccatcagccccaccgtcgactgcaccaagatcaactgatcgatggaaccatagtggaggcagctcgctcgttggatggcagctatacgtggccatcaccagcatgcaatcgacgaccgtacg

SEQ ID NO: 60406 - protein, 39 aa, Zea mays
  misc_feature: Ceres CLONE 1519832
MTGRLGGGVSMSNAANIPGKCCVSCSVPISPTVDCTKIN

SEQ ID NO: 60407 - DNA, 693 bp, Zea mays
  misc_feature: Ceres CLONE 1519833
cagctggagctccccgcggtggcggccgctctagaactagtggatcccccgggctgcaggaattcgtctcacccctagaaaaagacgaacggagagagcctcgagagcgagccgccattgcctagaggactcgagctagagctcccttcgattcgagactcgagagcatagccgtgcgctgggaagtaccacgtctaggagcagatgagcgggctggagctggaactgggactgagcctacgcgtcctcatcaacgtcttccacgagcagtgaatgcgcgacaccctccccgccaatgacatccccatgcctccgggcatggtagatcaaactggaggacgccgaggagccggcgcccgcctgtatccccctgggtcgggggggggggagcccctccactcccctcttccaatagttgcatgcttcccgaacctgaacttcgcatcgggaacgcgacccccccaaggagacgtttgggaacgaatttcgccttgaaaaaactcccattctttgtgacccactttgccggacggtccccagaaaatgggaatttcttcgccccacgcgtataccaatccgccctcttcgaacgggtctctaagcgcctattcggcgcgcgaggcttccccgaaaccgccctattggggaaagttcggctcttcccacacatgggcttctacatccccttggccg

SEQ ID NO: 60408 - DNA, 651 bp, Zea mays
  misc_feature: Ceres CLONE 1519834
aaagctggagctccccgcggtggcggccgctctagaactagtggatcccccgggctgcaggaattcgtctcacccctagaaaaaatatgtggtcatatttggttttgttgctgcacttcttatctggaatgcttgctggggtagcagaggtggaattgggtttgttagtcgctaccctgatgctgatctcagaacggccaaagatggacaatatgtaaaggttacaggggttgttacttgtggaaatttccccctcgaatcctcgttccaaagggttccaagatgcgtatacacttctactggcttgtatgagtacaggggttgggattccaaagctgcacaataccgaacatcggcgttttacatggggtttacgttcaatggagcgacatgcggttgatttctacatttcagattttcagtccgggcttcgagcattggtgaaaacaggatatggtgcacgtgtgaccccatacgttgatgaatctgttataattgacatcgatccagacaacaaggatatgtcccctgaatttttgagatggctaagagagagaaacctttcaagcgatgatcggacaatgcgcctaaaagaaggatacatcaaggaaggtagcactgtaagtgtgatgggggttgtccaaaggaacg

SEQ ID NO: 60409 - DNA, 714 bp, Zea mays
  misc_feature: Ceres CLONE 1519835
aaagctggagctccccgcggtggcggccgctctagaatagtggatcccccgggctgcaggaattcgtctcacccctagaaaaaagcgcttttctgtccgactacaagtcgttaactgctgcgtactccgcactccagtttggtcgtatttcttgaaagtaggtcttgcggtagttcgcccaactgtcaccatggacaactactagggtaagactgtgccacctctatgttcccaggaacagctccgtcacaaataggatcatcacaggcggggatcatgcctctgttcctatccaacttgggcaggtggatcccaaagggccttttcaaggtgaatttgaaaacatttgcactcgcaggggttttttcccccccccccacgagggggggggggcgtaaaaaatcccattgataaaaaaaaaaaacttcaccttcaccaccaaattattagatccaggtttacgggggacatggaaaattcttttaactgtatcctttgaaacacgtcccactatatgtgtacccgcaccgaagtccaaaatcgccacccgttattggtgcaaatatccccgcaccttttgttctgatcccccttcgaggacccaataacgttagaaccgccattatacacatgacggtggtataaaacatattattctcgcagttccttcctcgaaggttcataaggcgtctattatcaaacaaactaaaactc

SEQ ID NO: 60410 - DNA, 729 bp, Zea mays
  misc_feature: Ceres CLONE 1519836
  misc_feature (26)..(26): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (126)..(126): n is a, c, t, g, unknown, or other
  misc_feature (519)..(519): n is a, c, t, g, unknown, or other
cgttaaaaactattgttttccccccncnnnnnnnnngggggannnnnnaaacctggactccccgcggtggcggccgctctagaactagtggatcccccgggctgcaggaattcgtctcaccccctnagaaaaaaccagcaacccccacagcgccactgtccagtgcgcgcgtcaagcttgcttagctagccgccatggcctccctcgccgccgtctccgtggagcccgtggccatcaagggtctcgccgggcagttccatcttcgggaggaaacttcgccctcccccagggccgtccgcccccctcctttcccagggcctccttccacccgccgcgtggtgtccccccccgggggacggggaggtttttcctttgacaccgcctttcatatcgggacacctcccccggacaatagggggacattctttttttttgtttccccccccccccccggggggggggggggggggggggtttcttctatctcaatccccttccctcgggaggggtttcgggggnctttctcccccccaccctcgccaaacgcccccctccccttcctcccacgccgcaccccgcttttctttctacatcgccgtcttttctttgtttgccgtggcccacattcccccccttttccggcggcccttgcccccgcgtaccaggcgcctcttctcctttccccgtttggcccccgtatcccttctgccgttttttcttttctttttg

SEQ ID NO: 60411 - DNA, 520 bp, Zea mays
  misc_feature: Ceres CLONE 1519838
  misc_feature (347)..(347): n is a, c, t, g, unknown, or other
  misc_feature (349)..(349): n is a, c, t, g, unknown, or other
  misc_feature (350)..(350): n is a, c, t, g, unknown, or other
  misc_feature (351)..(351): n is a, c, t, g, unknown, or other
aagctggagctccccgcggtggcggccgctctagaactagtggatcccccgggctgcaggaattctctccccctagaaaaaagcacaagtagaccggaaaaccccatctccccccgccgccccaccacgcccgatggccgccgtaaggtcgctgctccgctcgtcggcctcccttcttcgcgccgcccccgccctccagatctccgctaccacgcgtccggttttctttcggggcgcttggctgctctccccgccccctccgggcccccgtccagtcaagcttttccgcgggggaggtcccttttttgccttttttgaacccccccccctccccccgggggtccccncnnnttgtgaaaatctaatttttttttccccctttcctgggccaacggccccccctgggggggctcccccccccctgaaaccctcccgggattttaacccccccccccgggtgggggggttttttttggaccccccgcgccccctctctgtgttggcccccccccacccccct

SEQ ID NO: 60412 - DNA, 568 bp, Zea mays
  misc_feature: Ceres CLONE 1519840
  misc_feature: Encodes the peptide sequence at SEQ ID NO. 60413
aaagctggagctccccgcggtggcggccgctctagaactagtggatcccccgggctgcaggaattcgtctcacccctagaaaaagggacgccgctgctgacagggcacctgatggattgatttcctcgagcagtcagcggcgctaaagagtcacgagcttactggttgtaagcaacgatcgacgaacgaggggtgtagggagtggaaggaagaggctcagcgttcatggagagccgcaaggaggagcatgcggcggtggggtggatgaccgtgccggcgttcggggagtgggacgtgaagaacggcgccgtgccggactactccatggacttctccaagatccgcgagatgcgcaagcagaacaggcgcgagctctcccggtccgggcagcgcggcggtgcgacacgacacgactactcagagaagcacatcgcagaggagagggagcaggccagccgccaacagccctccgccctgtccggacgacgccacgtcgacgctgacgacgactccctacggggaagaagaagttcctgactatttccggtgcttgaccaaacgggaaaaa

SEQ ID NO: 60413 - protein, 103 aa, Zea mays
  misc_feature: Ceres CLONE 1519840
MESRKEEHAAVGWMTVPAFGEWDVKNGAVPDYSMDFSKIREMRKQNRRELSRSGQRGGATRHDYSEKHIAEEREQASRQQPSALSGRRHVDADDDSLRGRRSS

SEQ ID NO: 60414 - DNA, 662 bp, Zea mays
  misc_feature: Ceres CLONE 1519843
tggagctccccgcggtggcggccgctctagatctagtggatcccccgggctgcaggaatttgtctcacccctagaaaaaacctgtgcatcgagcgttctgcagcaagcctgctcccatgccgcgctcgcgaggttccctggcgttcgtcctggctgccgcgccccagctcctgctcgccggcgccgaggcccctgctccctctgctcgtcttccacttcgccggctctctgcgcgcgccgcacccagttgcctgcgcacgcgtcgctgtcaggttccgagcgcctgggtcttcttccccctgcgctcggtcatggtcaccgcgagtcgtgaaattccctacatgcctatgcctgcgcccatgcccacctccgtccctgggtgggccctgctcggttcttactgtgccgcgcccctggctcctctgttggccgcgcggtcgtttcctgctccgcgcgcgacaggctgactgagtgtcctgtgtcgtattagacaaaatctgttatatttgtcaagtatatggggggcctcccgttgttgccatacttaggattaccaaagataggaaccttgatcacggccacatcctgaaaggatctgtccccattacttgccccggtgaaaagattctgggacctccctttcccctcgggtaacccccctc

SEQ ID NO: 60415 - DNA, 806 bp, Zea mays
  misc_feature: Ceres CLONE 1519845
  misc_feature: Encodes the peptide sequence at SEQ ID NO. 60416
  misc_feature (15)..(15): n is a, c, t, g, unknown, or other
  misc_feature (16)..(16): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
ggcgttgggtggtgnngcgagacataaaannnnnnngcttnnnnntcaaactgagactccccgcggtggcggccgctctatactagtggatcccccgggctgcaggaattcgtctcacccctagaaaaaagacagaagacaacccgtcagcccctctcgtttttcatccgccttcgcctccaaccgcgtgcgctccacgcctcctccaggaaagcgagagcttctgcataagaacaacaaatcaaaagcgtgatcagctcggtgccaacaaaacctcaacaaccaagtttcatgtctgatctcgacgtccagcttccatctgcctttgatccgtttgctgaggcaaatgctgaggactctggtgctggtcctggaacgaaggattatgtgcatgtgcgcatcccgtagcgcaacggcccaaagagtcggacgacggtccagggtcctgaagaaaggagttcagctataacaaggatcctcacggatcccgaaaaaagaaattctgcctgcactggacactgtagattcaggcacccaagagctagggccaggtccattccggtctctcaaggtgaaccagttcgccaagaaatggtagcccacctttcccaaaattacaggctaggggacttgccgaaaaaaaaaatgaaacctccacgaatatcacggggcttccctataaggggccctggctcaaatggcctccgttgccccctatatattgcttgcgccccctcaacacctaatttgtgctgagataccctttatacacatattccaccgtgctctgtcttcacccccactcg

SEQ ID NO: 60416 - protein, 38 aa, Zea mays
  misc_feature: Ceres CLONE 1519845
MSDLDVQLPSAFDPFAEANAEDSGAGPGTKDYVHVRIP

SEQ ID NO: 60417 - DNA, 673 bp, Zea mays
  misc_feature: Ceres CLONE 1519846
  misc_feature: Encodes the peptide sequence at SEQ ID NO. 60418
atagctggagctccccgcggtggcggccgctctagaactagtggatcccccgggctgcaggaattcgtctcacccctagaaaaaagtcgttgacacaaagagaaattccacagccggggggcaaggctttaattgccccctctccctccctcgcctccttcaccatcccaccgagctttgcaacagctagtagcatgggcaagctgtgctgcagccaggaagacgacgagccggcgttcaacctcctggggctgctcgtcaccgtcgtcctcgccctgctcctgctcatgctgtgcacgccgccccgccgcaggcgctgcgtcgcctactacccccgttactgctaggacaggacggacgcggtggcggtggcacacgccgtcgagcttcagccttcttcgaggtagggaggaaaggatcaatcttctgctctgctctgcgatgggcgccgaagtaggcatcagacgtggagttcaattcgagtccgagttgtggagtatacaataaatcatgctggattgtttgtttgtatgtaaaagcgttctgttattattggtaaatcaatgtgactactgcataaggctggtccgtctgtaacctgaatcgagagtctgtctgttggtaaaaaatgaatggactacctggattttgttgacttggtaaaaaaaaaaaa

SEQ ID NO: 60418 - protein, 50 aa, Zea mays
  misc_feature: Ceres CLONE 1519846
MGKLCCSQEDDEPAFNLLGLLVTVVLALLLLMLCTPPRRRRCVAYYPRYC

SEQ ID NO: 60419 - DNA, 622 bp, Zea mays
  misc_feature: Ceres CLONE 1519848
  misc_feature: Encodes the peptide sequence at SEQ ID NO. 60420
  misc_feature (208)..(208): n is a, c, t, g, unknown, or other
  misc_feature (214)..(214): n is a, c, t, g, unknown, or other
  misc_feature (215)..(215): n is a, c, t, g, unknown, or other
  misc_feature (221)..(221): n is a, c, t, g, unknown, or other
  misc_feature (222)..(222): n is a, c, t, g, unknown, or other
tggagctccccgcggtggcggccgctctagaactagtggatcccccgggctgcaggaattcgtctcacccctagaaaaaggacatattccattcacctcccatccatttctcaccagaagcgaaggcggaggcggaggagcggaggtaggagatctcgagcaagccggaggcagaggagatgaagacgttcgacccgtggccggtctnttcttnnccgccnngggagtggaagcgcaactggcccttcctcacgggtttcgccatcaccggattcatcatcacgaagatgacggccaacttcaccgaggaggatctcaagaactcctaagttccgtcctaggaacacaaagaagaaagctactttgacgaacccaggtgaaggagttgtcagaaacgcatgtttggccagcccagtttctgttattgcttttgaaatgaaaaaatttagaccccttctttcctcgtttctttaatcgaaatgcttgcactctatgttccatttgtaatggaataagaggcaaattgagttgaccaaccaccaatcacttctggatggaaaaaaatccaatgtgtgggcctcgattgtttgggggaactcccaaaaaaaaaaaaaaaaccgga

SEQ ID NO: 60420 - protein, 49 aa, Zea mays
  misc_feature: Ceres CLONE 1519848
  misc_feature (10)..(10): Xaa is any aa, unknown, or other
  misc_feature (12)..(12): Xaa is any aa, unknown, or other
  misc_feature (15)..(15): Xaa is any aa, unknown, or other
MKTFDPWPVXSXPPXEWKRNWPFLTGFAITGFIITKMTANFTEEDLKNS

SEQ ID NO: 60421 - DNA, 651 bp, Zea mays
  misc_feature: Ceres CLONE 1519849
  misc_feature: Encodes the peptide sequence at SEQ ID NO. 60422
tccccgcggtggcggccgctctagaactagtggatcccccgggctgcaggaattcgtctcacccctagaaaaaaacatcgcccatcaatcgacacaagtcacttcgacgtcacgcgggtgctgcgcactcagacaccaactgtcggcacctatgccttactacctggaggtggactactgctcggaggaggtgaggtctctggccccggccggcttcagccgccacagcagcggcatccaacatcactccgccgaggaaacattcaaggagggcaacacggacacacccgccgggacaaagcaccaccaccaccatggccacgccggcggccacacctacgtggtgcgcaaaacaagagccaaagaggacatcaacacctgcaccagcatagttcccccgatagcaggaagatcttccctccccagggttaacttaacccgcccggatggccggaaaccactcccgatcccagcatgccctgacgaccctaaagaaatgcccccaggttgactgcctaggcacgggggcatacgccatggagtattccgtacctggtccgccccccgggtccagtccccaaataccaacaattattccccctgaaccctgaattaaaacatgactccgatgatcccgatcccttaccaacg

SEQ ID NO: 60422 - protein, 119 aa, Zea mays
  misc_feature: Ceres CLONE 1519849
MPYYLEVDYCSEEVRSLAPAGFSRHSSGIQHHSAEETFKEGNTDTPAGTKHHHHHGHAGGHTYVVRKTRAKEDINTCTSIVPPIAGRSSLPRVNLTRPDGRKPLPIPACPDDPKEMPPG

SEQ ID NO: 60423 - DNA, 671 bp, Zea mays
  misc_feature: Ceres CLONE 1519852
  misc_feature: Translation starting site: 152
atagctggagctccccgcggtggcggccgctctagaactagtggatcccccgggctgcaggaattcgtctcacccctagaaaaatcaaccctatttccaaaaaacgaactagaaacgaccgcgaagccacaggtcgaaggcggcggcggtcatggggagcgactcggatactgaaaagaaggcctcggtggcgctaatgtccatcgcgaaacccctcgctggaaagaagctctgcaagcggaccctcaagctcgtgcgacgagcctccgaggcgaagtgcctcaggcgcggagtcaaagaggtaggcaagagcattctccgcgcgaacaaaggattgtgtgtgatccctggaaatgtttctcctattgatgtgattacacgtgttccgatactatgtagaagaagctaatgttccttacgtatatgttccatcaaaggaggatcttgcgaccgcatgaaccactaagaggccgacttgttgcgtcatggctctgaccatgccagacccgggggagctcagtgtagaggtgaaggataaactgacgtcggactatcaccaagttgtaacggaagacgctgaagctatatctgccatgttctgaggaccacgttatctgataatcaggcaatttcctgtgcacgtcttttcttggggaggtaccctgcccagc

SEQ ID NO: 60424 - DNA, 821 bp, Zea mays
  misc_feature: Ceres CLONE 1519853
  misc_feature: Encodes the peptide sequence at SEQ ID NO. 60425
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (821)..(821): n is a, c, t, g, unknown, or other
tccctttcttacaaataacccaccggccttagtcccnnnnnnnagaaaannnnaaagagtggggctccccgcggtggcggccgctctagaactagtggatcccccgggctgcaggaattcgtctcacccctagaaaaacccacccacgccgacgagcaaaccctagcgagcgagagagcccggagccgagagaccagccagccatggcgctgcgtgccctgtacaacgagatccggagcatgaaggtccgcgacgtgccggcttacctgaagccgcgcttgacctgggacaacgtcaagaagagcgtcgaccaggccgtcgaccgctacatcgagaaggacatcgccccgaggttcgccggaccctctctgccacgtctggctcggagggatgattttccccctacttccgccattcttttcccgcgcaccccgcggggggggggggggcgttaatgaccaccggaccccgatctggcggggaagaccagggccccgctttttccagcccccccgcccgccggccccgggcccggcatgcgctaagacttttttggcgaggccccttcccccggcccccccagcctcttttcgccccctgtttttggcctgccgcgcgccccggtgaccccactcgttcccccctctctcccgcctttgcccctcgccccccgtcggttcggggccggcggcaagtggcgccccgaaccgtgaatggggcgtgggctcttgcccttcgcatgcccgcccccccccgccgcatcacttcttatacacacccaataacgccatacccaagccatgttattaccccgccacccn

SEQ ID NO: 60425 - protein, 83 aa, Zea mays
  misc_feature: Ceres CLONE 1519853
MALRALYNEIRSMKVRDVPAYLKPRLTWDNVKKSVDQAVDRYIEKDIAPRFAGPSLPRLARRDDFPPTSAILFPRTPRGGGGR

SEQ ID NO: 60426 - DNA, 651 bp, Zea mays
  misc_feature: Ceres CLONE 1519854
  misc_feature: Encodes the peptide sequence at SEQ ID NO. 60427
tctgaactagtggatcccccgggctgcaggaattcgtctcacccctagaaaaaagccaggtggagagggcagatccgagaagagccggcgcgatgagctcgccggcgaggtcgaccatctcggccgccgaagacgtcgctgattccatcgacgcgctctaccgcaaggacgaggccatggctgaactcaagtctgaggtgatggaggcgctgcagagggaggtgaggtctctcgacgaagacaactggatgttcgccgcaccgcggtcccgcatcaacctcgtctccaggcctggtgcttacctgcccaagcaacacgggaaactctcatagttcgcccccccccctccgagggggggggggaacttctagggcgtacatgccttgggcttgcaagaagcccgggcccacgaccccactgatggtaggggaagggttgtcacattccaggactgacctgctcctcgcttcccactcattttgggtggccttcccggctacactccatttccccacccccgcctagggattttttccaggtggaacggccccacccgccgtgcctcggttgtcggtttcttttgctcaatgccaccccacccgacttaactttttgccccataccccgtcccccgcctcattacctcccccc

SEQ ID NO: 60427 - protein, 79 aa, Zea mays
  misc_feature: Ceres CLONE 1519854
MSSPARSTISAAEDVADSIDALYRKDEAMAELKSEVMEALQREVRSLDEDNWMFAAPRSRINLVSRPGAYLPKQHGKLS

SEQ ID NO: 60428 - DNA, 664 bp, Zea mays
  misc_feature: Ceres CLONE 1519857
  misc_feature: Encodes the peptide sequence at SEQ ID NO. 60429
atagctggagctcaccgcggtggcggccgctctagactagtggatcccccgggctgcaggaattcgtctcacccctagaaaaactcccagctggtttggtttggtttcgttttggttttggttgggttttcacaggcaccgcgcgcgcgccggcgatcgagatggccgactggggccccgtggtggtggcggtggtgctgttcgtgctgctgtcgccgggcctgctgctgcagctgccggccaagggcgggcgcttcgtggagttcggcaacttccagaccagcggcgcctccatcttcgtccacgccatcatcttcttcgccctcgccgccgtcttcctcatcgccatcggggtgcacatcaccacggactagccgtctagccccatagccgggaccgggatctttcttcgttacagtctgcctgtatatacatatatacatacatgctcagtacgtacgctttaccactctgtcagtgagtatctctttgtatcagcacccctgctgtgtgcgtacctagcaagtgtttatttgggctctggtctggcctgttatcattccacggcgcagcaagaaaccccgattcttttgcttcccaaaaagaaataaatccccccaaagttcagccttctggacaaaaaataataccccgcgccccccct

SEQ ID NO: 60429 - protein, 70 aa, Zea mays
  misc_feature: Ceres CLONE 1519857
MADWGPVVVAVVLFVLLSPGLLLQLPAKGGRFVEFGNFQTSGASIFVHAIIFFALAAVFLIAIGVHITTD

SEQ ID NO: 60430 - DNA, 662 bp, Zea mays
  misc_feature: Ceres CLONE 1519859
  misc_feature: Encodes the peptide sequence at SEQ ID NO. 60431
aagctggagctccccgcggtggcggccgctctagaactagtggatcccccgggctgcaggaattcgtctcacccctagaaaaactctccgtgctttctcagaggcgggttggcttctcctcccccaccggttcgtgttcaggttctggttcgtgggcgagagggaagagatggcggcgtcggacgttgagtaccgttgcttcgttggcggcctcgcctgggccaccgacgaccactccctcaacaacgccttcagcacctacggcgaggtcctcgagtcgaagatcatcctggatcgggagacgcagaggtcccgcggcttcggcttcgtcaccttctccacggaggacgcgatgcgcagcgccatcgagggcatgaacggcaaggagctcgacggccgcaacatcaccgttaacgaggcccagtcccgcggcggccgcggaggcggcggtggcggataccgtggcgggcgccgtgatggaggcggctaccgcggtggcggtggccgctaccgaggtggtcgtggaggctacggcggcggcggtgggggatacggtgggtggaaccccgcggcgcggctaacgcaacaacgacgggaactgggaggactgagccggtggggtccggctgagcctagttatcttggtcgcttctgctaccggg

SEQ ID NO: 60431 - protein, 164 aa, Zea mays
  misc_feature: Ceres CLONE 1519859
  misc_feature (10)..(81): Pfam Name: RRM_1 Pfam Description: RNA recognition motif. (a.k.a. RRM, RBD, or RNP domain)
  misc_feature (48)..(132): Pfam Name: GRP Pfam Description: Glycine rich protein family
  misc_feature: SWISSPROT Homolog: EC 5.2.1.8 Peptidylprolyl isomerase
MAASDVEYRCFVGGLAWATDDHSLNNAFSTYGEVLESKIILDRETQRSRGFGFVTFSTEDAMRSAIEGMNGKELDGRNITVNEAQSRGGRGGGGGGYRGGRRDGGGYRGGGGRYRGGRGGYGGGGGGYGGWNPAARLTQQRRELGGLSRWGPAEPSYLGRFCYR

SEQ ID NO: 60432 - DNA, 634 bp, Zea mays
  misc_feature: Ceres CLONE 1519860
  misc_feature: Encodes the peptide sequence at SEQ ID NO. 60433
ctggagctccccgcggtggcggccgctctagaactagtggatcccccgggctgcaggaattcgtctcacccctagaactgccagcggcggctgaaggcggcgcggtatcagcttggtgatttgtgagcgatggcgcccccggggtcgcggcggtgggcttacgtgcgcgtgatggccggcaccatcctcggtggcgtacttggattctacgtcatgcaccgcgtcgagacctcgtacaaggcgagaatggaggataggctgctgagatacgaggcgcatctgcttgccaaagccaaggagtcgcagcagttgcaggacgatgcacagcgggaggataaagcccagttcctgcccgactcgtgacaccgacattcttcccctcttgcagctgctcttttcaagctgttagaataacataaggcactggggccaaggagtccgtccactcgtttattcagatgtagagacataagatcgacatgcactttttgcttgctgctgacttcttattctggatcaagaacaatgcaccattctagcgcaaggtgggcgtcaatgtatgaacgccaaatatgaatatactttgatgtctatccgcacgtactctgctttgcaatctatgggttttcatcaa

SEQ ID NO: 60433 - protein, 77 aa, Zea mays
  misc_feature: Ceres CLONE 1519860
MAPPGSRRWAYVRVMAGTILGGVLGFYVMHRVETSYKARMEDRLLRYEAHLLAKAKESQQLQDDAQREDKAQFLPDS

SEQ ID NO: 60434 - DNA, 705 bp, Zea mays
  misc_feature: Ceres CLONE 1519862
  misc_feature: Translation starting site: 163
  misc_feature (394)..(394): n is a, c, t, g, unknown, or other
  misc_feature (395)..(395): n is a, c, t, g, unknown, or other
  misc_feature (399)..(399): n is a, c, t, g, unknown, or other
aatctggagctccccgcggtggcggccgctctagaactagtggatcccccgggctgcaggaattcgtctcacccctagaaaaatccaacccatcagtacccaaccttcccctacaccagaaaaatccccagttctttggtccgcgtcagagaggcggcggcgatgtctgggcgcggcaagggcggcaagggtctgggcaagggcggcgcgaagcgccaccggaaggtgctccgcgacaacatccagggcatcaccaagccggcgatccggaggctggctaggaggggtggcctgaagcgcatctcggggctcatctacgaggagacccccggcgtgctcaagatctttctcgagaactttttcccccccccccccacgggggggggggggggcnngctnaaaaaccttctacttccatggaatttcttctacccgcttcaaccgcccgggccccccccctcgacggcttttagaggcttaggctttgccccctccttccgtagccggggaccgggttagcgggatattgtcccccccccgcacccttttccccgaggtcggccttggcgcccatttcgctggctcaacaccctcccctccccggtccgccaatcctctttaacccacatcctcctgttggtatcgggggccccccccgaccaacttttaccttctcgccccacccccgccttgttaccgcccccc

SEQ ID NO: 60435 - DNA, 683 bp, Zea mays
  misc_feature: Ceres CLONE 1519863
  misc_feature: Encodes the peptide sequence at SEQ ID NO. 60436
  misc_feature (394)..(394): n is a, c, t, g, unknown, or other
  misc_feature (619)..(619): n is a, c, t, g, unknown, or other
atagctggagctccccgcggtggcggccgctctagaactagtggatcccccgggctgcaggaattcgtctcacccctagaaaaagcgcaaacatcgaatcgtctcactcgtgtctgccctgctcatactgcttgccctcgccgtatcgtccacccgcaacgcacaggaggattccatggccaacaacaccgggacgttggtgggcggcatccaggacgtgccggggagcgagaacgaccttcacctccaggagctcgcccgcttcgccgtcgatgagcacaacaagaaggccaatgctcttctggggttcgagaagcttgtgaaggccaagacacaagtggttgctggcacgatgtactatctcactcccgaagtggaggagggcgaaggtcanaacctctacaaagctaaggtatgggagaagccatgggagaagttcaaggacctgcaggaattcaaacctgttgaagaaggtgctagccgcctaaggatgtctcctttctccatgtggcgagcctgaaatctcaaagcaaagtttcaaaaataaggagcccatgctccccttgtggaaatttcataaaacctacaacccctatttggggcttggtttgggttgggntcccgcatccaaaagggaatttaaaggttgatttcattttcccccccccctcctacaaaaaggg

SEQ ID NO: 60436 - protein, 114 aa, Zea mays
  misc_feature: Ceres CLONE 1519863
  misc_feature (10)..(98): Pfam Name: Cystatin Pfam Description: Cystatin domain
  misc_feature (73)..(73): Xaa is any aa, unknown, or other
MANNTGTLVGGIQDVPGSENDLHLQELARFAVDEHNKKANALLGFEKLVKAKTQVVAGTMYYLTPEVEEGEGXNLYKAKVWEKPWEKFKDLQEFKPVEEGASRLRMSPFSMWRA

SEQ ID NO: 60437 - DNA, 647 bp, Zea mays
  misc_feature: Ceres CLONE 1519864
  misc_feature: Encodes the peptide sequence at SEQ ID NO. 60438
  misc_feature (597)..(597): n is a, c, t, g, unknown, or other
aaagctggagctccccgcggtggcggccgctctagaactagtggatcccccgggctgcaggaattcgtctcacccctagaaaaaggaccggcttcttgtgccaggcaaaaaaaacgaggatcccaagttcccttcacaaactgcagggggaggcgaacctcgtgcagcgcggccatggcgaagcagggggcgaagaagatgaaggacgagaacaagaagcgcttggacttactcctgcgcatcatcttcatatccaacgctatttacatagtggtgaggatggctataatgcattcatccttcacctggaagcattggattggccttatggtaacatcggcagcatattttcttccatataagcaactcgccagtatggcaaagccagtttactctgataacggagaactactggatggtggcttcgatttgagcactggtggggtttgcgagtatttatatgatgtgatctacatcactgtctttgtgcaattgatgtctatcattttctgaaaatttttggtggacatatttagtgattcccgcttttgccggatacaagattcccgtttgtttaagaagaattttttttagggnccccccccagggtgaagttggacaccaaaaaattttatttaatttgtttt

SEQ ID NO: 60438 - protein, 112 aa, Zea mays
  misc_feature: Ceres CLONE 1519864
  misc_feature (1)..(112): Pfam Name: DUF788 Pfam Description: Protein of unknown function (DUF788)
MAKQGAKKMKDENKKRLDLLLRIIFISNAIYIVVRMAIMHSSFTWKHWIGLMVTSAAYFLPYKQLASMAKPVYSDNGELLDGGFDLSTGGVCEYLYDVIYITVFVQLMSIIF

SEQ ID NO: 60439 - DNA, 560 bp, Zea mays
  misc_feature: Ceres CLONE 1519865
  misc_feature: Encodes the peptide sequence at SEQ ID NO. 60440
ggcgccacggcggcgacgagaagtggcgagccccgagagcgggtttagttagaggctacgggcggtcgggcgcggcggcggcggcggccatgagcagcgggagcgagagcactaccgccagcaggtggcccgagctggccacgctgcgcgccctggcgcgcgacgccgcggagcagctgcggctgccgcgggccggcacgtcggcgtcggcgtcggcgtcgtcgtcgccgtggcgcgggcgcgaggaccacctctacggccacggcaagacggccaaggtgatgcacctgctgctctggggacccaagtgaagcggcgagaggccaccgtaccgccggcgttgctcgttttgctctgcctgcaatccgccccgcacggactgtactgtactgtacctatacacctatatactacgacgtgcacatgtacgagtctacgacgtgctgctgtaccatactaatactagtgcgctgctgctcccttgccttcttgcttgcaagttgcaccagccactccgcttttttttgctcgaacgatcgactgctcgtcgcgtcgggcca

SEQ ID NO: 60440 - protein, 73 aa, Zea mays
  misc_feature: Ceres CLONE 1519865
MSSGSESTTASRWPELATLRALARDAAEQLRLPRAGTSASASASSSPWRGREDHLYGHGKTAKVMHLLLWGPK

SEQ ID NO: 60441 - DNA, 653 bp, Zea mays
  misc_feature: Ceres CLONE 1519867
  misc_feature: Encodes the peptide sequence at SEQ ID NO. 60442
aaagctggagctccccgcggtggcggccgctctagaactagtggatcccccgggctgcaggaattcgtctcacccctagaaaaaagccccgccgatacgacgacttgtctcattgattcttcaccatatcgagcttcctttgcaccacagcgtcaaggatgtcttgcatctgcggatccatctgcggctgcgagtacagctgcaagtgcgggaggaactaccctgacctgaaggagacgaccaccgccacgccggacaccgccgtcctcaggatgaccccgaacaacaaggccgcgaccgagttcatcaaggccacggcatagtccagaaaggccgcccacggctgcaggtgcgcaggcaactgcgtctgcgacccctgcagctgatgatgacatcaatcgacaaccctggctatagattcctatctatctaggttgcggtggtggctgcaccatcatacagcgacggcgatctggctgccctacataggtactgcatgttgtgtgtgacagaaagagagacacagaccttctgatggctatctctcgctgcacggttggcgtcaatctttctgctcatgtacatacaagtgtctacatgcatgatgctctatccgatcgcatctcgctctatcatgaatcaaatgctgcacg

SEQ ID NO: 60442 - protein, 54 aa, Zea mays
  misc_feature: Ceres CLONE 1519867
  misc_feature (1)..(55): Pfam Name: Metallothio_2 Pfam Description: Metallothionein
MSCICGSICGCEYSCKCGRNYPDLKETTTATPDTAVLRMTPNNKAATEFIKATA

SEQ ID NO: 60443 - DNA, 592 bp, Zea mays
  misc_feature: Ceres CLONE 1519873
  misc_feature (308)..(308): n is a, c, t, g, unknown, or other
  misc_feature (397)..(397): n is a, c, t, g, unknown, or other
  misc_feature (532)..(532): n is a, c, t, g, unknown, or other
ctccccgcggtggcggccgctctagaactagtggatcccccgggctgcaggaattcgtctcacccctagaaaaaatcggcagtgcaggatggctctgaggatgtgggcgagctcagccgccaatgcgctcaagctctcgggcggcgccggagcccgggctgctgccttctctatctccaggttcttctccactgttcacgatgggttgaagtacactcagtctcacgaatgggtcaagacgacgggcgacgtcgccaccgttggcatcacggaccatgctcagggccacctggggagaggtggtgttncgtggagctgccggaacccggcacgaaggtcgccgcgggaggacccttcggcaacgtgggagagcgtgaaaggccaccccagcgacgtncaactcccccgatctcccggccgaaggggtccgttcccaaaggttctaatggtggcaaaaatttttttaaaaaaaaaaaccccccccccggctgtttttattaaaaaaaaaacccccccccccccaaaaaaaaanggggggggttttttttttaaaaaaaaacccccccaccccccccgggggggggggggaaga

SEQ ID NO: 60444 - DNA, 678 bp, Zea mays
  misc_feature: Ceres CLONE 1519874
  misc_feature: Encodes the peptide sequence at SEQ ID NO. 60445
acccgcggtggcggccgctctagaactagtggatcccccgggctgcaggaattcgtctcacccctagaaaaagcacatgtgcatctcagcagcactagcagtgacaaactcgaagcttgcctccttgtccattttttaatactattactagaccccgcggccccctgctcggctatctagatggacgatatcaaggtggaccagctgtctgtaggtgatactaggtctctgggcccttctgttctgcgagctttgtcggaaatgtacctgcatggccgagcaaagagtgctggtggggctaccgaccagctcgtccaaaatgtgtatagttgcgaccaccttctctcgaggtgctcccctcttgcacaactgcagaccccgtgtcctaccgtgaagggcaccacaaaaaaaaggttctcgcgacttcatctccgacccatgaagactgcgagattctctaggtcattcacttccaccctgctctccttgaccaatggatgctatcttccatctggatgttctctttccgtctgtccagctagctatgctagcctagatcactgataaccagctgctgttcctgcaattttgcccgaaaatgtgacgcttttcactccccctgactttcttcatttcagggtcacgttctgacctgatatctgtttgccaaaaattcct

SEQ ID NO: 60445 - protein, 127 aa, Zea mays
  misc_feature: Ceres CLONE 1519874
MDDIKVDQLSVGDTRSLGPSVLRALSEMYLHGRAKSAGGATDQLVQNVYSCDHLLSRCSPLAQLQTPCPTVKGTTKKRFSRLHLRPMKTARFSRSFTSTLLSLTNGCYLPSGCSLSVCPASYASLDH

SEQ ID NO: 60446 - DNA, 621 bp, Zea mays
  misc_feature: Ceres CLONE 1519875
  misc_feature: Translation starting site: 143
  misc_feature (274)..(274): n is a, c, t, g, unknown, or other
  misc_feature (355)..(355): n is a, c, t, g, unknown, or other
gctctagaactagtggatcccccgggctgcaggaattcgtctcacccctagaaaaagacctgcagccaaccatctaccagcgactcagcgagcgagagcagcacacacgcagctagctaggagcagcagcagagcagcggcgatggcggcctccatgatctcctcgtcagctctggcggtggcgcctcagggcctgccgcccctcggccgccgcgcctcctccttcgccgtcgtctgctccaagaagaagatcaagaccgacaagccctagggnaattgggggtggcctggaccgtcgacgtcgacgccaacgggagaaagggcaagggcaagggcgtgtaccagttcgtcgacnagtacggcgcgaacgtcgacggatacagcccaatctacaacgaggatgactggtctcccaccggcgacgtctacgtcggtggaaccactgggcttctgatctgggccgtcaccctcgctgggatcctcgggcgcggcgccctcctcgtctacaacacagcgccctctcgggctaggatatcaatgcatgcggcttctgcgattcgtctggaaaatcgggtggtcggctatatcaagcctcctgaagcccaacctccgcagggaaaa

SEQ ID NO: 60447 - DNA, 659 bp, Zea mays
  misc_feature: Ceres CLONE 1519880
  misc_feature: Encodes the peptide sequence at SEQ ID NO. 60448
  misc_feature (483)..(483): n is a, c, t, g, unknown, or other
tggagctccccgcggtggcggccgctctagaactagtggatcccccgggctgcaggaattcgtctcacccctagaaaaagcgcacacatcgaatcgtctcactcgtgtctgccctgctcatactgcttgccctcgccgtatcgtccacccgcaacgcacaggaggattccatgggcaacaacaccgggacgttggtgggcggcatccaggacgtgccggggagcgagaacgaccttcacctccaggagctcgcccgcttcgccgtcaatgagcacaacaagaaggccaatgctcttctggggttcgagaagcttgtgaaagccaagacacaagtggttgctggcacgatgtactatctcactattgaagtgaaggatggcgaagtcaagaagctctacgaagctaaggtctgggagaagccatgggagaacctcaaggggctgcaggaattcaagcctgttgaagagggtgctagcgcctaangatgtctccttctccatgtgcgagcctgaagctcatagcaaagttgcataataaggagccatgctcccttgtgtaatttcataagactacaaccctattacggcttgcttggttgtgtctgtatccgaagggaatgaagggtgataatttttcttctattctaatagaggggtttt

SEQ ID NO: 60448 - protein, 103 aa, Zea mays
  misc_feature: Ceres CLONE 1519880
  misc_feature (10)..(98): Pfam Name: Cystatin Pfam Description: Cystatin domain
MGNNTGTLVGGIQDVPGSENDLHLQELARFAVNEHNKKANALLGFEKLVKAKTQVVAGTMYYLTIEVKDGEVKKLYEAKVWEKPWENLKGLQEFKPVEEGASA

SEQ ID NO: 60449 - DNA, 563 bp, Zea mays
  misc_feature: Ceres CLONE 1519882
  misc_feature: Encodes the peptide sequence at SEQ ID NO. 60450
  misc_feature (412)..(412): n is a, c, t, g, unknown, or other
  misc_feature (470)..(470): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (535)..(535): n is a, c, t, g, unknown, or other
  misc_feature (536)..(536): n is a, c, t, g, unknown, or other
ctccccgcggtggcggccgctctagaactagtggatcccccgggctgcaggaattcgtctcacccctagaaaaaaaaaatctcctaccactacactaccaccgtttcagtgctataggataggattttcttttgacggccatgaaaccccctcagctgccggccggggagcgctcctgggctcacgaggtcaagcaggccctccgtgagaaactccggcgctcctacggcgccgcctccgccacaccggcggccggtgaaccgagccgtggcgccgactgccgtggctcggccgccgaagaccccataaggagagtcatgttcttggctccctggggccacacataaaaccagacccagatctgggcttgcagagcatggccggatctgcaaaagactgctcaccatacttnaaaagaactggagcttgtcttgtaactatggagcatgctgcttgcaccacgacatgancgcatggctggttactagtattnnnntggggnnnnnnnnnnnnnnnnnaaaaaaaaaaaaaaaannggggtgggtcccccccccggccccccc

SEQ ID NO: 60450 - protein, 68 aa, Zea mays
  misc_feature: Ceres CLONE 1519882
MKPPQLPAGERSWAHEVKQALREKLRRSYGAASATPAAGEPSRGADCRGSAAEDPIRRVMFLAPWGHT

SEQ ID NO: 60451 - DNA, 655 bp, Zea mays
  misc_feature: Ceres CLONE 1519884
  misc_feature: Encodes the peptide sequence at SEQ ID NO. 60452
  misc_feature (548)..(548): n is a, c, t, g, unknown, or other
  misc_feature (561)..(561): n is a, c, t, g, unknown, or other
  misc_feature (634)..(634): n is a, c, t, g, unknown, or other
ctccccgcggtggcggccgctctagaactagtggatcccccgggctgcaggaattcgtctcacccctagaaaaagcaacacagcaagtcccgaccttgcctcctactgcagcagcagcataaccagaggggagtgcagcaagccgtttcgagagacagctttaggctactgctagcagtatggcttccgctgcgcgcttcctggtggccgtggtcgtggcgtgtgcactcctggccagcaacaactgccatgcggcgcgccacttggccgacacggccgcggctcccgctgctgctggtgtcgtccctggcctccccgccgtgccgaccttgccaacggtgcagccagtgccggcgctgccacctatgccggccgtgcccgcggtcaccgtgccgcagatgacgctgccgcccatgccagcggctcccaaggtggccgtgccgctgccgctgccgccaatgcccgccatcccatccgtgctgcccaagctgaccctaccaccgatgcccactgtcgttccaaccgtcgtccccaaggtggccttgccngccgatgccgtcngtcccgaacgtgaacgtggcccatgccgttcgcggcacgccctccatcggcgtaaacacagtgctcccgccangttttgggttcgcgtggcccc

SEQ ID NO: 60452 - protein, 158 aa, Zea mays
  misc_feature: Ceres CLONE 1519884
  misc_feature (128)..(128): Xaa is any aa, unknown, or other
  misc_feature (152)..(152): Xaa is any aa, unknown, or other
MASAARFLVAVVVACALLASNNCHAARHLADTAAAPAAAGVVPGLPAVPTLPTVQPVPALPPMPAVPAVTVPQMTLPPMPAAPKVAVPLPLPPMPAIPSVLPKLTLPPMPTVVPTVVPKVALPADAVXPERERGPCRSRHALHRRKHSAPAXFWVRVA

SEQ ID NO: 60453 - DNA, 653 bp, Zea mays
  misc_feature: Ceres CLONE 1519885
  misc_feature: Translation starting site: 87
  misc_feature (429)..(429): n is a, c, t, g, unknown, or other
  misc_feature (519)..(519): n is a, c, t, g, unknown, or other
gcggtggcggccgctctagaactagtggatcccccgggctgcaggaattcgtctcacccctagaaaaaactactgacgagctcgccatggcctccctctcctctgccgccgtcaccgccccttccttcgccgcaccagcgccagcccgcgccgtggtcagaaggaggtccttcaccgtgcgcgcctctctccgcaaggccaccggcaccgccgccgtggcaatggctgccagcgccctgcttgccggcggtgccatggcccaggaggtgctgctgggcgcaggcgacggcgggctcgtcttcgagcccagccagttcaccgtcaaggccggcgacaccatcacattcaagaacaacgccggcttcccgcacaacgtcgtcttcgacgaagacgaggtgccgaagcggcgtcgacgccaccaagatctcngcaggaggagtacctcaacgcgccaggcgagacctactccgtcaccctcaccgtgccgggaacctacggcttctactgcgagccgcatcnaggagccggaatggtcggcaagatcaccgtcaactaattaagctagctatcgatcgatatccattcatggtataagctggtgcttccctgcttgtactcccgccgatctgtcatctctaacatggttttcgtct

SEQ ID NO: 60454 - DNA, 643 bp, Zea mays
  misc_feature: Ceres CLONE 1519887
  misc_feature: Translation starting site: 167
  misc_feature (474)..(474): n is a, c, t, g, unknown, or other
ggcggccgctctagaactagtggatcccccgggctgcaggaattcgtctcacccctagaaaaatctctagctcgctcgccatcccctgcccggctgctgcccccaacggaacgacggccagaggaagctaccagagtcgatcgatcgagagagagagagagagagcatggctcggcaggagtttcctagattcggtcccccaaggaggaggagtccaacgccgccgtcagagaagctgtactgctgggagcaaagaacgccgcactagctggtactgtggttgcagttcccacgttggttggctgccgtgtccttccttgggctaaggcgaatctcaactacactgcacgagcactcattatatctgcagcctgtattgctggcttcttcatcactgctgacaagacattctacggtacgcacgacagaacaccatcggggagcttgggacagtcacttgatgcatagatgtanctgaagctggtaaggttctcctggttgccgcggcggtggatagggtggctattgccccatatgcaggggcaccttttctcttcggggacaagtattttttgggtggttggctatgcaaacaggagttggggctgaaatgattgtcaaacgagggaccccatttttgtat

SEQ ID NO: 60455 - DNA, 657 bp, Zea mays
  misc_feature: Ceres CLONE 1519891
gcggtggcggccgctctagaactagtggatcccccgggctgcaggaattcgtctcacccctagaaaaaaaaagcagtcctcccaccgcacgcaacgcagcctcgacctcgacctcgccgtcgccgtggtgagcaagcagacccgccgcctcctcgtccttgccgccgtcgccgtatgcctccacctccccgccgcctctgtcgccaccgacgtcgattactgcagtagaaaggagtacccggtgaaggtgagcggggtgcatatcgtgcccgatccggtcgagcccggtaagcccgccactttcgagatctccgcttctactgataaaaccatcgagaaggggaagctggtgatcgacgtctagtacttcttcttctacgtgcactcggagacgcgcgaaatctgcggagagatctcctgtccggcgaccggcgacttcgtgctgtcccacgagcagacgttgccagggttcactccaccggggtcatacacgatctacatgaagatggtcggggacgacaacgaggagctcagctgcatctcgttcggcttcagacattgagttcgtcgcctccagctgaaacccacctgaactgcgcgacacatgtcgccccacatggatggtattatgtaaacaaatggatttacggagacgct

SEQ ID NO: 60456 - DNA, 632 bp, Zea mays
  misc_feature: Ceres CLONE 1519897
  misc_feature: Encodes the peptide sequence at SEQ ID NO. 60457
  misc_feature (566)..(566): n is a, c, t, g, unknown, or other
ctccccgcggtggcggccgctctagaactagtggatcccccgggctgcaggaattcgtctcacccctagaaaaagcaaacatcgaatcgtctcactcgtgtctgccctgctcatactgcttgccctcgccgtatcgtccacccgcaacgcacaggaggattccatggccaacaacaccgggacgttggtgggcggcatccacgacgtgccggggagcgagaacgaccttcacctccaggagctcgcccgcttcgccgtcgatgagcacaacaagaaggccaatgctcttctggggttcgagaagcttgtgaaggccaagacacaagtggttgctggcacgatgtactatctcactattgaagtgaaggatggcgaagtcaagaagctctacgaagctaaggtatgggagaagccatgggagaagttcaaggagctgcacgaattcaaacctgttgaacagggtgctagcgcctaaggatgtctccttctccatgtgcgagcctgaagctcacagcacagttgcagaataaagagccatgctcccttgtgtaatttcataagatacnaccctattacggcttgcttgattgtgtctgtatcgaaaggaattgaaagcgattaatttttcttct

SEQ ID NO: 60457 - protein, 103 aa, Zea mays
  misc_feature: Ceres CLONE 1519897
  misc_feature (10)..(98): Pfam Name: Cystatin Pfam Description: Cystatin domain
MANNTGTLVGGIHDVPGSENDLHLQELARFAVDEHNKKANALLGFEKLVKAKTQVVAGTMYYLTIEVKDGEVKKLYEAKVWEKPWEKFKELHEFKPVEQGASA

SEQ ID NO: 60458 - DNA, 640 bp, Zea mays
  misc_feature: Ceres CLONE 1519900
  misc_feature: Encodes the peptide sequence at SEQ ID NO. 60459
  misc_feature (507)..(507): n is a, c, t, g, unknown, or other
tggcggccgctctagaactagtggatcccccgggctgcaggaattcgtctcacccctagaaaaacccccccacacgcatcacccaccgcgcgccgcctcgtgcgtgcctctcaattccgtctcgttctcgccggtgatctgcagcagcagccatgatgatggcgtgtgccctcgccgtcgcccagccagcagcatctctcgcgccgccatccggcaagaggaccctctccggcggccgccccccgcggctgccacctcccaggctttcaggtaaacttgccttcgccacaccgtgctgcgtgcgtggtgcaggcaagctaataaggagccgcgctgtcattgccaaggctgcgcaggacgactcggaatcgtccgggaccgggagcatagtgaaatacgtcacgagctctttcagcaccgcggaagacatttttgccctagctggtataggctttgccgcagtagctgcattatgggcttcggtcaacctcattgagatcatcgacnagctcccggtccttcctcttctctttgactagtcgggatattggttgcatggcttttcatctacaacaatctcctcttcaaggcaaaaaagaaagaatttctaagagacatcaaaagctcaggatctcgaatc

SEQ ID NO: 60459 - protein, 128 aa, Zea mays
  misc_feature: Ceres CLONE 1519900
  misc_feature (119)..(119): Xaa is any aa, unknown, or other
MMMACALAVAQPAASLAPPSGKRTLSGGRPPRLPPPRLSGKLAFATPCCVRGAGKLIRSRAVIAKAAQDDSESSGTGSIVKYVTSSFSTAEDIFALAGIGFAAVAALWASVNLIEIIDXLPVLPLLFD

SEQ ID NO: 60460 - DNA, 623 bp, Zea mays
  misc_feature: Ceres CLONE 1519902
  misc_feature: SWISSPROT Homolog: EC 3.5.1.52 Peptide-N(4)-(N-acetyl-beta-glucosaminyl)asparagine amidase
  misc_feature (562)..(562): n is a, c, t, g, unknown, or other
cggtggcggccgctctagaactagtggatcccccgggctgcaggaattcgtctcacccctagaaaaacctgcttgcacgccagccactccgaggcctactctagggttgaggaatatgcaggaacagacaggcaaccagtgccaccgccagagcgatcaacaatgggctccttcttctcgacattagtgacgccccctccgcccgccgccgaggacccaaaatgagccgtggtggcagcgcactccaaggccacctacgacgagcagtgggcggcccacaaaatcagcatcaagctgatggagatcgacttctcggcgtcctggtgcgggccctgccgcatcattcaagacggccttcaaggagctggcctcccgcttcaccgatgccgtcttcatcaagggcgacgtcgacaagctctcggaagtctcaggacatggaaggtataggcgatgccaacgttcttgctggtcaaggatggtaaggatgtacgccgtgtgattgctgctaatacgactagcttgatgagaaatcaggatgtgcgtaacgacatcttcgtcgtcntagcttagcagagcagactctccagcttcatagctgtttcgcgactccagaggttactggg

SEQ ID NO: 60461 - DNA, 655 bp, Zea mays
  misc_feature: Ceres CLONE 1519904
  misc_feature: Encodes the peptide sequence at SEQ ID NO. 60462
  misc_feature (220)..(220): n is a, c, t, g, unknown, or other
  misc_feature (375)..(375): n is a, c, t, g, unknown, or other
  misc_feature (383)..(383): n is a, c, t, g, unknown, or other
tggcggccgctctataactagtggatcccccgggctgcaggaattcgtctcacccctagaaaaaaaccggacagctccccacaaaaccgtcagttctcttttcccctgtaaatcgcaaattcgtcttccctgcccatctatcgcttggacacctctgcaagggagcacatggctctcgagaaggccaaggagatcatcgcgtcctccccggtcgacctanctctccgaaaggccaaggagaccgtcgcctcccaccccgtcgtcttcttcagcaaaacttactgccctttctgcacccgagtgaaacaattgctagcaaagttggggggcaagttattttttaccccccccccaagggggggggggggggggctnaactgcantcaactcttcgctgaatggactggccaaaaaaaatggtccccaaagtcttcctggaaaaggggaacccaattggtgggctgtgacccccccatggcaaatggccaaacgtggggcaatttggggcgatttgttacaccaaagcctggaaataaaattgtcctggccaagggcaacctgcaaaaaacaacaaattccggcctttgataaacagggtttaaaagggccaagtccccacgctctgagtcgcccatttaacgccaccggccaaggg

SEQ ID NO: 60462 - protein, 139 aa, Zea mays
  misc_feature: Ceres CLONE 1519904
  misc_feature (18)..(18): Xaa is any aa, unknown, or other
  misc_feature (72)..(72): Xaa is any aa, unknown, or other
MALEKAKEIIASSPVDLXLRKAKETVASHPVVFFSKTYCPFCTRVKQLLAKLGGKLFFTPPPRGGGGGLNCXQLFAEWTGQKKWSPKSSWKRGTQLVGCDPPMANGQTWGNLGRFVTPKPGNKIVLAKGNLQKTTNSGL

SEQ ID NO: 60463 - DNA, 647 bp, Zea mays
  misc_feature: Ceres CLONE 1519905
ctccccgcggtggcggccgctctagaactagtggatcccccgggctgcaggaattcgtctcacccctagaaaaaaacaaaaccctcctccctcactgccccctcgcagacgagacgcgtggtagctagggttttggcctcgccgcgcacgcctcctgaactgctagaccgttcgaggagcagcagacgaggatcagaccgacgccgtgacaggagtcgccacgatggacgacctgggggcccgtcgtagcaagacgcaaccacgcgtgcctcgtcggacggtcccggtcgaataaagtggcctaatctgatctcgcacgacgagcagaaccaactggggaatgtgggacgcatcagcggacttcaagatcacctgagagtagcactcgaagatgctgaggaaatctcgcgacttcacaagacgaggaagaggctgcgttcggatgctggagcctcgggccgacattaactgtgataatagaacacaggcaacccacagttcatacgacctgactggatttctcatgctcagggttaggatttgtgggccgttggactccatctgatcagagctaagtgtactatgtctacgcgaatataaagtaagcctggtacctgactgctagtgatctgcatcgagccatgaat

SEQ ID NO: 60464 - DNA, 607 bp, Zea mays
  misc_feature: Ceres CLONE 1519906
  misc_feature: Encodes the peptide sequence at SEQ ID NO. 60465
  misc_feature (398)..(398): n is a, c, t, g, unknown, or other
  misc_feature (414)..(414): n is a, c, t, g, unknown, or other
  misc_feature (507)..(507): n is a, c, t, g, unknown, or other
  misc_feature (530)..(530): n is a, c, t, g, unknown, or other
  misc_feature (543)..(543): n is a, c, t, g, unknown, or other
gcggtggcggccgctctagaactagtggatcccccgggctgcaggaattcgtctcacccctagaaaaagcacctccctttccccaactcgatctcgcacctagggtttcgtctcgccgctctcgtcctccgcgaagatgccgaagaacaagggtaagggaggcaagaaccggaagcgaggaaagaacgaggctgacgacgacaagcgcgagctcgtcttcaaggaagacgggcaggagtacgcgcaggtgacccggatgctcggcaacgggcggtgcgaggccatctgcgtcgatggcacgcgccgcctctgccatatccggcgtaagatgcacaagaatgtctggatcgcggctggggacatcgtcctcgtcggcctgcgcgactaccaggacgacnaggccgacgttatcgntcagtacatgaacgacgaggcgcgcctgctcaaggcctacggggagcttcctgacacgctcaggctcaacgaggggcgtcgacgtccatgggnccccgagaaagccaagaaggcancgactacttccangttcaaggacgaggacttccgacaagatctaaaaaatcctgtttcctgcctaaaggggtactgt

SEQ ID NO: 60465 - protein, 157 aa, Zea mays
  misc_feature: Ceres CLONE 1519906
  misc_feature (30)..(94): Pfam Name: eIF-1a Pfam Description: Translation initiation factor 1A / IF-1
  misc_feature (88)..(88): Xaa is any aa, unknown, or other
  misc_feature (93)..(93): Xaa is any aa, unknown, or other
  misc_feature (124)..(124): Xaa is any aa, unknown, or other
  misc_feature (132)..(132): Xaa is any aa, unknown, or other
  misc_feature (136)..(136): Xaa is any aa, unknown, or other
MPKNKGKGGKNRKRGKNEADDDKRELVFKEDGQEYAQVTRMLGNGRCEAICVDGTRRLCHIRRKMHKNVWIAAGDIVLVGLRDYQDDXADVIXQYMNDEARLLKAYGELPDTLRLNEGRRRPWXPEKAKKAXTTSXFKDEDFRQDLKNPVSCLKGYC

SEQ ID NO: 60466 - DNA, 666 bp, Zea mays
  misc_feature: Ceres CLONE 1520037
  misc_feature: Encodes the peptide sequence at SEQ ID NO. 60467
aaagctggagctccccgcggtggcggccgctctagaactagtggatcccccgggctgcaggaattcgtctcacccctagaaaaaacttttttgcaactttgatagggaaggccatcatcaagactcatattcagacgctgtttatcgtgtccttatgcaacaaccagctcctgtatcttatggaaaaggagctaatctggatattcggtcacattcctgggttttctgctaccctgccatccgtgattgccaaactccatgctgccaaggacaagtatctatcaccaccgacaccagtctcggcgtcctcacagatggaggagaaacgatggaatctctcgtttacattggtttggaactctatagtgtggcttgtgcttctgaacttctccgttaagataatcacgtcgacagcacaggattatctcaaaaagcagcatgatatggagatggaacgcgtttctgattccccgcccccggaacaaaactaactagcggcgcaactaggcggtgtgtttatttcggctgctaactgcacagattcacctgcagacgaattcaagttccaacgattatcaattagcattaataagctattcatctacccaggtcaccaaaaacttgggccctgggcacttggccggggtgaagggctggggactaccc

SEQ ID NO: 60467 - protein, 103 aa, Zea mays
  misc_feature: Ceres CLONE 1520037
MEKELIWIFGHIPGFSATLPSVIAKLHAAKDKYLSPPTPVSASSQMEEKRWNLSFTLVWNSIVWLVLLNFSVKIITSTAQDYLKKQHDMEMERVSDSPPPEQN

SEQ ID NO: 60468 - DNA, 561 bp, Zea mays
  misc_feature: Ceres CLONE 1520041
  misc_feature: Encodes the peptide sequence at SEQ ID NO. 60469
  misc_feature (72)..(72): n is a, c, t, g, unknown, or other
ggggctccccgcggtggcggccgctctagaactagtggatcccccgggctgcaggaattcgtctcacccctnagaaaaaaccagagtcaccgcggcgagttcaaatcccacaatcttcttgtagcacaccactgtcttcgtccaactcggcggcgatgtctgggcgcggcaagggcggcaaggggctgggcaagggcggcgcgaaacgccaccgtaaggttctccgcgacaacatccagggtatcacgaagccggcaatccggaagctggcgaagaggggcggcgtgaaacgtatctccgggcttatctacgaggaaaacccgccggcgtgctcaagatcttccctcgagaaatgtcatccggcgacgcggttcacctacaacgagcacgctcgccgcaagaccgtcacgccatggatgttgtgtacgccctcaagcgccagggccgcactctgtacgggttcgggggggtgaaggaatttctttccctctctttgaaaggttgtccgggggggtttccccaattcccccggcttttgcttggcttgaattaaaaaaaata

SEQ ID NO: 60469 - protein, 105 aa, Zea mays
  misc_feature: Ceres CLONE 1520041
MSGRGKGGKGLGKGGAKRHRKVLRDNIQGITKPAIRKLAKRGGVKRISGLIYEENPPACSRSSLEKCHPATRFTYNEHARRKTVTPWMLCTPSSARAALCTGSGG

SEQ ID NO: 60470 - DNA, 819 bp, Zea mays
  misc_feature: Ceres CLONE 1520046
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (21)..(21): n is a, c, t, g, unknown, or other
aaaaataatatnnnggggggnaaacacaatcaaccaatcctcgcctgtggtgttttttttcatagctggactccaccgcggtggcggccgctctagaactagtggatcccccgggctgcaggaattcgtctcacccctagaaaaacacaactcgcagatcgagtccaagcattcaccggaggatcccaaatcacactctccagtacccgtccgcttctccagccgcatctctagacgagtctatctcctcctcctccgccgccgccgcaactatcctaatggctcggttcgccgtggtcgccgacatacgacgccctcctcgacgtcgtcgcggcggaacaagactttaccgcagctcccaaggccgcgcccagtatgggcccatgttggcggctctacccaggccagggcggcggccacaagcgcggagggcgaccgggcaagccacagggaggacacgcccccagaaacaccttgtaacttaattaaatgtctggtgcttgtttgtagtactaaaagaaccagtggaaggagatcgagggaggtagatgggcgtcacgcagatggcggcaggaacataacatacaagggccgccctgaccaccgctgtagagacgggcaggagcccccgacatgtagtctcgtgttccgccgggaccgctgcgatggtccggttggaaccccaatcgagcccccacaccacaacacaaagagacgaacagagagaagaaagcaaaccataaatgctcatcttaaaactcgcacaaagaaaccaagcacgtcaacagtaaccgacccccccccccgaacctcaacaaa

SEQ ID NO: 60471 - DNA, 552 bp, Zea mays
  misc_feature: Ceres CLONE 1520050
  misc_feature: Encodes the peptide sequence at SEQ ID NO. 60472
  misc_feature (334)..(334): n is a, c, t, g, unknown, or other
  misc_feature (335)..(335): n is a, c, t, g, unknown, or other
ctggagctccccgcggtggcggccgctctagaactagtggatcccccgggctgcaggaattcgtctcacccctagaaaaagagcaggacaggttgcatttgcatctgagttcctgatcgttgtattccagtttcttccgtgagttttgtgggatcgcgaggaagaaggatgtcgtgctgcggaggcaactgcgggtgcggcgccggctgcaagtgcggcagcggctgcggagggtgcaagatgtacccggacatggctgagcaggtgaccaccaccaccaccacccagactctcatcatgggtgttgcaccatccaagggcggggtcgtaggcnnggccgccggaaagcttgaaaaaaacggcgggggaagtgggggggcaaatggacctggaaccctggacctgaaaggaaactccaaccggggcggcaataaccttcagggcccccagcccccatggggcccaaaaaacctctttcccccccccaattaaaaaacccccccccggaataaaattccccccccgggccttttctgggtttttttccaacct

SEQ ID NO: 60472 - protein, 107 aa, Zea mays
  misc_feature: Ceres CLONE 1520050
  misc_feature (1)..(77): Pfam Name: Metallothio_2 Pfam Description: Metallothionein
  misc_feature (56)..(56): Xaa is any aa, unknown, or other
MSCCGGNCGCGAGCKCGSGCGGCKMYPDMAEQVTTTTTTQTLIMGVAPSKGGVVGXAAGKLEKNGGGSGGANGPGTLDLKGNSNRGGNNLQGPQPPWGPKNLFPPPN

SEQ ID NO: 60473 - DNA, 805 bp, Zea mays
  misc_feature: Ceres CLONE 1520051
  misc_feature: Encodes the peptide sequence at SEQ ID NO. 60474
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (28)..(28): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
aagaaataatagnnnntattatagaatnaaaannnnnnnnnnnngaccaaaattaaaaactaggactccaccgcggtggcggccgctctagaactagtggatcccccgggctgcaggaattcgtctcacccctagaaaaaggcatcccactcgcgccgtcgctcgacacaaaccacacagtctcagccagcctcaaggcgcgcgcaacgccgctcctccctgcgcttgcgagggtcgacggcatggacaagcaggatgagaggaagaagccccacgggaaaacagaccccaagaggggcgacatcatgaagcggatccttaaggacctcaccggcggtggcaacgacgggcggcggcggaggtgccaatgactgtggtgttaacaacgacaactaccagcggatccgggtaccaacctcccgctgaggccgactgaacgacatggcctaaagcgcaccccgtgttacgaccccccccccccaaagacggtgaagccccctccgtgtaacctgtctttgctcccaaatttgaaaaaaaccgtagacctacccccaaaataaggataatcgggaggaagaggtaagccagccgggccgcaggtaaacattatgttaggcgtaagggcggggaaggaacaaacgataacaaaaaaccaggaatcgaggccgctgtgaaaaaattaaaaatagggagaggtgagggacaatctaggaaccacgacctaaaaaagggggaaacgaaaaaaaaaaaccacatacaccccgcccgcccaccccccaccccacatcaccaagaacaaaacaaa

SEQ ID NO: 60474 - protein, 42 aa, Zea mays
  misc_feature: Ceres CLONE 1520051
MDKQDERKKPHGKTDPKRGDIMKRILKDLTGGGNDGRRRRCQ

SEQ ID NO: 60475 - DNA, 664 bp, Zea mays
  misc_feature: Ceres CLONE 1520055
  misc_feature: Encodes the peptide sequence at SEQ ID NO. 60476
  misc_feature (1)..(1): n is a, c, t, g, unknown, or other
  misc_feature (401)..(401): n is a, c, t, g, unknown, or other
  misc_feature (559)..(559): n is a, c, t, g, unknown, or other
  misc_feature (563)..(563): n is a, c, t, g, unknown, or other
naatagctggagctccccgcggtggcggccgctctagaactagtggatcccccgggctgcaggaattcgtctcacccctagaaaagtgctttcttagaggtgggttggcttctcctccccctccggttcgggttcgggttcgtgaggttctccggggttcgggttcgtgggtgagcggatccagatggcggcgtccgatgttgagtaccgctgcttcgtccgcggcctcgcctgggccacggacgaccactccctccacaaccccttcaggacctacggcgatgtcctcaagtccaagagcatcctccatccggagacccttatgtcccgcgggtttcggcttcgtcaccttttttttttttttccccccccccaaaggggcgagggaggggttgaacttnctattatcctctaccccccccccatcaccaaaaaaaaaaagccccatcccgggggggggggggggaagccatccccccgcccttacggcgcctcgcccacgacatgacccggctcggccgcctggcagaccccctcattgccgacagccccacaaccncccnccgcccgctcgaccaacgccgcttccccctcccccggaaacacaaccgcccgccccgccctaccccccccccacaaacaaaaaataatttctcccccacgg

SEQ ID NO: 60476 - protein, 107 aa, Zea mays
  misc_feature: Ceres CLONE 1520055
  misc_feature (73)..(73): Xaa is any aa, unknown, or other
MAASDVEYRCFVRGLAWATDDHSLHNPFRTYGDVLKSKSILHPETLMSRGFRLRHLFFFFPPPQRGEGGVELXIILYPPPITKKKKPHPGGGGGKPSPRPYGASPTT

SEQ ID NO: 60477 - DNA, 641 bp, Zea mays
  misc_feature: Ceres CLONE 1520058
  misc_feature (250)..(250): n is a, c, t, g, unknown, or other
  misc_feature (251)..(251): n is a, c, t, g, unknown, or other
  misc_feature (252)..(252): n is a, c, t, g, unknown, or other
  misc_feature (271)..(271): n is a, c, t, g, unknown, or other
  misc_feature (330)..(330): n is a, c, t, g, unknown, or other
  misc_feature (360)..(360): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (422)..(422): n is a, c, t, g, unknown, or other
  misc_feature (446)..(446): n is a, c, t, g, unknown, or other
  misc_feature (447)..(447): n is a, c, t, g, unknown, or other
  misc_feature (448)..(448): n is a, c, t, g, unknown, or other
  misc_feature (455)..(455): n is a, c, t, g, unknown, or other
  misc_feature (457)..(457): n is a, c, t, g, unknown, or other
  misc_feature (459)..(459): n is a, c, t, g, unknown, or other
  misc_feature (467)..(467): n is a, c, t, g, unknown, or other
  misc_feature (468)..(468): n is a, c, t, g, unknown, or other
  misc_feature (551)..(551): n is a, c, t, g, unknown, or other
  misc_feature (553)..(553): n is a, c, t, g, unknown, or other
  misc_feature (583)..(583): n is a, c, t, g, unknown, or other
  misc_feature (607)..(607): n is a, c, t, g, unknown, or other
  misc_feature (613)..(613): n is a, c, t, g, unknown, or other
atagctggagctccccgcggtggcggccgctctagaactagtggatcccccgggctgcaggaattcgtctcacccctagaaaaaacagcctcccaaatccccaaagcctccgacccccttcctctctccctccgccggcgctgcgcacgcaaggaacaagagacatgggcgtctacacctttgtgtgccgcaacaacggcggcgagtggaccgcccagcagcactccccgcgagatccgaggatttccgnnnggtaccgcatacgaggtgnagcggccccctcttgactgccccccccccgcgccgactcttccctaacggctccagttnccccttctccctggtacccaccacactccnccctttttccccccgccccccccgggggcggcacgggggggggnnnnaaccaagggggaggngggagcggggccaccagggggggnnnacaacanananaaaacccnnaacccccccccgcccccctcccccccacaacaaaacacaacaacaaaggggaccacccgcgccacccaacgactcccacgacncngccgccgcgccgcacccccccccccacccncacccactccccaccccaccccgnacaccnacccccaccaccgctccccacccccacg

SEQ ID NO: 60478 - DNA, 695 bp, Zea mays
  misc_feature: Ceres CLONE 1520063
  misc_feature: Encodes the peptide sequence at SEQ ID NO. 60479
ggagctccccgcggtggcggccgctctagaactagtggatcccccgggctgcaggaattcgtctcacccctagaaaaaatcaactcgcaattccgcattcgttccaactcctgagcactttctcctcgtcccagacaagccaatcgaagccgagatacgaccatggactccaccggcaccggagcagggggtaaggggaagaagggagcggccgggcgcaaggtcggcgggccaaggaagaagtcggtgtcgaggtccgtgaaggccggtctccagttccccgtcggccgcatcgggcgctacttgaagaagggccgctacgcgcagcgtgtcggcaccggcgcccccgtctacctcgccgctgtcctcgaatacctcgccgctgaggttctggagctcgccggtaatgctgccagggacaacaagaagactcgcattattccgcgccacgtgcttccggcgatccggaacgacgaggagcttgggaagctgttggggcggcgtgaccatcgcttcacggcgggtgtgctcccccaatatcaacccctgtttctgctgccccaaaaagaccgggggagaaaggcttccagtggtcggggagccaagggagggcaatgtccgccccaaaaaaggccgccccaagtcccccctaaggaaaggcatagcacttgacctgtccccggagttggatcctt

SEQ ID NO: 60479 - protein, 169 aa, Zea mays
  misc_feature: Ceres CLONE 1520063
  misc_feature (31)..(104): Pfam Name: Histone Pfam Description: Core histone H2A/H2B/H3/H4
MDSTGTGAGGKGKKGAAGRKVGGPRKKSVSRSVKAGLQFPVGRIGRYLKKGRYAQRVGTGAPVYLAAVLEYLAAEVLELAGNAARDNKKTRIIPRHVLPAIRNDEELGKLLGRRDHRFTAGVLPQYQPLFLLPQKDRGRKASSGRGAKGGQCPPQKRPPQVPPKERHST

SEQ ID NO: 60480 - DNA, 666 bp, Zea mays
  misc_feature: Ceres CLONE 1520066
  misc_feature: Encodes the peptide sequence at SEQ ID NO. 60481
tggagctccccgcggtggcggccgctctagaactagtggatcccccgggctgcaggaattcgtctcacccctagaaaaaacccacccccaggcctcctgccgcccggcccgcgccgcgccatggaagagccgccgccggggagcagcaaggccgccgcggcgcgcgcgccccgggtggtgggcgtgctggcggggctgctggagcgcgcggcggagcgcggcgacacggcgacgccgacgccggcgggctcggcgttccggggccgcgcgctgccggggatccccgtgcggcggtacgcggagcggatataccggtacgccgggtgcagcccggcctgcttcgtcgtcgcctacgtctacctcgaccgcctcgcgcgggggcgccgcgacgccggcgccggcgaggacgaggacgaggacgaggcggcggttgtcggcatcgactcgtacaccgtccaccgcctcctcatcacctccgtcttggtcgccgccaagttcatggacgacaggcaccacaaccacgcctacttctcgcgggtgggcggcctggaggtggcggaaatgaactcccctggagctgcgccttcctcttcgccctgcgctttccgcctcaacgtcggccccccgacaccttcgcgcgggaattgcgcccgcgcttcaaatgcc

SEQ ID NO: 60481 - protein, 182 aa, Zea mays
  misc_feature: Ceres CLONE 1520066
  misc_feature (17)..(164): Pfam Name: Cyclin Pfam Description: Cyclin
MEEPPPGSSKAAAARAPRVVGVLAGLLERAAERGDTATPTPAGSAFRGRALPGIPVRRYAERIYRYAGCSPACFVVAYVYLDRLARGRRDAGAGEDEDEDEAAVVGIDSYTVHRLLITSVLVAAKFMDDRHHNHAYFSRVGGLEVAEMNSPGAAPSSSPCAFRLNVGPPTPSRGNCARASNA

SEQ ID NO: 60482 - DNA, 635 bp, Zea mays
  misc_feature: Ceres CLONE 1520067
aaagctggagctccccgcggtggcggccgctctagaactagtggatcccccgggctgcaggaattcgtctcacccctagaaaaagtcatttgtccaatggtttcaggcaattcctttatcgtatttcctctgctgcattttccatgcaatatcttgactgatgtatgctcatgctcaacacctccaataaaacgagacatgctatagcattgttgaatgcaagtgggtatgcagtttgcagtatgcttatgttgaattgatgtaacttagccgaactgaaagaggctgccccagcttgattggaacagaggaatttgctgctgtttttgttcttattaccgaacaacacaagtcaactctaaaaaaaaattagtttataactccggttataaagagtcgttctgtactgagatttcattgttcacttgaagaaacctctgtcggacgatcagaatgcttggtgctgtttaagttggctcgtgttatattgctcatgttctaagcatacatatccaacatgtcagtcacttttctattacgccattctaagttaatatatgtaatgctatttctgcgtctagctcctgtaccctatctgactatccgttcgatagcgtgaaaaaaaacgacacgcc

SEQ ID NO: 60483 - DNA, 780 bp, Zea mays
  misc_feature: Ceres CLONE 1520068
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (41)..(41): n is a, c, t, g, unknown, or other
  misc_feature (52)..(52): n is a, c, t, g, unknown, or other
  misc_feature (53)..(53): n is a, c, t, g, unknown, or other
  misc_feature (336)..(336): n is a, c, t, g, unknown, or other
  misc_feature (397)..(397): n is a, c, t, g, unknown, or other
  misc_feature (425)..(425): n is a, c, t, g, unknown, or other
  misc_feature (498)..(498): n is a, c, t, g, unknown, or other
  misc_feature (499)..(499): n is a, c, t, g, unknown, or other
  misc_feature (536)..(536): n is a, c, t, g, unknown, or other
  misc_feature (562)..(562): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (639)..(639): n is a, c, t, g, unknown, or other
  misc_feature (641)..(641): n is a, c, t, g, unknown, or other
  misc_feature (667)..(667): n is a, c, t, g, unknown, or other
  misc_feature (681)..(681): n is a, c, t, g, unknown, or other
  misc_feature (693)..(693): n is a, c, t, g, unknown, or other
  misc_feature (694)..(694): n is a, c, t, g, unknown, or other
  misc_feature (707)..(707): n is a, c, t, g, unknown, or other
  misc_feature (719)..(719): n is a, c, t, g, unknown, or other
  misc_feature (720)..(720): n is a, c, t, g, unknown, or other
  misc_feature (754)..(754): n is a, c, t, g, unknown, or other
  misc_feature (770)..(770): n is a, c, t, g, unknown, or other
tggtgatgtgaagcaannntgtgtttttttggggggggggngtttttttttnnttttaaattttggagctccccgcggtggcggccgctctagaactagtggatcccccgggctgcaggaattcgtctcacccctagaaaactttcaaggcttcagaacaccaaagtttggaggtgtcactgtctactatgacatgtgagatctacagcatttcgccaataaagattttcagcgaagtcgtccagtttacgcctcttggactgatcgacatgttcaactccggtggtgcacttgacaatactttcagcgttgcagattcttcaactaccacagttngtataagaagcccacgaacaacagccgctgggcgccggattccagaccccaggcacagagntctcgtcaaagttgatggacccgcaaancccacccccccccattgggggaggaagggccctccctcaaaccttttacccctacaccaccttcatgtgggtnnaaatgtgaccaaagctgtgaaagacacacccgttggngggcttgccaccgtcgcgcgaacggntgtaaaggaagggtnnntcctcttttgcccctctttgtaaaagatcgcgcaaccgggctcgccgacgacactggggngnctctcctgctacacccacccaccccncggagaggcaaaangggtacgggggnnatgcgtcctgtgnttctgttcccannttttctacctcctccccccatatcgaccatcatnaccgttttttgaggtntggcacccct

SEQ ID NO: 60484 - DNA, 629 bp, Zea mays
  misc_feature: Ceres CLONE 1520069
  misc_feature (344)..(344): n is a, c, t, g, unknown, or other
catagctggagctcaccgcggtggcggccgctctagaactagtggatcccccgggctgcaggaattcgtctcacccctagaaaaaagccatgggatgggagcactccacatgcgtgaagaagctttaaaattttgtcctccctccctccttccgatcatccttcctgatgctgttgatcgatcaaccacttgaatcatgcttgtcatcatcggtccatgcctccatggtctagtaggttctgtaaattgttgtgagtttgcttgtgtgctagctagctaggtggcccggcccggccgttgaaaagtgccaaaaaaaaatacatgtgtattttccctgcatgcgncagaaaaaatcatcccggaacaaaaaaagttcttttggttgccattcgcctgcagacttcttgtcgtttgctacttattaagcgagtgctagctctgcatgcatgactacgtcctttgcatgttgatgagcaactttcgatacttttgggtgtttgttttatgtaagtgcttcgtcctttacatcgacagtgtcccagaactatttggactgttattcttttattttgacccagcaatctgctcgatgaaataaagctttatatatttattgaaaaaaaaaaaaa

SEQ ID NO: 60485 - DNA, 653 bp, Zea mays
  misc_feature: Ceres CLONE 1520071
  misc_feature: Encodes the peptide sequence at SEQ ID NO. 60486
tggagctccccgcggtggcggccgctctagaactagtggatcccccgggctgcaggaattcgtctcacccctagaaaaatctgggcactggaaaaggtcgcacaaaacgtcactgctaagacgtaccaacagatagatgccagagcaaagggcagattccacggcgtggcgcctgagccacgggaaggggtaaggagtgggcatataccaggaagcgtctgcgttccgttccccgagatgttcgacggcgcaccaccgagccttctcctccccgccgacgagctgcggcggaagtttcagcacgcaggaatctccctggaccgacccatcgtcgtgacctgcggatccggcgtgactgcctgcatactgcgctctggggctgtacaggatcggaaagcgtgatgtgccagtctactatgggtcctggacggagtgggagggtcagtcggactccgattaccccaaagtctccgctcctggtacaacttgagcgtctggcactggcagttggcagctttacactgccagcatgatggcattgtgtttgcgacaggctgaaccgatgttatctagcactggcagcattgtattcgctactgcaaggcctgctaatgtcaaaattccaaccacgcccaccccgaaaaaaaaataca

SEQ ID NO: 60486 - protein, 54 aa, Zea mays
  misc_feature: Ceres CLONE 1520071
  misc_feature: SWISSPROT Homolog: EC 2.8.1.2 3-mercaptopyruvate sulfurtransferase
MFDGAPPSLLLPADELRRKFQHAGISLDRPIVVTCGSGVTACILRSGAVQDRKA

SEQ ID NO: 60487 - DNA, 552 bp, Zea mays
  misc_feature: Ceres CLONE 1520074
  misc_feature (220)..(220): n is a, c, t, g, unknown, or other
  misc_feature (268)..(268): n is a, c, t, g, unknown, or other
  misc_feature (291)..(291): n is a, c, t, g, unknown, or other
catagctggagctccccgcggtggcggccgctctagaactagtggatcccccgggctgcaggaattcgtctcacccctagaaaaaatccacaacacgtcgtcgatctacacacatacatagtcttcttctactacacgacgacaaacatgtgggaagcctgcgaagatcggagagtggggtggatacgccggcgatcgtcgggatctgagggctactccnggtaccggctgaccgagggtgaaaggtccacgggcgggaacaacaagncaggcttggttttttcccgggtncccaatttccttttttttttaaattggaaaaccccaatgggggaaaacccccccaaaaaagaggggccctggggtttttcgccccctttggggccgagaaaacaaaatatatttttggggggggcccaaaaaaaatggtgggggaaattttccgggggaccagggggccccccccccaaaaaaaaaaaaaaaaagggggggggggctctcctcctttttttgtgtgccccacaaaaaaaaatttttttttttggggggcgg

SEQ ID NO: 60488 - DNA, 782 bp, Zea mays
  misc_feature: Ceres CLONE 1520076
  misc_feature: Encodes the peptide sequence at SEQ ID NO. 60489
aattatttttttttaatttttaataattatttaatttatagagattgtgcaaactggcactccccgcggtggcggccgctctagactagtggatcccccgggctgcaggaattcgtctcacccctagaaaaagctagtccggtaccctcgacctcggcgtcccaccgaagacgacctcacgcggagctgggaatattccttcgcctccgtgctccctttagcaccaactgtcacggccgcttctagcacgcatcattctcgtctcccgtctcgagagattgcagggggcggcgctcgaagctggaggaagcggacgggttcgcgatggggtccgagggatcctcgggtccggtcgtcgttcccagaaactttaggctgctacaagaactaacacgtggtgagaagggcattggtgatggaactgtgaactctgagatggatgatgctgataacatatacacgcggtccctggaccaggagactatcattgggacctcccccgatactgttcaccgagggactaatctgcccaatttaaggctggtttttggtgatcggggatttttcctatattaaccctccgcacccgtccggattccccggaccccggaccccatgatgcacatgggcgggaaaccaaaaaaaaactggaatttggttttgaaacccagggccctatttttcccaacgcctctcgggcaaaatgggggaaaggggggaaacactcccgcattggaaatgaaaatcccgctgggggccgggcgtgttaaaaaaagggtaag

SEQ ID NO: 60489 - protein, 83 aa, Zea mays
  misc_feature: Ceres CLONE 1520076
MGSEGSSGPVVVPRNFRLLQELTRGEKGIGDGTVNSEMDDADNIYTRSLDQETIIGTSPDTVHRGTNLPNLRLVFGDRGFFLY

SEQ ID NO: 60490 - DNA, 651 bp, Zea mays
  misc_feature: Ceres CLONE 1520081
  misc_feature (651)..(651): n is a, c, t, g, unknown, or other
ggagctcaccgcggtggcggccgctctagaactagtggatcccccgggctgcaggaattcgtctcacccctagaaaaaaggggccagggctagcaccggcggcgtatccctaatcccacctccagtctctggggaccaaatttctgggggcgatggaggccgctgtggccaggctaggtttcggcggaagttctggttctatgcttcccgcccccggaagggttgagagattgtccgcggagcaacccatccccccatcttttttgattagggtttgttacccgaacccctagtgtgttgcattctacacacacccgcccccccccctcagttgggtgtgttgccgcggcccaaaaagtttaacccctactctttccacacaccctcccggcaggcactgatgtttttcaatactatcctccccccgggggggaggtggggaggccaccccccgcgttcttacacctggagtcgcgcccccccctccctacttctcgttagtatcgggcccactcttttcccgcgagaaatgtgagaccacggccggggggggcggccgccacccgaacaatgatatgggtgggaggtccatacgagacaacatcacatacagcaacaaggtggtgcattcattggtgtgttttgtttttn

SEQ ID NO: 60491 - DNA, 827 bp, Zea mays
  misc_feature: Ceres CLONE 1520085
  misc_feature: Encodes the peptide sequence at SEQ ID NO. 60492
  misc_feature (20)..(20): n is a, c, t, g, unknown, or other
  misc_feature (21)..(21): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (738)..(738): n is a, c, t, g, unknown, or other
  misc_feature (807)..(807): n is a, c, t, g, unknown, or other
tttttttttttttttttttnnacgcccaaaannnnnnnnnnnnggcacaataggcgcgaggggggctccccgcggtggcggccgctctagaactagtggatcccccgggctgcaggaattcgtctcacccctagaaaaaacgcggtacgcgcacacagccaaaccatcctcctctccgccgcccgccgcagcagcacccaccgggcaagatgaagacgatcctggcgtcggagacgatggacatcccggagggcgtcacggtcacggtggccgccaagctggtcacggtggagggcccccgcggcacgctcgcccgcaacttctagcacctcagcctctacttcccgctgcaggaggccggcgcacaagctcaaagggggacgcccgcgcagggcacacgccggcccgtggcccgccgtcgcgcacgcgccagccccgcggggggggagccgttgtgaaggggggcccccgtgcgcccccccgcccccccgtatgaggtggcggccgactgcccgacgggccggcggggagggcccccgcgtcgggcattcgtgggcggtcagcgttggggggggacggcggaaagctaccgtcaggacggagtgcgacgggtctggcccccggggggcgccctccccctctgggcctgtaagcatggagtcgctccgcgggccccaagagaaggtggaaggggaagaaagcagtcaggcccggggcgcgggcagaccgagtcgcggngcggcgccgcggtggcgggcgcccccgcggccgccccgcgacgcgcgcctctggcgcggccccctcggngggctggctgcgccttctat

SEQ ID NO: 60492 - protein, 38 aa, Zea mays
  misc_feature: Ceres CLONE 1520085
MKTILASETMDIPEGVTVTVAAKLVTVEGPRGTLARNF

SEQ ID NO: 60493 - DNA, 637 bp, Zea mays
  misc_feature: Ceres CLONE 1520091
  misc_feature: Encodes the peptide sequence at SEQ ID NO. 60494
ccgcggtggcggccgctctagaactagtggatcccccgggctgcaggaattcgtctcacccctagaaaaacgcgctgccgccgtcgtcctcccgcgcgccggccccgctccgcgcgaccgccggggaggcggtgaccgaggaggcgcccaaggggttcgtggccccgcagctggaccccagcacgccgtccccgatcttcggcggcagcacgggcgggctgctccgcaaggcgcaggtggaggagttctacgtcatcacgtgggtgtcccccaaggagcaggtgttcgagatgcccaccggcggcgccgccatcatgcgggaggggcccaacctcctgaagctggcgcgcaaggagcagtgcctcgcgctcggcaccaggctgcgctccaagtacaagatcacctaccagttctaccgcgtcttccccaacggcgaggtgcagtacctccaccccaaggacggcgtctaccccggagaaggtcaaaccccgggcaggggaggggcgtccgggccaaaaactttcccccaagcattccgggaaaaaaacccttctaaccccccttctgaggtttccaggtttcccccctgggtaaagaagcccccttttccgacttatttcccccaactttcaccccg

SEQ ID NO: 60494 - protein, 115 aa, Zea mays
  misc_feature: Ceres CLONE 1520091
  misc_feature (1)..(89): Pfam Name: PsaD Pfam Description: PsaD
MPTGGAAIMREGPNLLKLARKEQCLALGTRLRSKYKITYQFYRVFPNGEVQYLHPKDGVYPGEGQTPGRGGASGPKTFPQAFREKNPSNPPSEVSRFPPWVKKPPFPTYFPQLSP

SEQ ID NO: 60495 - DNA, 620 bp, Zea mays
  misc_feature: Ceres CLONE 1520111
  misc_feature: Encodes the peptide sequence at SEQ ID NO. 60496
  misc_feature (593)..(593): n is a, c, t, g, unknown, or other
caaagctggagctccccgcggtggcggccgctctagaactagtggatcccccgggctgcaggaattcgtctcacccctagaaaaaacccgcgccagtcaaactatctgctcccttgttcctggaagagattgagctccctctgccccacccagtagagaaggtgtcgaaagtgcagatcaagccggcggtgcagatcccgctggaagtggagcccgcggcccatgaactgccggagactaagaacgccgcgcggggaaccggatccctcctggcgagcccgccggagaaggccgcggccaagttcatcgaggccgcaacaaaggtccgaagagcgcgcacacgtctgagatcgacatctccgctgtgatgaagcacgcgcaccctgacgttcacatctactcgaagagcctgatcatgatgaactccttctacatcgcatcttcgattaaatggtcatgcgaggacgccaagctcgcgcgctacataagaagcgcgccatcacgtacagagagatccaaacctccttgtgcctcttgctctccggcgagctgcccgagcgccccccctctgagggcaccgaagccggcgccanttcacttcctccttgggctgtagcctc

SEQ ID NO: 60496 - protein, 82 aa, Zea mays
  misc_feature: Ceres CLONE 1520111
  misc_feature (76)..(76): Xaa is any aa, unknown, or other
MKHAHPDVHIYSKSLIMMNSFYIASSIKWSCEDAKLARYIRSAPSRTERSKPPCASCSPASCPSAPPLRAPKPAPXHFLLGL

SEQ ID NO: 60497 - DNA, 640 bp, Zea mays
  misc_feature: Ceres CLONE 1520127
  misc_feature: Translation starting site: 201
cttagctggagctccccgcggtggcggccgctctagaactagtggatcccccgggctgcaggaattcgtctcacccctagaaaaaatcggctagcttttggctcggcagctaacgacctgcagccaaccatctaccagcgactcagcaagcgagagcagcacacacgcagctaggtaggagcagcagcagagcagcggcgatggcggcctccatgatctcctcgtcagctctggcgggggcgcctcagggcctgccgcccctcggccgccgcgactcctccttcgccgtcgactgctccaagaaaaagatctagaccgactagccctacaggatagggggtggcctgaccgacgacgtcgacgccatacgggagaaaacgcaagggcaagggcgtgtaccagttcgtcgacaagtacggcgcgaacgtccatggatacagcccattctacaacgaggatgactggtctcccaccggcgacgtctacgtcggtggaaccactgggctgtcccgatctgggccgtacccctcggctgggatcctcctgcgctgccgccctcctcatctacaacaccatgcgccctctccggctaaggatacccaaaagcatgcgcttccttgcgattcactcaagataaaat

SEQ ID NO: 60498 - DNA, 668 bp, Zea mays
  misc_feature: Ceres CLONE 1520130
  misc_feature: Encodes the peptide sequence at SEQ ID NO. 60499
tggcggccgctctagaactagtggatcccccgggctgcaggaattcgtctcacccctagaaaaaaggcatgagcacccctctcctccgccgtcccatggccgcgccctgttcctgggacacttccttccacgaaaaaaagcagaagcagaagctctagctacctctactaccgacctggatccactcaacccgctacgctaagctccccttcccgttcgacaagtgaagagaagaggttattcatccatctgcgctgcagcctgcaaaggagaaggagaaggaggcgcttgacatgggcaagtacgtggagctgctggacatgggcgtgcgcatcgccgcgcgcttccactcccactgcccgcagaccgcgcgcctctactaccacccgcccgctggcgggccggcggccgcgggggacggccgcaagggcgactccggcattgtcgaccccggccgccgccgccgtgatgctgaagcagcgaggcgcggagagttcgacggctccaaagatcatcctccaacacccttctcttaatgccggctggctttggatggcgatgcctcctagggaacccgtcaaaccgaggcccgcgggacaacccagtcccaaattttaaccacccctttcatcggcccgacgcagaacgcctccacaccctgcctcggg

SEQ ID NO: 60499 - protein, 80 aa, Zea mays
  misc_feature: Ceres CLONE 1520130
MGKYVELLDMGVRIAARFHSHCPQTARLYYHPPAGGPAAAGDGRKGDSGIVDPGRRRRDAEAARRGEFDGSKDHPPTPFS

SEQ ID NO: 60500 - DNA, 625 bp, Zea mays
  misc_feature: Ceres CLONE 1520134
  misc_feature: Encodes the peptide sequence at SEQ ID NO. 60501
aagctggagctccccgcggtggcggccgctctagaactagtggatcccccgggctgcaggaattcgtctcacccctagaaaaagccaagcaaataagacgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacggctgcagctgcggtggcaactgcaagtgcgacccctgcaactgctgatcacatcgatcgacgaccatggatatgattattatctatctagcttgtggtggtggttgaacaataataagcgaagccgagctggctgccatacataggtattgtgtggtgtgtgtgagagagagagaacagagttcttcagtttgctatctctctctgcatgtttaggcgcagtctttgtgctcatgtacgtacgtgtgtctacctgcattgtgggtgatcccattgcatccgctga

SEQ ID NO: 60501 - protein, 76 aa, Zea mays; identical to SEQ ID NO: 8464
  misc_feature: Ceres CLONE 1520134
  misc_feature (1)..(76): Pfam Name: Metallothio_2 Pfam Description: Metallothionein

SEQ ID NO: 60502 - DNA, 776 bp, Zea mays
  misc_feature: Ceres CLONE 1520135
  misc_feature (1)..(1): n is a, c, t, g, unknown, or other
  misc_feature (2)..(2): n is a, c, t, g, unknown, or other
  misc_feature (17)..(17): n is a, c, t, g, unknown, or other
  misc_feature (18)..(18): n is a, c, t, g, unknown, or other
  misc_feature (21)..(21): n is a, c, t, g, unknown, or other
  misc_feature (22)..(22): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
nnttttttttttttttnnttnnttttttttttttttnnnnnnncaaaaaannnaaaaaactggagctccccgcggtggcggccgctctagaactagtggatcccccgggctgcaggaattcgtctcacccctagaaaaaacccggtagttacacctcggaaagcatcttcaagtcagcaggctacctagctagagctatcactatatcatgatcactgtatctagacctagcaatggcgacacccacaccgctgcgtcggaatggctaagtggtcgtcgtcagttttggtcgccgtcctcgaggtcctggactcggtggtgaatgtgctccgctgcgcgccccgatccccgcgcaccagcatcaggcggaagaggactgcaagaagtcggacacagctgcacgatgggacggtgctgatatcgaggatggggcgctactatatctggatccactaaatcctgggacatcagcctggctggacctcaaggttccccgtcagcacccagggggcagttcctccccggggccagacgacacctaagtgcccaacccccggcttccgaggtcccccttcccccttcatagcccgggcgcggtgcaattccctggatcacatatcccgcgtctgggtttaaggttggtcttctcaggaacgattcttgatggtccgggacgccggaccgcccagcccctggatacggaatttaatccttgctaagggttaccgaaatgcgtcttctggttaacggtattttattctagggccggcgggctt

SEQ ID NO: 60503 - DNA, 603 bp, Zea mays
  misc_feature: Ceres CLONE 1520136
  misc_feature: Encodes the peptide sequence at SEQ ID NO. 60504
ctccccgcggtggcggccgctctagaactagtggatcccccgggctgcaggaattcgtctcacccctagaaaaaatcgcagacgacatcgtcctccccttcgcggacgccatcccgtgggaggagatcggcgtcttcgttgcagaggatgatgtcccgcagctggacagcatcctgacatccatccccacagacgtcgtgctgaggaagcagcggctccttgcgaacccgtcgatgaagcaggccatgctgttcccccagcctgctcagccaggagatgcgttccaccagatcctgaacggcctagcgcgcaagctcccgcacggcagcaatgtcttcctgaagcctggtgagagggccctgaactggaccgctggaccaccaggcgacctgaaaccttggtagcgtcctgtggatctgagatggataccacttgttctgaaaggaaatatggagaacatgattatatataataccccgtgctttgagttaccatgggtggcatagtgctgaacaagaagccaaaggtacatccgttctaaggtcttttttctataacctgttatataccttataaaccatccttccctttccttctaaaaaa

SEQ ID NO: 60504 - protein, 133 aa, Zea mays
  misc_feature: Ceres CLONE 1520136
PRGGGRSRTSGSPGLQEFVSPLEKIADDIVLPFADAIPWEEIGVFVAEDDVPQLDSILTSIPTDVVLRKQRLLANPSMKQAMLFPQPAQPGDAFHQILNGLARKLPHGSNVFLKPGERALNWTAGPPGDLKPW

SEQ ID NO: 60505 - DNA, 628 bp, Zea mays
  misc_feature: Ceres CLONE 1520140
  misc_feature: Encodes the peptide sequence at SEQ ID NO. 60506
tccccgcggtggcggccgctctagaactagtggatcccccgggctgcaggaattcgtctcacccctagaaaaaatcactctcattcgcaatttccctacgagctcgagctcacggctcaccgcaactcaaaagccagcacaggaaaacccccgtcatggcctcctccaagatactgcgcgccaccgtcatcgtcgtggccgtctccgtgtcctccttcgccggcgccgccctctccgccgaggcccccgcaccgagcccggcctccggcgcagcggccgtctcctcttcgctcttggccgccgccctctgcccggccgtcacgctcctcctcggtaacctgcgccactgatgacgcctgcctgcctgtccaacaagagccgccgtgtgctgtcgcgtgatgttattgtcctctgtatgtgtgtgtgtgtgttcctgacctgtgcgtgccttgtaccgcctccccgcgcgtggattggaactctatcgatcgttcggagattcagcgcgtttgtttctgtagcatcattgattcaaacttcctaaaaaaaaaaaaaaacgagacgctcgaagtacccaattcgccatatagtgagtcgtattacgcacgctcactggccgtcattttac

SEQ ID NO: 60506 - protein, 64 aa, Zea mays
  misc_feature: Ceres CLONE 1520140
MASSKILRATVIVVAVSVSSFAGAALSAEAPAPSPASGAAAVSSSLLAAALCPAVTLLLGNLRH

SEQ ID NO: 60507 - DNA, 418 bp, Zea mays
  misc_feature: Ceres CLONE 1520144
  misc_feature: Translation starting site: 148
caaagctggagctccccgcggtggcggccgctctagaactagtggatcccccgggctgcaggaattcgtctcacccctagaaaaaaccagcaacccccaacagcgccactgtccagtgcgcgcgtcaagcttgcttagctagccgccatggcctccctcgccgccgtctccgtgaagcccgtggccatcaagggtctcgccgagcagctccatctcccggaaggaagctcgccgtcgccccagggccggtcgggccccgcttcatccgcaggccccgcgcaacccgcgtggtggccaatacggcgacaaaaccggtctaactttgaacccgaaaaaaatccgggaaaaacccccccgaaaaaaaagggggggggaaccccccttttagggggtttttaaaaaacccccccccccctcc

SEQ ID NO: 60508 - DNA, 657 bp, Zea mays
  misc_feature: Ceres CLONE 1520145
  misc_feature: Encodes the peptide sequence at SEQ ID NO. 60509
ggagctccccgcggtggcggccgctctagaactagtggatcccccgggctgcaggaattcgtctcacccctagaaaaaaccccccactttagacagttcgtcagaccttctcgtttttccttcgacgtccgctctcaccgagtgcgctaccacggctgcctccaggaaagcgacagcttctgcctaacaacaacaaatcagcaggttgatcagctcggtgccaacaaagcctcagcaaccgactttcatgacagatctcgacgtcccccttccggctggctttgatccattaggtgagacatatgctgaggcattctggtgctggacctggatcaatcgattatgtgtgtgtgcgcatacctcagcgctaccgtgaaaagagtctgactacagaccacggtctaaagaaggagtccagcgattactagatgctcacggatctgaacaaggaattctgctgcaataggtactgtaattcatgactccatagctacgccaggtcattcggatccaaggagaacatcgcaagagtgttgctacttacctatttcaagctgggagtgcagagtactgaaattgatatattcaggattgctaaggaacctgttgatgcttcgcgccctctaatgagtgcctccacttgttggggaagcttga

SEQ ID NO: 60509 - protein, 41 aa, Zea mays
  misc_feature: Ceres CLONE 1520145
MLRHSGAGPGSIDYVCVRIPQRYREKSLTTDHGLKKESSDY

SEQ ID NO: 60510 - DNA, 503 bp, Zea mays
  misc_feature: Ceres CLONE 1520152
  misc_feature: Encodes the peptide sequence at SEQ ID NO. 60511
aatctggagctccccgcggtggcggccgctctagactagtggatcccccgggctgcaggaattcgtctcacccctatgaaaaaatccaccagcagctgaggtcgtcagccatggcggagcgggagcagcaagagcaggtggctagcgacgacgcggcggagtggaagcaggtggcggagctgagggccgtcacccaggcccaggacccttcctgcgaggatgaggacgactacacgctccggcgcttcctccgcgcgcgggaccacaacatcggcaaggcgtcggcgatgctgctcaagtacctcaagtggaagccgcggccaagcccccggcgcatccatctcggagtggccgggagcgggcaggggaactctacctgctggccacgaccgggagggcgccccctcatctacggcttcgggggggctcatcacccgagcgcagggactcgacaagttaaaggctattcgtcaaggtcctctaaccccccgtccagcgcctgg

SEQ ID NO: 60511 - protein, 131 aa, Zea mays
  misc_feature: Ceres CLONE 1520152
MAEREQQEQVASDDAAEWKQVAELRAVTQAQDPSCEDEDDYTLRRFLRARDHNIGKASAMLLKYLKWKPRPSPRRIHLGVAGSGQGNSTCWPRPGGRPLIYGFGGAHHPSAGTRQVKGYSSRSSNPPSSAW

SEQ ID NO: 60512 - DNA, 563 bp, Zea mays
  misc_feature: Ceres CLONE 1520158
  misc_feature: Encodes the peptide sequence at SEQ ID NO. 60513
aaagctgggaagctccaccgcggtggcggccgctctagaactagtggatcccccgggctgcaggaattcgtctcacccctagaaaaaaccaaacaagcaagctagctggtcaccagttgttaacatatacatcagcaagctccacgaaagcaagaagaagaagaaacatgacgaccactagctgcgcgtcgtcaagctcctagacagccgtactcctcttcttcgccgtctctcttcggggtaccaagggcgagccatgcggcacgtccagcatccacgtgcagaccgtcaacacgggcgcgacagcagctgccggcgacacgctgttcgagggtcaagtgaaaaactgtgcttatcagcgtcaagaacctgcgcgtggacggttgcggcttcgctacgacggtggtagtcgacccggccctgttccgcccagtggaccgcggtgtcctccctagtgaacgccgggggaatccatccgcggacctgggccattcgggaaccttcccgttaacccttgggacccactccttccccggtggaccccccaagaaacctggggaggt

SEQ ID NO: 60513 - protein, 50 aa, Zea mays
  misc_feature: Ceres CLONE 1520158
MRHVQHPRADRQHGRDSSCRRHAVRGSSEKLCLSASRTCAWTVAASLRRW

SEQ ID NO: 60514 - DNA, 655 bp, Zea mays
  misc_feature: Ceres CLONE 1520160
  misc_feature: Translation starting site: 172
  misc_feature (114)..(114): n is a, c, t, g, unknown, or other
  misc_feature (427)..(427): n is a, c, t, g, unknown, or other
  misc_feature (465)..(465): n is a, c, t, g, unknown, or other
  misc_feature (532)..(532): n is a, c, t, g, unknown, or other
  misc_feature (551)..(551): n is a, c, t, g, unknown, or other
ggagctccccgcggtggcggccgctctagaactagtggatcccccgggctgcaggaattcgtctcacccctagaaaaaattcgtgtcctggcatccgcagagagtttgttccgntccaggcaaccaaaaagcgttgccccgccgcgcagaggaagaagagagcagaggaggatggctcgtacgaagcagaccgcccgcaagtccacgggaggcaaggccccccgcaagcagctcgccaccaaggcggcgaggaagtcggcgccgacgaccggcggcgtgaagaagccccacaggtacagggcccggaaccgtggcgctgcgcgagatccgcaagtaccagaagagcacggagctgctgatccgcaagctgcccttccagcgcctggtgcgcgagatcgcgcaggactttcagacagacctccggttnccagagcacgccgtgctggcgctcccaggagggcgcgnaagcctactcgtcgggctctttcgaggacaccaacctctgcggcatccacgcccaagcgcgtcaccnatcatgcccaagggaattncagctcgcccgccgcattccgtggggaggcgcgctaaggcttcattttccgaggaatttgatgaaatgtcctagttcccaaacaaataggcccattttaaccgg

SEQ ID NO: 60515 - DNA, 614 bp, Zea mays
  misc_feature: Ceres CLONE 1520162
  misc_feature: Encodes the peptide sequence at SEQ ID NO. 60516
aagctggagctccccgcggtggcggccgctctagaactagtggatcccccgggctgcaggaattcgtctcacccctagaaaaactccgcatttccatcctgtcgtgggatcccagccaccgccgctagaagaagagctcggcgattcccaggtcccgcgagaatatgccgaagcagatccatgagattaaggacttcctcctcaccgcgaggaggaaggatgcccgctcagtgaagatcaagaggagtaaggatgttgtcaagttcaaggtgcgctgctccaagtacttgtacacgctctgcgtcttcgatgctgagaaggcaaacaagttgaagcaatctcttcccccaggtttgaccgtcgaggaggtctgattggatacatggcaacgccgagttgaactacccaagcttctttatcagtagcagagcatgctactctatgtacttttggaacctaagctattagacctgtcagtgttggatgtctggatcttgcatttttggagaaataccaatttacctcgttcaaggatgcaagtatatttcttgtttaactgcacattactttatattttatgcctggttcatacctttcccggtaaaaaaaataaa

SEQ ID NO: 60516 - protein, 69 aa, Zea mays; identical to SEQ ID NO: 8575
  misc_feature: Ceres CLONE 1520162
  misc_feature (2)..(69): Pfam Name: Ribosomal_L38e Pfam Description: Ribosomal L38e protein family

SEQ ID NO: 60517 - DNA, 672 bp, Zea mays
  misc_feature: Ceres CLONE 1520165
  misc_feature: Encodes the peptide sequence at SEQ ID NO. 60518
gctctagaactagtggatcccccgggctgcaggaattcgtctcacccctagaaaaaacagttccacgccgccactccccccaacccgaccacgctgcgcctccgcttgacccccagccgagggaggaatgggtaagggtacgggcagcttcggcaagcgccggaacaagacgcacacgctctgcatccgctgcggccgccgcatcttccacctccagaagagtacctgctcctcctgcggttaccccgccgcccgcatccgcaagtataactggagtgtgaaggccatcaggcgcaagacaaccggtaccggaaggatgaggtacatgcgccacgtgcctcgccgtttcaagagcaacttcagagaatggactgaagctgctcccaaaaagagtgctgccgctgccaactaagtctggatgttgctatcaagaacctgataagctacaacactgccacacttatgcttgacttgtactttctgaactttttacccccaatactcccggaagtacttgatttatcattgcctctgaatttaaagtcagaaccccctgggtggttttaaaaaaaaaaaaaaaaaaacccaaaaccccccccactggcacccccactcccccccttatcatgaagttcgttatttaactcccccccctccccttggtcccgactg

SEQ ID NO: 60518 - protein, 94 aa, Zea mays
  misc_feature: Ceres CLONE 1520165
  misc_feature (2)..(55): Pfam Name: Ribosomal_L37e Pfam Description: Ribosomal protein L37e
MGKGTGSFGKRRNKTHTLCIRCGRRIFHLQKSTCSSCGYPAARIRKYNWSVKAIRRKTTGTGRMRYMRHVPRRFKSNFREWTEAAPKKSAAAAN

SEQ ID NO: 60519 - DNA, 769 bp, Zea mays
  misc_feature: Ceres CLONE 1520168
  misc_feature: Encodes the peptide sequence at SEQ ID NO. 60520
  misc_feature (1)..(1): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (44)..(44): n is a, c, t, g, unknown, or other
nccataaaacttggacgaggataaaaaaacgcttctnnnggttnttttttttaattggttaatcaccctggagctgcccgccagtattgactctctaaaacccgggatcccccttgcctccttgtttcgtctcacccctataataaaggccaccaaaggtagcttgccatcacaacgaacaaaagctttcgatctcacctacaccgaggaagaagagatcaatggaatcagagcaaggagtcgtgatcgcgtgccacagcaaggctgagtttgacgcccacatgaccaaggcccacgaagccatgccagctggtgggtaaatgggagatcagtggacgaaaaagaaagcggcacaaaggaccgccccccacccgcccccctactgattagtgtttgaggtggtttacccaaaaaaaatacaaacacccgggggcgggattcaccggaaatagtgctccccctgtattgtttgtgagaaaaaataactcacaggcgggcctcatccagaaactaagcgaatatgtcgaaaccatcaactggtacctcgccctagagggctcgcatcatttttgttttgcacgcattaagactgaaaccgttagcataattaaaaagaagaaacacaccaggcggtgagtaagaaaaataaccaatagaagagaggagacgtgtctatcatcttacaataatagttctgtcatttaacccctccacgtcgaatagtaggagaatgaagatagatgtacgtactgactacgtgtggcatatg

SEQ ID NO: 60520 - protein, 32 aa, Zea mays
  misc_feature: Ceres CLONE 1520168
MESEQGVVIACHSKAEFDAHMTKAHEAMPAGG

SEQ ID NO: 60521 - DNA, 578 bp, Zea mays
  misc_feature: Ceres CLONE 1520174
  misc_feature: Encodes the peptide sequence at SEQ ID NO. 60522
  misc_feature (341)..(341): n is a, c, t, g, unknown, or other
agctccccgcggtggcggccgctctagaactagtggatcccccgggctgcaggaattcgtctcacccctagaaaaaagggaactgaggaaacgtctcgaatggtcgaacagtagtttgctcgctattatccatggcgacttctacggctgctgccactgcactgctccgccccaggccggcagttccagccaagttggcgcagaggaggtgcctccatgcggttgctgggtggacgacgatgaggaggaggggagctgcaggggtcgtgcgagctttcttcaaccctctcggggatgagcgcatcctccgagaagccatcaaggagccagtagcattcatngggtggtgtgtttgctggcctcttgaggcttgacctgaatgaggatcctctcaaggaatggataagtcggacagtggaggcttctggaatagctgaggaaaacagctctgaagaatcaagtgaggcagatcaaaatgatgcccctcaccaaattgaaattgattgaggtgcattgtcaacttttgtcaccttggcacttttcccttggaacttaccccgaaaatttttgacacctga

SEQ ID NO: 60522 - protein, 80 aa, Zea mays
  misc_feature: Ceres CLONE 1520174
  misc_feature (70)..(70): Xaa is any aa, unknown, or other
MATSTAAATALLRPRPAVPAKLAQRRCLHAVAGWTTMRRRGAAGVVRAFFNPLGDERILREAIKEPVAFXGWCVCWPLEA

SEQ ID NO: 60523 - DNA, 654 bp, Zea mays
  misc_feature: Ceres CLONE 1520179
  misc_feature: Translation starting site: 138
  misc_feature (296)..(296): n is a, c, t, g, unknown, or other
  misc_feature (303)..(303): n is a, c, t, g, unknown, or other
tggcggccgctctagaactagtggatcccccgggctgcaggaattcgtctcacccctagaaaaagccggagtgtagcggggcgaagccatccgaactccgaaaagccccccagcggcctcccctccgccccgcagccatggccgccaccggcgtggtcgccgagccgaagaccaagtacgatcgccagctcaggatatggggtgatcaaggccaggctgcactggagaaggctagcatatgcttgcttaactgtggtcctaccggaaccgaagcattgaagaatctcgtgcttggnagcatangaagtgtgactgttgttgatggctcccaagttgaagcatctgacctgcggaacaggtggtctgttggatgaaggctgttttgggcaaccaagagctaaatctatatgttctttcctacaagagcttaatgacgctgttaaggccaagtttgttgaggagtctccagcgcatttgatagatactaatccttctttcttttcccagtttactggttgtattgctaccccgcttcccgaagagttttttactgaacctagattatatctggcgggaaagcaaatatcgtttttggttgctgcccggttcctatgggcctaacccggtttggttcagggttaacataaaaggaac

SEQ ID NO: 60524 - DNA, 636 bp, Zea mays
  misc_feature: Ceres CLONE 1520182
  misc_feature: Encodes the peptide sequence at SEQ ID NO. 60525
  misc_feature (567)..(567): n is a, c, t, g, unknown, or other
cggtggcggccgctctagaactagtggatcccccgggctgcaggaattcgtctcacccctagaaaacccctagaaaaacgagtacctgacaacggtgagcgggcactacgcgccgatcgcgcccggcggctcgccggtcatccgctcgctggcgttccggaccaaccagggggcgtacgggccgttcggcgtggcggagggcacgcccttcgagttcccggtggacggcggcgtcatcgtcggcttctgcgggaggagcgggtggcagctcgacgccgtcggcctctacgtcgcgccgctgcgcccggagaccgtgtacgacagggtgcacaagcttggcctcacggcttaccgcgcagtttggcagcggatcgggtcccagcagcagcagcagcagcaagaaccggtgaaactgctgaacggcaacgcgcagattactcacaagatgtaaccaactgccaggatgccaaccatgactatctatattctgcagtccgaatgtatccagctagcgtatggatctaatgtacctgtacctcatcctgatatgaacacttcagcgtatgnattctaaacatgcagcaaacagttcctgccaaggggacttgggctggctgcccactctttaaaaagcaa

SEQ ID NO: 60525 - protein, 33 aa, Zea mays
  misc_feature: Ceres CLONE 1520182
  misc_feature (32)..(32): Xaa is any aa, unknown, or other
MTIYILQSECIQLAYGSNVPVPHPDMNTSAYXF

SEQ ID NO: 60526 - DNA, 662 bp, Zea mays
  misc_feature: Ceres CLONE 1520186
  misc_feature: Encodes the peptide sequence at SEQ ID NO. 60527
ggagctccccgcggtggcggccgctctagaactagtggatcccccgggctgcaggaattcgtctcacccctagaaaaagctctgccttcccagtctcccatccctgaaaacctcacaaaaccctcgctcgctccccaccaccccgccgcgccgccgcctgtaccagctgcgtcaagatgagtcggcaccctgaggtgaagtgggctcacaggatcgacaaggtttacatcactgtacagttacctgacgcacaggatgctaaggtcaatttggatccagatggtgtcttcacattctctggcagtgctggtacaaacttgtatgaattgaaactagatctgaatgacaaagtaaacgttgaggctacccaaataagtgtgggggtcaggtccatattctgtatcccacaaaagctgaagcccaatggtggaaagaaactccgtcgagatgatcaaaggcgacctccttttgtgaaagttgaatgggaaaattgggttgaagaaaaagaatatgggggctaaaaccacctgggatgggagggccttccccaatttcgggagcactgggtggttaaggccgggctgggtgggcgtgggagaatttgcccgggaaggggggggcctttgggagcattgctggtgatagggggggctttttggggg

SEQ ID NO: 60527 - protein, 114 aa, Zea mays
  misc_feature: Ceres CLONE 1520186
  misc_feature (5)..(79): Pfam Name: CS Pfam Description: CS domain
MSRHPEVKWAHRIDKVYITVQLPDAQDAKVNLDPDGVFTFSGSAGTNLYELKLDLNDKVNVEATQISVGVRSIFCIPQKLKPNGGKKLRRDDQRRPPFVKVEWENWVEEKEYGG

SEQ ID NO: 60528 - DNA, 642 bp, Zea mays
  misc_feature: Ceres CLONE 1520187
  misc_feature: Translation starting site: 290
tggcggccgctctagaactagtggatcccccgggctgcaggaattcgtctcacccctagaaaaagtgctttcttaaaggtgggttggcttctcctccccctccggttcgggttcaggttcgtgaggttctccggggttcggtttcctgggtagagcgaatcgacatgtccgcttccgatagttgagtaccgctgcttcatctgcggcctcccctgagccacggacgaccactccttcctcaaggcctttagcacctactgagaggtcctcgagtcctggatcatcctcgatgcggagacgcacaggtcccgcggcttcatgcttcttcgccttctccacggaggaggtgatgcccagcgccatcaagggcatgatcagctaggacctggacgggcgcaacatcaccgtctcttaggaccactcccgcttttgccgtggatgctgcaccagtgggtacagtggtggccctgtaagcagccgctacttctagacttctcgccttgatggcgtcggctcctatcgtggtgtcagcatcgcttacagtgacgtctgaagttacggggagtctgacattttgctactgaaatgtcataccgtgcctgcttgctacagcgactacctattgcgactgagatgaactgc

SEQ ID NO: 60529 - DNA, 968 bp, Zea mays
  misc_feature: Ceres CLONE 1520187-R
  misc_feature: Encodes the peptide sequence at SEQ ID NO. 60530
  misc_feature (968)..(968): n is a, c, t, g, unknown, or other
tggataatcccgacgggggtaacagcatccatcgatccgcagtccatgctggttgatgcatgggtctgctggagccgaggatgaacacagctgtaacaactgtacacaaagcgaccttgcaatcaaaaacacagatgggcaacaacaaacatgagacgaacgaagataaaccctctggactagggtaaacaacacggtagcgaacaggataacttggccgcgcgggccccaccgctcagttcctccagttcccatcagagttgccgtagccgccgccacggttgcctccgccgtagccgccgccaccaccaccgtagccgccgccgcctccgtagccgccgccgccaccgccgtagccgccgccgccatcacggcgcccgccaccgccgtaaccgccgcctccacggccaccaccgtacccaccgccgcctgctctacggccgccgcgggactggggcctcgttgacggtgatgttgcggccggtcagctcccttgccgttcatgccctcgaaggggtttccgcatcaccctcctccctgggaggaagtgacgaaccccgaaagcgcgtgggaacctcgtgcgtctcccgaaaaaaagggataatctttgggccccgagggacctccccccttaggttccctacaggccttttgtgaaaagggaaggggcccccccggtgggccccagggaagaggcccccaaacataaagcaggcgggatattaaatattccgaagcgcccccatatttagatcgcctttccccaccaaaaacccatacccccggggaaaacctccaaaaaccgtaacccgtatccgtggggagtgggagaaacctcccacccctcctaaaaaagacccttttcttgggtggggagaaaaaatccccccgccccccggggacaaccaccttttttaggggggggcccaccactggggagacacgccgtgtttctgtccttttaagan

SEQ ID NO: 60530 - protein, 61 aa, Zea mays
  misc_feature: Ceres CLONE 1520187-R
MLRPVSSLAVHALEGVSASPSSLGGSDEPRKRVGTSCVSRKKGIIFGPRGTSPLRFPTGLL

SEQ ID NO: 60531 - DNA, 878 bp, Zea mays
  misc_feature: Ceres CLONE 1520187-R2
  misc_feature: Encodes the peptide sequence at SEQ ID NO. 60532
  misc_feature (665)..(665): n is a, c, t, g, unknown, or other
  misc_feature (671)..(671): n is a, c, t, g, unknown, or other
tactcgagcgtctcgtttttttttttttttttccttgaagataacttgggataaagcctgacgggggtaacagcttccatcgatccgcagtccatgactggttgatgcatgggtctgctggagccgaggatgaacactgctctaacaactgactcaaagcgaccttgcaatcaaaaacacagatgggcaacaactaacatgagacgaacgaagataaaccctctggactagggtaaacaacacggtagcgaacaggataacttgggcgctcgggccccaacgctcagttcctccagttcccgtctggatttgccgtaaccgccgcctcggttgccaccgccgtagcctccgccaccaccacctgagacgccaccgcctccgttgccgccgccgccaccgccgtaaccgccgcctccatcacggttcccgccaccgcattttcccccggactacgatgccaccagcggacctctcctgcgccgcctccacggctcgccgcgggactgggcctcattgacggtgatgttgctgccgtccagctccttgccgttgatgccctcgatggcgttccgcatcacctcctccgtggagaaggtgacgaagcctaagccgcgggacactctgcgtctcccgatcgaggatagatcttggactccaggacctcnccgtangtgctgaaggctcttcgaaagggagtgagcctccctggccctcgcgtagcccgccgactaatcagcggtactcaacatccgatgccgccatctcgattctgtgtaccactgatccgcatccccgattacctcacgatccgataccgaactggatggtggatgacatgcgacccaccctctagaagcacctttttctaggtgtgagac

SEQ ID NO: 60532 - protein, 51 aa, Zea mays
  misc_feature: Ceres CLONE 1520187-R2
  misc_feature (48)..(48): Xaa is any aa, unknown, or other
  misc_feature (50)..(50): Xaa is any aa, unknown, or other
MLLPSSSLPLMPSMAFRITSSVEKVTKPKPRDTLRLPIEDRSWTPGPXRXC

SEQ ID NO: 60533 - DNA, 654 bp, Zea mays
  misc_feature: Ceres CLONE 1520191
  misc_feature: Encodes the peptide sequence at SEQ ID NO. 60534
tggagctccccgcggtggcggccgctctagaactagtggatcccccgggctgcaggaattcgtctcacccctagaaaaaaggagaaggcccccgacgggattattctttctccccgcgtgctctctatctctcccctctttctctccctctgcccgacgactaggccgccgccgccacggccccgccgccgccgccgtgcccaggtctttgtcggtccttgtccggcaacgagcaccctacagatggctgggaggcacaccattattctgatgcagccatctcaaaatagggcttctagaacatttatggattacaattcgattaatcatgcattggatggaatctgtgggctttatgaaaggaaaattagggatatcaacccaatgatcccaaacataacttatgacatcagcgacctctataacttcattgatggcctagccgacattagtgcgctggtttatgatcactcgattcaggcattcctgccatatgatcgacagtggataaagcaaaagttgtttcaacccctgaagaaatttggctcaccggtagcacaacttgttggttgttcttggatgcccttttatcccacaaacaaagcatgccgggacaataagtgtcccatccagggggttttggggaggtttttc

SEQ ID NO: 60534 - protein, 137 aa, Zea mays
  misc_feature: Ceres CLONE 1520191
  misc_feature (3)..(105): Pfam Name: ER Pfam Description: Enhancer of rudimentary
MAGRHTIILMQPSQNRASRTFMDYNSINHALDGICGLYERKIRDINPMIPNITYDISDLYNFIDGLADISALVYDHSIQAFLPYDRQWIKQKLFQPLKKFGSPVAQLVGCSWMPFYPTNKACRDNKCPIQGVLGRFF

SEQ ID NO: 60535 - DNA, 639 bp, Zea mays
  misc_feature: Ceres CLONE 1520193
  misc_feature: Translation starting site: 132
  misc_feature (316)..(316): n is a, c, t, g, unknown, or other
  misc_feature (387)..(387): n is a, c, t, g, unknown, or other
  misc_feature (415)..(415): n is a, c, t, g, unknown, or other
  misc_feature (423)..(423): n is a, c, t, g, unknown, or other
  misc_feature (443)..(443): n is a, c, t, g, unknown, or other
  misc_feature (445)..(445): n is a, c, t, g, unknown, or other
  misc_feature (451)..(451): n is a, c, t, g, unknown, or other
  misc_feature (468)..(468): n is a, c, t, g, unknown, or other
  misc_feature (481)..(481): n is a, c, t, g, unknown, or other
  misc_feature (483)..(483): n is a, c, t, g, unknown, or other
  misc_feature (520)..(520): n is a, c, t, g, unknown, or other
  misc_feature (556)..(556): n is a, c, t, g, unknown, or other
  misc_feature (587)..(587): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
cgtggatcccccgggctgcaggaattcgtctcacccctagaaaaaaaagcattgaagcaaacaaccctgcaactgcaacaagccctgacgcttaatacatcggccggctctcgatcggcagcacatcattgatggcggccgcggacggggacaaggcgaagagcggcgtcggtgggcagcagatgcaccgcggtgcgggggctggacgtggcgcggtacatggggcggcggtacgagatcttgtcgttcccgtccttcttccaggcgggggaacggccgcgacacgcgcgccacctaccggctgctggatgaccgngccaccgtggacgtgttcaacgagagggggagggggggtattgtgattattttttgtgccccccctcttcngggcgaaccgggggccactaggccgggnggagggangggccacttccgcccttcgncncgttgnccccggccccggcgccnccggggggacccncnttcagatcaataccatgagagggtgcgcggccaaggncgtctgtaagaacctcggggtgccttcctcggacgnggcagattggacttaagacttgggatttccnctcatttgtggcnnntccttgcccgcttgggtcctaccccggctctctctcc

SEQ ID NO: 60536 - DNA, 652 bp, Zea mays
  misc_feature: Ceres CLONE 1520194
  misc_feature: Encodes the peptide sequence at SEQ ID NO. 60537
  misc_feature (652)..(652): n is a, c, t, g, unknown, or other
gctctagaactagtggatcccccgggctgcaggaattcgtctcacccctagaaaaacgagcagaccaaggcggagatcatgcaggtgctgcggaagatgttccccggcaaggacgtcccggacgccaccgacatccttgtcccgagatggtggtccgacaggttctacaagggcaccttctccaactggccagttggcgtcaaccgctacgaatacgaccagcttagggcaccggttgggagggtatacttcaccggtgagcacaccagcgagcactacaatggctatgtccatggagcctatctttcaggtatcgactccgctgaaattctcatctactgcgcccagaaggagagtgggggtaccatgtccagggaaagtatgactaggaagctacagcaaattgatttaaagctcccgcaaattgagcagtgtggatgttgcatttctcagttcattttttccctggtttcaacaaagtataaatgacagccatgttccctcgcggcatatgcctttttcattattccaataaagctagcggctggttccatgaactaaaaaaaaaaaaaaaaaacgagacgcctccagggaccccaatttcccccttaagggaggccggattaacccgcgctccccgggccctcctttn

SEQ ID NO: 60537 - protein, 136 aa, Zea mays
  misc_feature: Ceres CLONE 1520194
  misc_feature: SWISSPROT Homolog: EC 1.5.3.11 Polyamine oxidase
MQVLRKMFPGKDVPDATDILVPRWWSDRFYKGTFSNWPVGVNRYEYDQLRAPVGRVYFTGEHTSEHYNGYVHGAYLSGIDSAEILIYCAQKESGGTMSRESMTRKLQQIDLKLPQIEQCGCCISQFIFSLVSTKYK

SEQ ID NO: 60538 - DNA, 519 bp, Zea mays
  misc_feature: Ceres CLONE 1520195
  misc_feature: Encodes the peptide sequence at SEQ ID NO. 60539
tggcggccgctctagaatagtggatcccccgggctgcaggaattcgtctcacccctagaaaaaaccttgccatcacctcctcgcctagactgccactgccagcaggtgacaccgccatctctgctctgactctcgcaacgaaagcgcacgctcggccgcctgccagagttgccatggagaccatacccacgatggctctgctgaaccccgacgccaaggctgcggcgcgttcggcgccgtccaccagcagcggcagcgtctcgctgcgcgtccggacggagcacgcagccaacaagctgcggtgtccgcatcagcgtaatcacactggtggcgctttctcccagagctcgcgctgcgccagacctgccctggggaacttcttgtcgccgaagaacccccccgggaaaaaccgaagggcggctggggactaaccccgggaaaaaaccccccccccttccgggggggggaattttgaaaaaaaaaaaccccccaaaaggggggggttaaaatatattttat

SEQ ID NO: 60539 - protein, 85 aa, Zea mays
  misc_feature: Ceres CLONE 1520195
METIPTMALLNPDAKAAARSAPSTSSGSVSLRVRTEHAANKLRCPHQRNHTGGAFSQSSRCARPALGNFLSPKNPPGKNRRAAGD

SEQ ID NO: 60540 - DNA, 546 bp, Zea mays
  misc_feature: Ceres CLONE 1520196
  misc_feature (318)..(318): n is a, c, t, g, unknown, or other
  misc_feature (396)..(396): n is a, c, t, g, unknown, or other
  misc_feature (398)..(398): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (527)..(527): n is a, c, t, g, unknown, or other
aattctggagctccccgcggtggcggccgctctagaactagtggtcccccgggctgcagattcgtctccccctagaaaaactgaagaaacctcaagtagctctggaatggaatcaagagatgatgatgttgatgcctgacttttcacaacgcaagttctgggggcaaagtagtttccagggcagccatggctttcctaggccaaaaagccctcgccctttggacttttgtcattcgtccccagtccaaaattgaccctgagcaattccaactccgggtaagcgggctggcctaaaccgccgggggtgaaaaagaaccncgaatttccccttttgaaaccccccaaaaaaaaaaacctttggtttttttcccccccccaaaagggggggggggtttntnnnncnnnnttccccccccggggatcccaaaaaaaaaaaacccccccccgaatctccccccccccaggattggcaaatttggttataaacccccacccccctttcttggggataaaacgtgggggggccntgtgtcgcgggaggtcttt

SEQ ID NO: 60541 - DNA, 620 bp, Zea mays
  misc_feature: Ceres CLONE 1520199
  misc_feature: Encodes the peptide sequence at SEQ ID NO. 60542
tacccgcggtggcggccgctctagaactagtggatcccccgggctgcaggaattcgtctcacccctagaaaaaaatcactgggaggcgcaagtagcaacccgcatcacgagttcacccacgctccccgcagagttcactagcgaccaaggagttcaaagaagaggcaacaagaacgaacgccaccaccgcgctccggtcgctttgcttggttcgggccactgcaccgccattgttgatctgttctccttctccttggaggagaaagaacagggggagaagaatgatggggcgccgtcaccgccgccgtccgccagcgaccgctcagccgccgccatcgccgccttcgccaggtcccacgcgcccgtcatctacgccgccgtcgccgtgctcgccgcgctgctcaggatggtctacctgggaagaatctacccgccggcctctttgttggttcgaattgggactcctttttttagttcggtcaacctctccatcttttccgcagtgtgcttgcgctctcgagaggagcagtagctggtgctggagtgctgcgttggggtcattaattaattaccggtgtggatttgccgaaacgattgattgacctgacattgatttttca

SEQ ID NO: 60542 - protein, 176 aa, Zea mays
  misc_feature: Ceres CLONE 1520199
TRGGGRSRTSGSPGLQEFVSPLEKNHWEAQVATRITSSPTLPAEFTSDQGVQRRGNKNERHHRAPVALLGSGHCTAIVDLFSFSLEEKEQGEKNDGAPSPPPSASDRSAAAIAAFARSHAPVIYAAVAVLAALLRMVYLGRIYPPASLLVRIGTPFFSSVNLSIFSAVCLRSREEQ

SEQ ID NO: 60543 - DNA, 648 bp, Zea mays
  misc_feature: Ceres CLONE 1520201
  misc_feature: Encodes the peptide sequence at SEQ ID NO. 60544
  misc_feature (434)..(434): n is a, c, t, g, unknown, or other
  misc_feature (438)..(438): n is a, c, t, g, unknown, or other
  misc_feature (440)..(440): n is a, c, t, g, unknown, or other
ctggagctccccgcggtggcggccgctctagaactagtggatcccccgggctgcaggaattcgtctcacccctagaaaaatctcccctcctcttccacggccgcgcctgcgacacccatccgccgccacgccatggccaagtacaacgtggtgcagaagaacaagcgccagtgcaatcaggaccgcaagcgcgccgcgcatggggagcccgggaccggcaagctcaagcagcggaccgcgcccgtctccatgtccggcaagcggaagaagaagctcgagcgccgcctcaaccggaagcaaaaagaggctgcgatgattaaggcgctggagaacaacatgggggatgtcgacatgatctcagttgaagggtcttcagaagctgcaaagggcaagtcccaagtgaagttcagtgtgaagaaaaactcaagaatacngatnangagattaaaggggcaaggaagaaagccaaaaattcaaaaccccctgccaaggagagagttgatgcaatggtagaaatgacaagttgatgccttggttcccttgacggacaaaacctcatacatccccttttgatgtttttcccaaattttggaacatggaacccaacctccccaaaaactgggcggggtggtctttggaactttctgg

SEQ ID NO: 60544 - protein, 126 aa, Zea mays
  misc_feature: Ceres CLONE 1520201
  misc_feature (101)..(101): Xaa is any aa, unknown, or other
  misc_feature (102)..(102): Xaa is any aa, unknown, or other
  misc_feature (103)..(103): Xaa is any aa, unknown, or other
MAKYNVVQKNKRQCNQDRKRAAHGEPGTGKLKQRTAPVSMSGKRKKKLERRLNRKQKEAAMIKALENNMGDVDMISVEGSSEAAKGKSQVKFSVKKNSRIXXXRLKGQGRKPKIQNPLPRRELMQW

SEQ ID NO: 60545 - DNA, 631 bp, Zea mays
  misc_feature: Ceres CLONE 1520204
  misc_feature: Encodes the peptide sequence at SEQ ID NO. 60546
  misc_feature (342)..(342): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
  misc_feature (468)..(468): n is a, c, t, g, unknown, or other
  misc_feature (514)..(514): n is a, c, t, g, unknown, or other
ggagctccccgcggtggcggccgctctagaactagtggatcccccgggctgcaggaattcgtctcacccctagaaaaacccaggcaccagcatagatctcgtgggctcgccactattattctgcacagcaacgcatcagccttctggaaccatctcgccgccgccacaccacaatccacaacccgtcgaagcgaagcaagcaatggccggagtcggatcgaaggccctcgccgttgccgccgttctggcggccgtctccttctcggtggccgccgcggccgaggcgcccgcgcccagccccgtctccgccgccgtcgcggcgtcgtcgccctttcgcgcggntctcgtcgcctccgccgccgcttcctcttttcgcgcgtccgcactgagccgatgggcctcgtgcctgcaggctacctagcagtatttcccccgcgnnncgccgcggcgctaaaattattttatggnatgctatccatagtaccaataaaaaggaaattgtgtcggggctgcnggtcccctcccattttggccgatcgggttccctggggagggaggtttcaaacctgtccgggggcggtgggggaccccccccccttgaaaaaactggcttccccccggacgggaaggg

SEQ ID NO: 60546 - protein, 72 aa, Zea mays
  misc_feature: Ceres CLONE 1520204
  misc_feature (47)..(47): Xaa is any aa, unknown, or other
MAGVGSKALAVAAVLAAVSFSVAAAAEAPAPSPVSAAVAASSPFRAXLVASAAASSFRASALSRWASCLQAT

SEQ ID NO: 60547 - DNA, 649 bp, Zea mays
  misc_feature: Ceres CLONE 1520206
  misc_feature: Encodes the peptide sequence at SEQ ID NO. 60548
  misc_feature (380)..(380): n is a, c, t, g, unknown, or other
  misc_feature (452)..(452): n is a, c, t, g, unknown, or other
  misc_feature (461)..(461): n is a, c, t, g, unknown, or other
  misc_feature (492)..(492): n is a, c, t, g, unknown, or other
  misc_feature (578)..(578): n is a, c, t, g, unknown, or other
gctctagaactagtggatcccccgggctgcaggaattcgtctcacccctagaaaaaattccccaaaaccaaaataatcgccaccgctctccgcaccgaaccgaagcagcggcgatgtcggcggagaagccggctcccgtgcgcgtgctctactgcggcgtctgcggcctcccggccgagtactgcgagttcggccccgacttcgagcgctgcaagccctggctgcgcgcgcacgcgcccggcgtctaccccgacgaccttgtcgccgcctcctcctcacccggcggcggcgacaaggacgtcgacaaggtcggggatcgcctccagggcgtcgggatctccgacggctccaccggcgccgcaggggatgcttccgcgtcntagccccagaggcgaaacgcctgcctggtgggtagctcaagaaaaggagaaagcagaagtggtcattgagangattgtccngtaacagcgcaaatgtgttactgtggtgaangggctttgattggttgggtgtaaagcttaatgatgcttccaaaaaactttgggaagaagtttgcaacccgacctttcggttgttangggcccttccggaaaagacccaatcgaccttacaggggggcttccccaatgagatattggggagttcctta

SEQ ID NO: 60548 - protein, 89 aa, Zea mays
  misc_feature: Ceres CLONE 1520206
MSAEKPAPVRVLYCGVCGLPAEYCEFGPDFERCKPWLRAHAPGVYPDDLVAASSSPGGGDKDVDKVGDRLQGVGISDGSTGAAGDASAS

SEQ ID NO: 60549 - DNA, 672 bp, Zea mays
  misc_feature: Ceres CLONE 1520208
  misc_feature: Encodes the peptide sequence at SEQ ID NO. 60550
ggagctccccgcggtggcggccgctctagaactagtggatcccccgggctgcaggaattcgtctcacccctagaaaaacaccacaacccagcgccggcagtcgccgtcatcgatcgatcgccggaaaactaacccctaacgatgtctggagccggcgaggaggacaagaagcccgcggagggcggcgcccacatcaaccttaaggtcaagggacaggatggcaatgaggtgttctttcgcataaagaggtccacccagctgaagaagctgatgaacgcttattgtgaccgccagtctgtggacatgaatgccattgcgttcctgtttgatggccgcaggcttcgcggcgagcagacccctgatgagctggagatggaggacggcgacgagatcgacgccatgcttcaccagaccggaggcagcgttcctagcaccacctaaaagcctcgttttgctctccgtccctgcgtagtagtaaacaaaagggaaaaagtctttttaaataaaggaacttgtgatgctctgggctccttgtgccatttgctgaagggacatcccttagcctttgtttagtaaagatgggtttggaaactttggttctgttcatcacctcgtttatctaatccctaaaaccatgccgccaaaaaaaaaaaaaaagaaaccgaaaacgct

SEQ ID NO: 60550 - protein, 99 aa, Zea mays; identical to SEQ ID NO: 19564
  misc_feature: Ceres CLONE 1520208
  misc_feature (21)..(91): Pfam Name: ubiquitin Pfam Description: Ubiquitin family

SEQ ID NO: 60551 - DNA, 637 bp, Zea mays
  misc_feature: Ceres CLONE 1520211
  misc_feature: Translation starting site: 170
aagctggagctccccgcggtggcggccgctctagaactagtggatcccccgggctgcaggaattcgtctcacccctagaaaaaatcttctcccccagctccccagcgcctgtccccaattatttggcctccgtcagagaggggagaaagacccgttcaaagcggcggcgatgtcggggcgcggcaagggcggcaagggtctgggcgagggtggagacaagcgccaccggaaggtgctccgcgacaacatccagggcatcaccaagcacggcgatccggatgctggctcggaggggcggcgtgaaacgcatctccgggctcatctactaggagacccgcggagcgctcaagatcttcctcgagaacgtcatccgcgacgccgtcacctacaccgagcacgcgcgccgcaagaccgtcaccgccatggatgtcgtctacgcgctcaagcgccattggccgcaccctctaccgcttcggaggctaggcgcctcttcccatctggagaatgcttagggtgatacgtctctgtacctgtgggtcgtagtgttgctgcgttcctggatgtaatccattttttttttctgcttgaacacatgctggctcaaaagaaaaaatcgagacgctcgtagttcccattc

SEQ ID NO: 60552 - DNA, 873 bp, Zea mays
  misc_feature: Ceres CLONE 1520214
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (514)..(514): n is a, c, t, g, unknown, or other
  misc_feature (515)..(515): n is a, c, t, g, unknown, or other
nnnnnnnnnnnnnnnnnnnnnnnnnnnnnnnnnnnnnnggggggggggtttttttttttttcctgtgattccccgcggtggcggccgctctaaaactactggatcccccgggctgcaggaattcgtctcacccctagaaaaacccactcgagccagccagccagccagcaagccgcttgggcgccatctctctagagattcgtaacctcgaaaagaagatacggtgcggcccaataaacacacggcttactacaaaatcgcagatggccggcctcaagacgaaattcgtccccctcccccgccatggcgggcgcgcacgtggcggcccgccgaatactccgaagcccacgcacccggctcctgtgttcataaaacaatgatctaccttacaacttggtaatatgcttaaattgggcgtacggactccttctgtttaaccccccccctggtaggggggggggggggggggaagtttaatatccaatccacaaaaaaaaaaaatcatacctggacnnaaaagtaagctggatatttctgattattatggccgaccacggtagcaacaatcaaacgtaaaaaaagaaacaagcacggcacctagattcttatttccttacatgtaacactatcagcataattagagaggtgagaaaagatgaaaacaaatcaccaaaacgccccgcgggcgccctcggccgcccggccggtggacctgttcacgacccccctcgctttcatacccaccaattattaaattatacaataaacttatattccttatcatttttctgtcttttattatttatctaacgatatttttataatattacgtattaacctgacccctaccagcaatcgccgagtgttaaggtt

SEQ ID NO: 60553 - DNA, 642 bp, Zea mays
  misc_feature: Ceres CLONE 1520215
  misc_feature: Encodes the peptide sequence at SEQ ID NO. 60554
  misc_feature (520)..(520): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (639)..(639): n is a, c, t, g, unknown, or other
tggcggccgctctagaactagtggatcccccgggctgcaggaattcgtctcacccctagaaaaaaggggcgctggcagggcgcaggcaccgattggctcctgatatcgcagcgtggcggtcgctcagttcagtccgccatggaaggtgcagccggccaaatgctcgtcccgatcctcggcatcgttgccgtggccgccgtgaccttctacaccgtcagcttcatggagatgcgagacaaatccttcgaggagctcgacgagaagtactcggacttcgacgagtcaggcgggcggcagcggcggtctcgccgcagggccgagcgcgacaggaagaagtccaaatgattggccacgccgccatttgtgtccctgctggtttgagaggggactgacgggggatgaagacgcagctgctacttatgaatttttgggttccaagtcatgggtgagtgtgagtgtgagtgtgtgtggttatgaacatctgcctatttcctagctattagccactgaagcagctaanacgatggatttgtttaaacgactccgtaatacattatgtacccctctggtgtgcttcnnnnnnnnnnnnnnnnnnnnnnnnnnnnnnnnnnnnnnnnnnnnnnnnnnnnnnnnggaaanaaa

SEQ ID NO: 60554 - protein, 68 aa, Zea mays
  misc_feature: Ceres CLONE 1520215
MEGAAGQMLVPILGIVAVAAVTFYTVSFMEMRDKSFEELDEKYSDFDESGGRQRRSRRRAERDRKKSK

SEQ ID NO: 60555 - DNA, 657 bp, Zea mays
  misc_feature: Ceres CLONE 1520216
  misc_feature: Encodes the peptide sequence at SEQ ID NO. 60556
  misc_feature (1)..(1): n is a, c, t, g, unknown, or other
nataagctggagctccccgcggtggcggccgctctagaactagtggatcccccgggctgcaggaattcgtctcacccctagaaaaaatccagtgttctgtcctagcgccgccgccgccccagctcgccttgcgtgactgagagctcgtcggcttccgtccacgcgtgaagcgagagcatggacacccaggtgaagcttgctgttgtggtgaaggtgatgggcacgaccggctccaggggtcaggtgacccaggtcagagtgaagtttttggatgaccagaaccggctcatcatgaggaatgtcaaggggcccgttcgcgagggtgacatcctcaccctgctcgagtccgagagggaggccaggaggctcccctgaggccctagcgttcttggtgggctcttgtatggtctttggtgtcttggaatttgtgctatgtttgcacttctgtgaccctgttttaaaagtagtaaccctgggtttaagatttgcacttttggttatcctgggttgaaaatgccattggggttaaaacatggttacccttgcctatattatccaaaaaaaaaacgcatggcttggaatcctaaacaaaaaaaagaaaaaacccgaaaccccccgagggacccaatttccccctaatataaagcggaattaccg

SEQ ID NO: 60556 - protein, 65 aa, Zea mays
  misc_feature: Ceres CLONE 1520216
  misc_feature (1)..(65): Pfam Name: Ribosomal_S28e Pfam Description: Ribosomal protein S28e
MDTQVKLAVVVKVMGTTGSRGQVTQVRVKFLDDQNRLIMRNVKGPVREGDILTLLESEREARRLP

SEQ ID NO: 60557 - DNA, 671 bp, Zea mays
  misc_feature: Ceres CLONE 1520217
  misc_feature: Encodes the peptide sequence at SEQ ID NO. 60558
  misc_feature (396)..(396): n is a, c, t, g, unknown, or other
aaagctggagctccccgcggtggcggccgctctagactagtggatcccccgggctgcaggaattcgtctcacccctagaaaaaccactgcgactgtgagcttcgttcgttcagttcatccgtgttcttgtttgcgaggtcgagagagagaggatgtcgtgctgcggaggcaactgtgggtgcggctccggctgcaagtgcggcaacggctgcggagggtgcagcaagatgtacccggacatggctgagcaggtgaccaccaccacccaggctctcatcatgggtgtcgcaccatccaaggggcacgccgagggcgggttcgaggcggccgccggagctgaaaacggcgggtgcttttgccgcccccccctgcggggggggggggggtgcaactgcngcaagtgaacttagtgctcccccctgcaggccggccggaggaacctagctaattattataacctaaataaaggttagcgggcgtcccctgtggtgtgtttccgagtccatccagcagtttaattgcggggccttggcggggcatgcctccgagtctgaaaatgaaggatgaatccctgaatgggggggggtcctggccctggtaatcccccccccggcccccccccgggggcctttctggggggcgaaacaaagggggcttggggttatagttcg

SEQ ID NO: 60558 - protein, 83 aa, Zea mays
  misc_feature: Ceres CLONE 1520217
  misc_feature (1)..(81): Pfam Name: Metallothio_2 Pfam Description: Metallothionein
  misc_feature (82)..(82): Xaa is any aa, unknown, or other
MSCCGGNCGCGSGCKCGNGCGGCSKMYPDMAEQVTTTTQALIMGVAPSKGHAEGGFEAAAGAENGGCFCRPPLRGGGGCNCXK

SEQ ID NO: 60559 - DNA, 627 bp, Zea mays
  misc_feature: Ceres CLONE 1520220
  misc_feature: Encodes the peptide sequence at SEQ ID NO. 60560
tccccgcggtggcggccgctctagaactagtggatcccccgggctgcaggaattcgtctcacccctagaaaaaacgcacctgctccattacccgtctgccgtcggcataacataatcgtcgtcgcgtgcagtccccattcccttttccagtggtctgttgctcgcgcttcgtccagcttctccggaagaggtagcacggcaacggcagatgatgagtgaccccaagtacgcctacgcctaccccgcgcaggggtactaccaagggccgtaccatgccccgccgcgtgatggggagccgccgccaattactacgccgccgcccgccaaaagggaagccaaaactttccgggaaagctggaacttttcccggggcggccaattcttgacccttttttaattattccccggccccaagttttaagggggggggcccgcccccccatggaagggggggtaattcccaaggaaggggccccccctctcccggggggggtttttggccccattaaaattaaaacggggttatttgaaaaccgggcaccccttttggtcccccccgtgttttaaacaaaaaaaggggggggagaaaaccccccccatatttttttttgggggaagaaaaaaaaa

SEQ ID NO: 60560 - protein, 62 aa, Zea mays
  misc_feature: Ceres CLONE 1520220
MMSDPKYAYAYPAQGYYQGPYHAPPRDGEPPPITTPPPAKREAKTFRESWNFSRGGQFLTLF

SEQ ID NO: 60561 - DNA, 753 bp, Zea mays
  misc_feature: Ceres CLONE 1520221
  misc_feature: Encodes the peptide sequence at SEQ ID NO. 60562
  misc_feature (10)..(10): n is a, c, t, g, unknown, or other
tttttttttnttttttttttttttttttttttctttttttttttttttttctcaagctggagctccccgcggtggcggccgctctataactagtggatcccccgggctgcaggaattcgtctcacccctagaaaaagtgtgtgtgtgtgtgaccgtgcgtgaggcgtgagtccgtgaccattcccgtcggccgtcccaaaagaagcgcaaatttacaacccagtccaccacgggccacacaatcccaaatctaaccctccgacggcgatggggatctcgagcatgccggagccgcgggacagcctgctggggtacctggtgtacaacacggtgatctccatcgcggcgctggcggggctgttgcggtcggcgctggtgttcctggacctgcaggccgcgctgccgcccggggacgactgctggtacctactggtggcgtctggcccgggaactggagaaccggttctcaaggccttccggccggcgcatgaacaagtgcttggcgtccacggcgacgacatgcgaaggcagaaagcggcacccaacggggaccacctgcctccgtgtggccttgtccgggttcccgggcgaggagacccctgtgtaaacaatcttccccctggggggaccaaccttttttccagccggcgcgccttggcccccaagaaaccctggggcttccccagtaagaacatccgtcccctcaacgcgggaggccaggactactagtgcccgggaggattataaagttgg

SEQ ID NO: 60562 - protein, 153 aa, Zea mays
  misc_feature: Ceres CLONE 1520221
MGISSMPEPRDSLLGYLVYNTVISIAALAGLLRSALVFLDLQAALPPGDDCWYLLVASGPGTGEPVLKAFRPAHEQVLGVHGDDMRRQKAAPNGDHLPPCGLVRVPGRGDPCVNNLPPGGTNLFSSRRALAPKKPWGFPSKNIRPLNAGGQDY

SEQ ID NO: 60563 - DNA, 647 bp, Zea mays
  misc_feature: Ceres CLONE 1520222
  misc_feature: Encodes the peptide sequence at SEQ ID NO. 60564
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (51)..(51): n is a, c, t, g, unknown, or other
  misc_feature (52)..(52): n is a, c, t, g, unknown, or other
nnnnnnnnnnnnnnnnnnnnnnnnnnnnnnnnnnnnnnnncccaccaattnnaaaaagtggggctccccgcggtggcggccgctctagaactagtggatcccccgggctgcaggaattcgtctcacccctagaaaaagccaaccgcgaagcactacactacactacaccacacccacccgacgacgatcacacacgcagaagatcgagttcgttcgatcgtgaccgtgacgcaggaagctataagctagccaagacaggaataataatggcggcgtcgacggtggcgagcctctctgtcccggtgacgacgacgaccttcgcggcggcgggcggcggcgacgtgctgatcgtcgtcccgaggaggggcgggcgccaagcggcgtcgtcctgggttcccccgcgggggggtgcgcccgcggacgggcggggcgggtttggtgcgccgggggggccaaggggggccggccccgcccgccggaaacttccgacaaaggtgccggaaaaggttcaagcgggggggaaggaaaccttgggcgggacaaaccttaaaagggcgaacccccaaaattggcccccccgggcctgtgggaaacaaaaggggggagaggaaaaattttaaagcccccccaaggggcaaggagccccc

SEQ ID NO: 60564 - protein, 117 aa, Zea mays
  misc_feature: Ceres CLONE 1520222
MAASTVASLSVPVTTTTFAAAGGGDVLIVVPRRGGRQAASSWVPPRGGAPADGRGGFGAPGGPRGAGPARRKLPTKVPEKVQAGGKETLGGTNLKRANPQNWPPRACGKQKGGEEKF

SEQ ID NO: 60565 - DNA, 641 bp, Zea mays
  misc_feature: Ceres CLONE 1520223
  misc_feature: Encodes the peptide sequence at SEQ ID NO. 60566
  misc_feature (515)..(515): n is a, c, t, g, unknown, or other
cgcggtggcggccgctctagaactagtggatcccccgggctgcaggaattcgtctcacccctagaaaaacgtgctcgcctctcgggcatcctatctcgacggtgggagactcatgcaccggatgtgtgccaagctcgattcgcaccacacgctgcggcctgaggttcaagacatctacgcctgagctaggctctggtggcgcacatgtcaacaccggccaggaagcgcctgatgcgctacttcaagcgccttcagcacgaccagcccgccggcatcagcgacgcgccgtaccacaacattatcatgctctggatcctcgtcatattccgcccggatgacacgccttgagatggaggcacgttcgggctgactctgcaatttactcaccattaccccggcacacctcccactgttccgtttgtttcgacgatgtttcatccaaacatctatgccgatgggaacatctgtatggacatcctactagacactaggagccctatatatgatgctgcggncatattgacctctattcagtcgctgctgtgtgacccaatcccaattctcctgctactctgaagcacctaaaatgtcagccagatcaagctgataccacgtcaatttcgtgacgtgtgcaccaaact

SEQ ID NO: 60566 - protein, 47 aa, Zea mays
  misc_feature: Ceres CLONE 1520223
  misc_feature: SWISSPROT Homolog: EC 6.3.2.19 Ubiquitin--protein ligase
MSTPARKRLMRYFKRLQHDQPAGISDAPYHNIIMLWILVIFRPDDTP

SEQ ID NO: 60567 - DNA, 636 bp, Zea mays
  misc_feature: Ceres CLONE 1520227
  misc_feature (205)..(205): n is a, c, t, g, unknown, or other
  misc_feature (213)..(213): n is a, c, t, g, unknown, or other
  misc_feature (214)..(214): n is a, c, t, g, unknown, or other
  misc_feature (215)..(215): n is a, c, t, g, unknown, or other
  misc_feature (237)..(237): n is a, c, t, g, unknown, or other
  misc_feature (238)..(238): n is a, c, t, g, unknown, or other
  misc_feature (239)..(239): n is a, c, t, g, unknown, or other
  misc_feature (246)..(246): n is a, c, t, g, unknown, or other
  misc_feature (248)..(248): n is a, c, t, g, unknown, or other
  misc_feature (251)..(251): n is a, c, t, g, unknown, or other
  misc_feature (252)..(252): n is a, c, t, g, unknown, or other
  misc_feature (256)..(256): n is a, c, t, g, unknown, or other
  misc_feature (262)..(262): n is a, c, t, g, unknown, or other
  misc_feature (264)..(264): n is a, c, t, g, unknown, or other
  misc_feature (266)..(266): n is a, c, t, g, unknown, or other
  misc_feature (271)..(271): n is a, c, t, g, unknown, or other
  misc_feature (279)..(279): n is a, c, t, g, unknown, or other
  misc_feature (281)..(281): n is a, c, t, g, unknown, or other
  misc_feature (283)..(283): n is a, c, t, g, unknown, or other
  misc_feature (285)..(285): n is a, c, t, g, unknown, or other
  misc_feature (287)..(287): n is a, c, t, g, unknown, or other
  misc_feature (290)..(290): n is a, c, t, g, unknown, or other
  misc_feature (291)..(291): n is a, c, t, g, unknown, or other
  misc_feature (295)..(295): n is a, c, t, g, unknown, or other
  misc_feature (297)..(297): n is a, c, t, g, unknown, or other
  misc_feature (299)..(299): n is a, c, t, g, unknown, or other
  misc_feature (301)..(301): n is a, c, t, g, unknown, or other
  misc_feature (305)..(305): n is a, c, t, g, unknown, or other
  misc_feature (307)..(307): n is a, c, t, g, unknown, or other
  misc_feature (310)..(310): n is a, c, t, g, unknown, or other
  misc_feature (311)..(311): n is a, c, t, g, unknown, or other
  misc_feature (317)..(317): n is a, c, t, g, unknown, or other
  misc_feature (319)..(319): n is a, c, t, g, unknown, or other
  misc_feature (321)..(321): n is a, c, t, g, unknown, or other
  misc_feature (326)..(326): n is a, c, t, g, unknown, or other
  misc_feature (327)..(327): n is a, c, t, g, unknown, or other
  misc_feature (331)..(331): n is a, c, t, g, unknown, or other
  misc_feature (332)..(332): n is a, c, t, g, unknown, or other
  misc_feature (333)..(333): n is a, c, t, g, unknown, or other
  misc_feature (338)..(338): n is a, c, t, g, unknown, or other
  misc_feature (340)..(340): n is a, c, t, g, unknown, or other
  misc_feature (342)..(342): n is a, c, t, g, unknown, or other
  misc_feature (343)..(343): n is a, c, t, g, unknown, or other
  misc_feature (359)..(359): n is a, c, t, g, unknown, or other
  misc_feature (361)..(361): n is a, c, t, g, unknown, or other
  misc_feature (362)..(362): n is a, c, t, g, unknown, or other
  misc_feature (368)..(368): n is a, c, t, g, unknown, or other
  misc_feature (370)..(370): n is a, c, t, g, unknown, or other
  misc_feature (373)..(373): n is a, c, t, g, unknown, or other
  misc_feature (374)..(374): n is a, c, t, g, unknown, or other
  misc_feature (402)..(402): n is a, c, t, g, unknown, or other
tggagctccccgcggtggcggccgctctagaactagtggatcccccgggctgcaggaattcgtctcacccctagaaaaacttgctcgctgcgccgccgcctccgacatcgtcccttcgtccccacgagcaaccgataatccgccggcgttgagatgttggtttatcaggatctcctatctggcgacgagctcctgtcggattcanttcacccnnntttaaccaaagggaagcttcgnnnagaacgngncgnntccntggtgngngnagggntccgaagngngnananagnntggngntncnaacncncannagggtncncntggtnntgannntgtgngnanncattgggtgggccaantnnccatcncngcnncgaaggggttgggggtggaaggggaaanggaaaaaaaggccggtttgaaattggaccaccaaggccttgggttggaaaaggggtgggggttgggaataatttggttggaaacacctttttcccggttccttacaggggaaagccaaaccccttccccctttttttggaaccaaaaaaaaaaacccacttttttggggggggccctttaacccctcccccaaaaaaaaattccctttcccaagaaattccctcccacctgggg

SEQ ID NO: 60568 - DNA, 642 bp, Zea mays
  misc_feature: Ceres CLONE 1520230
  misc_feature: Encodes the peptide sequence at SEQ ID NO. 60569
  misc_feature (577)..(577): n is a, c, t, g, unknown, or other
  misc_feature (629)..(629): n is a, c, t, g, unknown, or other
  misc_feature (630)..(630): n is a, c, t, g, unknown, or other
tggcggccgctctagaactagtggatcccccgggctgcaggaattcgtctcacccctagaaaaatatgacatgagaggctacaaaatcagcgttacgatggctgaaaaatcagcacccagagcagcaccttcttatggtcatggcggtggccgcggtggtggatatggtggaggtggacgcagggataattacagagatggtgggggccatggacccaatagaaaccagggtggtggttcgcgttcccgaccatactgaaagcaactaatattcttactgtgattgttgcctgtgagaaaccatttctattcctgttctacggatttgtactcattcaggcgcataagatggggatataagctccaaatgctggtaggtttgtgatactatttcagccggtggatcactcctgtaagctttggattttgctgcaaagaacaggtagcgtggtttatcatgtgataggtttattagatttcgtctatattagatgacatatcaaacaacattcatagaatgttccacacccatttttgtttgatgcacagagggtttgtagcatgtactttagcttangttgccacaaacatttggcttcatatagatgggtgatttgtgcctctgggtnnatagcttgtttt

SEQ ID NO: 60569 - protein, 85 aa, Zea mays
  misc_feature: Ceres CLONE 1520230
GGRSRTSGSPGLQEFVSPLEKYDMRGYKISVTMAEKSAPRAAPSYGHGGGRGGGYGGGGRRDNYRDGGGHGPNRNQGGGSRSRPY

SEQ ID NO: 60570 - DNA, 645 bp, Zea mays
  misc_feature: Ceres CLONE 1520238
  misc_feature: Encodes the peptide sequence at SEQ ID NO. 60571
aaagctggagctccccgcggtggcggccgctctagaactagtggatcccccgggctgcaggaattcgtctcacccctagaaaaacccagaaaataaaaaataggctcaatatcctcgccagtggatcccctccttgcgaggccggatctgagctgccgccggcgctatggcgagcggcggcctggcggctgcgtccgaagtcgccggctttttcctcatccgccctgtccttgccatcgccttcgtcttcaccctcttcctcctcagctggtacgtggcgtggaagacggtgctgatgcacgtgccgctggggcaggagatcgccggcctgcgcccgataaagccctctaaacccaagccaggataccgcggccgcttcgcctagttctaccagaacctggccgaaggcgcgctgaggaacagcaaatcacacggcgcctcatcttaagacaaagcagtcaccgccttgtaatgagtacctgccgcagactttgttatgcagtgctaattagaatgcaagtactaccagtgacggcgtctttttaggagacaatgtatatcagcatgtgatgggagcatccctgcctgacgatacatcaggcttatgatagtagcgcatcaactgtttattgcatgaccttgcac

SEQ ID NO: 60571 - protein, 72 aa, Zea mays
  misc_feature: Ceres CLONE 1520238
MASGGLAAASEVAGFFLIRPVLAIAFVFTLFLLSWYVAWKTVLMHVPLGQEIAGLRPIKPSKPKPGYRGRFA

SEQ ID NO: 60572 - DNA, 636 bp, Zea mays
  misc_feature: Ceres CLONE 1520244
  misc_feature: Encodes the peptide sequence at SEQ ID NO. 60573
ctggagctccccgcggtggcggccgctctagaactagtggatcccccgggctgcaggaattcgtctcacccctagaaaaaacctgctgacagctatgatttcccctgctcacctcgccttcgccgccgccttcctcctcgtcgtccggtcttcggcgcctggcgctgctgccgcccgcccgatcttcgatggtaagaccatccccctccgaggccaccgccactgcgaggtggctcgccgcccagaacacgtggggtgtcctcagcacagtatcaagtgacttaagtggagctccatttggcaatgtggtttcatatagtgatggagtaccaggccagggccgtggaataccctactttgatctgacaactctggatcccagtgcaagagatgcactggaagatgaaaggacctcttttacccttagcgagttccctctgggaacttgtggggaaatagatcctgaaaaccccacttgtgcacaacttactctgaatggatagttgaagatggctgaccttcagacatctgatacagatttggccaagtcagcagtttttaccaaacatcctgaaatgaatgattggccaaagaatcatcatttactaatcttcagaatggagatcgaaaacttat

SEQ ID NO: 60573 - protein, 104 aa, Zea mays
  misc_feature: Ceres CLONE 1520244
MVRPSPSEATATARWLAAQNTWGVLSTVSSDLSGAPFGNVVSYSDGVPGQGRGIPYFDLTTLDPSARDALEDERTSFTLSEFPLGTCGEIDPENPTCAQLTLNG

SEQ ID NO: 60574 - DNA, 576 bp, Zea mays
  misc_feature: Ceres CLONE 1520245
  misc_feature: Encodes the peptide sequence at SEQ ID NO. 60575
  misc_feature (349)..(349): n is a, c, t, g, unknown, or other
ggagctccccgcggtggcggccgctctagaactagtggatcccccgggctgcaggaattcgtctcacccctagaaaaacctactaaccgcgtctcctctccagcgcccgccgtcgccgccgccctcctcttggtcccgccgtccgtcgaggtcatcatggtgagggtcagtgtgctcaacgatgcgctcaagtccatgtacaatgcagagaagaggggcaagaggcaggtcatggatcaggccgtcgtccaaggtgatcatcaagttcctgacggtcatgcagcgtcatggatacattggcgagttcgagtacgtggatgaccacagagctgggaagattgtggtgaanctgaacggcagactaaacaatgcggtgtaattaccccccggtttgatgtgggggaaaagaaaaccaaagctggactgcaaagctgcctccgtcttccccagtttggctatttcctgcttaacaacctcctgcgggaatttttggatcccgaggagggccccaacccaaaaccccggaaggaaaaacccctgggtttctttttatataataaaagggggcccccccaa

SEQ ID NO: 60575 - protein, 58 aa, Zea mays
  misc_feature: Ceres CLONE 1520245
  misc_feature (49)..(49): Xaa is any aa, unknown, or other
MQRRGARGRSWIRPSSKVIIKFLTVMQRHGYIGEFEYVDDHRAGKIVVXLNGRLNNAV

SEQ ID NO: 60576 - DNA, 645 bp, Zea mays
  misc_feature: Ceres CLONE 1520249
  misc_feature: Encodes the peptide sequence at SEQ ID NO. 60577
tggcggccgctctagaactagtggatcccccgggctgcaggaattcgtctcacccctagaaaaaagcagcagcacagtcatccacactaacgaacgaactgaggtcgacgacgactgatcgagcagcgacgatggcggctgtgctgaacagcaggaagacgccgcaggtggttgccgtgctggtggcggcggcgctgctggcgtcgtccgcttcggcggcgatcacctgcgggcaggtggggtcgtcgctggctccgtgcatcccgtacgcgacggggagggccagcgcgctccccgcgtcgtgctgcagcggcgtcaagagcctcaacagcgcggcgcggaccagcgcggaccgccaggcggcgtgccgctgcctcaagagcctcgccaacagcgtcaagagcgtcaacatgggcaccgtcgccaccatccccggcaagtgcggcgtctccgtcggattccccatcagcatggtcaccgactgcaacaagatcagcttagttatcgacgaccaggctaataagcctaccgaaacgtacacgtacgtcccgcgcgctggccgaggggagaaccccgggaaaaaataaaaaaaagctagctgtattgccccgaaccccatgccatatcgattctattatatacggg

SEQ ID NO: 60577 - protein, 151 aa, Zea mays
  misc_feature: Ceres CLONE 1520249
  misc_feature (33)..(118): Pfam Name: Tryp_alpha_amyl Pfam Description: Protease inhibitor/seed storage/LTP family
MAAVLNSRKTPQVVAVLVAAALLASSASAAITCGQVGSSLAPCIPYATGRASALPASCCSGVKSLNSAARTSADRQAACRCLKSLANSVKSVNMGTVATIPGKCGVSVGFPISMVTDCNKISLVIDDQANKPTETYTYVPRAGRGENPGKK

SEQ ID NO: 60578 - DNA, 655 bp, Zea mays
  misc_feature: Ceres CLONE 1520252
  misc_feature: Encodes the peptide sequence at SEQ ID NO. 60579
  misc_feature (392)..(392): n is a, c, t, g, unknown, or other
tggcggccgctctagaactagtggatcccccgggctgcaggaattcgtctcacccctagaaaaagaccaaaagattcccacgggctcgccgctcgcatctcgccagcgcgaacgcagcctccgtgcatatcaccagcctcctcgcgcacccggtcccgcttgcctttccccacctactcgccgtcgcggtgccgtgcgccggtgctgttcagtctagggtttcggccctcgcccgccgatccgtccccccgccggccatgtcgaagcaaggagggaaggccaagccgctgaaagcgcccaaggtcgacaagaaggagtacgacgagagtgatcttgcttatttgcccaccaccacagatgggggggggggcctgaaagatcttaaagccaangtataaaagggcccaattggaggctccggtctcaagaaaagtgggaaaagaattgagcctgggcccacccgcccagccgtgtcgtaagacccctggggaagaaggctaagggggggcgtaggtgaccggggggggcgggaggcgggcgggggggtggggaaaagaaaggggggcacggtcatgtcctcgcgcacccggggccggacgagaggggtgagcagacccgaagggggtttgcggcgccccggctgggggggaggtgg

SEQ ID NO: 60579 - protein, 46 aa, Zea mays
  misc_feature: Ceres CLONE 1520252
  misc_feature (1)..(46): Pfam Name: TMA7 Pfam Description: Translation machinery associated TMA7
  misc_feature (45)..(45): Xaa is any aa, unknown, or other
MSKQGGKAKPLKAPKVDKKEYDESDLAYLPTTTDGGGGLKDLKAXV

SEQ ID NO: 60580 - DNA, 719 bp, Zea mays
  misc_feature: Ceres CLONE 1520253
  misc_feature: Encodes the peptide sequence at SEQ ID NO. 60581
gctctataactagtggatcccccgggctgcaggaattcgtctcacccctagaaaaaacgcggaagcaagaattcgtcgtcaaattcccagcttgcgcgtgtttctgtggatttcttcccgcttccctgctcctgcctcctatgggcctttgatccggggcttcgtggatcttgggaagaggaggtgtggtgggcgcctccgcggcgatctggcggggaggatatggccagcgggaaggagccgatcgaggtcaggtttcgtctcttcgacggcacggatatcgggcctaccaaatacgatccctccaccacgggctcctctctcaaagagtttttcctcccctccctggcggggggaggggggtatatttccccaaaactggttatggacttggagccttacccctggggggaaggatatttgtagaataaccccggcccccttcccaaaattcccgtggtttcccgtataaagaagaatccctaggtgggtgcagtttctcctctggaagcgtggcttctcggggacacccccttaaggctggcgaataaccttgtgggaaaacaagtctttgtccccgttccccccacggcccagaaagaaaatggagcgcgcccttgtagttccttcgggatggggggacgccttccttggcgttcttttccccctctctgtttgtggcagctttgttaaggattttttgggcgggtgcgctttag

SEQ ID NO: 60581 - protein, 67 aa, Zea mays
  misc_feature: Ceres CLONE 1520253
MASGKEPIEVRFRLFDGTDIGPTKYDPSTTGSSLKEFFLPSLAGGGGYISPKLVMDLEPYPWGEGYL

SEQ ID NO: 60582 - DNA, 633 bp, Zea mays
  misc_feature: Ceres CLONE 1520263
aagctggagctccccgcggtggcggccgctctagaactagtggatcccccgggctgcaggaattcgtctcacccctagaaaaaaccctttcccaatctcggcttgtgttgctcggagcgggcaggcggcccccctcgcttcacggtcctactggatcttcttccccgccccacggacgaggagacgctgatcgcatggggaagagacaggccgctgctataccacctcccatcactcggacggaccaacttgacgctgtcttttcctgacgtttctggatccactggagtactgttgagtgccgtcttgacaggcaaaatctgattggtgaaacctcttgcagagatgctgcctggagaactgcacccgtctgctaatgcactcactgagcctactggcctatatcgtgtacggactcgcgactgagtacgggtcgacactgttcaagggtacaaggatgcgagaccttgccccaggtgaggtgactgttacctgcactcgtaatggcctggggtggatttctcgattgcctctgaccttagtctgccttgggttggaatatcatattggctgactgatatgcctgtaggcaccgtgacctagtctgtcggcactacgatgagcttgtgccat

SEQ ID NO: 60583 - DNA, 683 bp, Zea mays
  misc_feature: Ceres CLONE 1520266
  misc_feature: Encodes the peptide sequence at SEQ ID NO. 60584
  misc_feature (407)..(407): n is a, c, t, g, unknown, or other
  misc_feature (422)..(422): n is a, c, t, g, unknown, or other
  misc_feature (452)..(452): n is a, c, t, g, unknown, or other
  misc_feature (469)..(469): n is a, c, t, g, unknown, or other
  misc_feature (470)..(470): n is a, c, t, g, unknown, or other
  misc_feature (472)..(472): n is a, c, t, g, unknown, or other
  misc_feature (495)..(495): n is a, c, t, g, unknown, or other
  misc_feature (521)..(521): n is a, c, t, g, unknown, or other
  misc_feature (550)..(550): n is a, c, t, g, unknown, or other
  misc_feature (576)..(576): n is a, c, t, g, unknown, or other
  misc_feature (608)..(608): n is a, c, t, g, unknown, or other
  misc_feature (632)..(632): n is a, c, t, g, unknown, or other
  misc_feature (639)..(639): n is a, c, t, g, unknown, or other
  misc_feature (653)..(653): n is a, c, t, g, unknown, or other
aaagctggagctccccgcggtggcggccgctctagaactagtggatcccccgggctgcaggaattcgtctcacccctagaaaaagaatttccattcgaccccatccacttctcagttctcacctcaatctcgcgagaagcgaagccggaggaggagggtgcgaggagatcgcgagcagccggagccggagccggaggcctagaagatgaagacgttcgacccgtggccggtattcttccgccgggagtggaagcgcaattggcccttcctcacggggttcgccatcaccggcttcgtcatcactaagatgacggccaacttcaccgatgaggacctcaagaactccaagttcgttccggtatacagccaccccctgaacggggagggggttgtccgatttgcctggnccggacagccaggtntttctaagaagtttgaatgaaaaaataacnttcttttttcttcttgnnantgccgggcagcctatgcctcccntttgtattggtaatacgaggcctccnactttgatccaataaattcccaactttcngattaataagcgaacccccccaaggntggaccctggtttcccaaaaaaaatacaacanaaccccagaaacctcccacagggnccccaanttcccccccggttntcgggtccccccctcccgcggcccttcctg

SEQ ID NO: 60584 - protein, 78 aa, Zea mays
  misc_feature: Ceres CLONE 1520266
  misc_feature (68)..(68): Xaa is any aa, unknown, or other
  misc_feature (73)..(73): Xaa is any aa, unknown, or other
MKTFDPWPVFFRREWKRNWPFLTGFAITGFVITKMTANFTDEDLKNSKFVPVYSHPLNGEGVVRFAWXGQPGXSKKFE

SEQ ID NO: 60585 - DNA, 610 bp, Zea mays
  misc_feature: Ceres CLONE 1520275
ggagctccccgcggtggcggccgctctagaactagtggatcccccgggctgcaggaattcgtctcacccctagaaaaaatccaccatcacacactcaatccacacaaacacttcctcctcacacgggcgctgcgcactgactcaccaagcgtccgcccccatgggtttctaccaggaggtggactactgctcgaatgacgtgacgtcggtggccccggccggcttccgccgccacgagcggcagcatccagcaacacgtcatcaaggagaacttcgaggaggtcgacacgatctcccgcgccggcgccaaccacctccaaccaccatggtcaccacggcggccacagcttcttgctgcccgagaccatggtcgaaaatgacatctccacgcgcgccggcgagttcccctagcgcgtggagagcctcctcgccacggccttgtgacccccccgtgcacgcggcatgcccgccccttcgtgcttgactgcgtgccttatgtactgtctgtggttgactgggtgtgcagggtcatcgtacttggctatcgtacgtgcacgcactcagctcctgtacgaattacgacaataagctcgtgacctgaatagtactt

SEQ ID NO: 60586 - DNA, 642 bp, Zea mays
  misc_feature: Ceres CLONE 1520276
  misc_feature: Encodes the peptide sequence at SEQ ID NO. 60587
  misc_feature (622)..(622): n is a, c, t, g, unknown, or other
aagctggagctcaccgcggtggcggccgctctagaactagtggatcccccgggctgcaggaattcgtctcacccctagaaaaaatccagttccacccccgccggccacactcgtctctctcacgagccacagcccacaggctagctctctagcggtctagccagtccacgcagcgcagggatggcgtcgttcgccgtggcaacggccccgtcgctagcggccccggcagccaagaggaggcccgccgccggcgtcacgtacgtggagggcatgaacgcctacagcggcctcaaggggctcgacaaggtgaccatgctcggggtgcgcaagaccgccaactactccttcgccaaggtcgtggcgtccctcacccccgcgggcaggaagcggcgcggcggttctttcggcgcccagatgaacgccgccgccgagatcttcaagatccccgccaccatgagcggcctcgtgctcgccggcgtccccgcccgcttcgtgctgctcccggtggaggccgccgcccagtaggcctaattagcgcccccccccctgcttataaaccatgaattattttcaaccgggtgcaccgctttcaatcccccccttggcgatggccggggaccanccatttaccaattgatttag

SEQ ID NO: 60587 - protein, 114 aa, Zea mays
  misc_feature: Ceres CLONE 1520276
  misc_feature (79)..(114): Pfam Name: PetM Pfam Description: PetM family of cytochrome b6f complex subunit 7
MASFAVATAPSLAAPAAKRRPAAGVTYVEGMNAYSGLKGLDKVTMLGVRKTANYSFAKVVASLTPAGRKRRGGSFGAQMNAAAEIFKIPATMSGLVLAGVPARFVLLPVEAAAQ

SEQ ID NO: 60588 - DNA, 643 bp, Zea mays
  misc_feature: Ceres CLONE 1520279
aaagctggagctccccgcggtggcggccgctctagaactagtggatcccccgggctgcaggaattcgtctcacccctagaaaaagcgccactctccctggcagccgccgtttgttgtcgcgagcgcgttcctgccccgccacagccgaagctcccagcgtcctcctgcaggccgagctgaaggttcagcgcgccggtggagttcgacgacgaaactccgtcacgtcatacctctccgcctcccgtcttccagacgtctccaatcagggctcccagcgtctcggagaagaggagcagcacggcacggcggctgtggcgaggaaggctcctgtcccatcccaacccagttagcagccgcccaaggaggaggagattcaatcggcgtgcgggcgtccgcggtccatccatcgatccaattccaatctgccggtgagcagctcgttgagattcccaatcaacagctcgaatcgcctgctctcccatcctattgaatgaaactatggtatagtggtttgcctagttattatctcgaattaatttgtaaagatctccactttggttcgatttgattgtttcttcaactagtggcatattgttctgcttcttatgtgattccattaggtctctgcgtcacggcttgttcg

SEQ ID NO: 60589 - DNA, 660 bp, Zea mays
  misc_feature: Ceres CLONE 1520281
  misc_feature (201)..(201): n is a, c, t, g, unknown, or other
  misc_feature (202)..(202): n is a, c, t, g, unknown, or other
  misc_feature (203)..(203): n is a, c, t, g, unknown, or other
  misc_feature (204)..(204): n is a, c, t, g, unknown, or other
  misc_feature (205)..(205): n is a, c, t, g, unknown, or other
  misc_feature (206)..(206): n is a, c, t, g, unknown, or other
  misc_feature (207)..(207): n is a, c, t, g, unknown, or other
  misc_feature (208)..(208): n is a, c, t, g, unknown, or other
  misc_feature (209)..(209): n is a, c, t, g, unknown, or other
  misc_feature (210)..(210): n is a, c, t, g, unknown, or other
  misc_feature (216)..(216): n is a, c, t, g, unknown, or other
  misc_feature (217)..(217): n is a, c, t, g, unknown, or other
  misc_feature (218)..(218): n is a, c, t, g, unknown, or other
  misc_feature (219)..(219): n is a, c, t, g, unknown, or other
  misc_feature (220)..(220): n is a, c, t, g, unknown, or other
  misc_feature (258)..(258): n is a, c, t, g, unknown, or other
  misc_feature (259)..(259): n is a, c, t, g, unknown, or other
  misc_feature (357)..(357): n is a, c, t, g, unknown, or other
  misc_feature (362)..(362): n is a, c, t, g, unknown, or other
  misc_feature (376)..(376): n is a, c, t, g, unknown, or other
  misc_feature (381)..(381): n is a, c, t, g, unknown, or other
  misc_feature (384)..(384): n is a, c, t, g, unknown, or other
  misc_feature (385)..(385): n is a, c, t, g, unknown, or other
  misc_feature (603)..(603): n is a, c, t, g, unknown, or other
gctctagaactagtggatcccccgggctgcaggaattcgtctcacccctagaaaaatgaatcaggaggtaagaaagttgagttagatgatctacctggcgagggacctgttctaaggtgggaatcacggattgtatttgttcctagtggagatgcatatcatcccaaaaacagaaaagtcaagctcagtgtgactgtggannnnnnnnnnaaaaannnnntttttttttttgggggagggggagggggggggggaaannaaactcggctttttgttttctccccccaacccggaaaacacatttggggcttttttttttcccccccgggtttcccggagggggtttttggaggcccnatttnttttttttgagtantcaanaanntgggggggctgcgggggggtttggggggcggaaaaaacggaggggaggggggggcgaataaaaaaaatagttacgccccgggggagggggggaaaaaaaaaaagaaaattttgaagaaggggtctctttctctcgacctctgttaaaataaataaaattatcccaggaggggggggggggggaaaaaaaaaaaaaaggggcgttgttttttttgaaanaaaaacacaacacgcggatgggaaattaaaaaagggaggagaggataacaccccaac

SEQ ID NO: 60590 - DNA, 691 bp, Zea mays
  misc_feature: Ceres CLONE 1520283
  misc_feature: Encodes the peptide sequence at SEQ ID NO. 60591
ggagctccccgcggtggcggccgctctagaactagtggatcccccgggctgcaggaattcgtctcacccctagaaaaaggcaaaagctccccaacgaagtgcgagcgacccacgtccacacgacacgaaccaccaccaccaaccagcagccgcaccacgcacccagcgcaaagcgatggcgtcgctcaccatgatggcgtccttcgccgccgtggcggtggccgcgccctcgcgccgcggcaccttcgccgtggtcaggtccgccaaggtcgaccgctgccaggagcccgccacgctagcagcaaccgaggccaggcccgccgccgacggacgccgcgccgtcatgctcgcggctgctgcggcggccgtggcagccatcggcggcgccagcgccgccatggcgggccccaagaacgggacccccgaggcgaagaagaagtacgcggccatctgcgtcaccttgcccaccgccaaggtctgccacaactgaacacgcccgcgttgcagctgcagggcccgggggggggtataaaatttaaggtacgtgccacggtggttgttgtccccaattgggtggtttcaaggctttaaaaggcatgccctgaacgtggagggccccctaaattgcttttctgaaaggggccccggaggcttgtaaaaaatatccaggtggccactgtcaaaaactggg

SEQ ID NO: 60591 - protein, 104 aa, Zea mays
  misc_feature: Ceres CLONE 1520283
MASLTMMASFAAVAVAAPSRRGTFAVVRSAKVDRCQEPATLAATEARPAADGRRAVMLAAAAAAVAAIGGASAAMAGPKNGTPEAKKKYAAICVTLPTAKVCHN

SEQ ID NO: 60592 - DNA, 648 bp, Zea mays
  misc_feature: Ceres CLONE 1520286
  misc_feature: Encodes the peptide sequence at SEQ ID NO. 60593
  misc_feature (616)..(616): n is a, c, t, g, unknown, or other
ggagctccccgcggtggcggccgctctagatctcctggatcccccgggctgcaggaatttgtctcacccctagaaaaacccgtttttcttcctgtggtcgctcgttgagtgcggaaattccacgaacgtgagctcaacatggagccggcgacccctccggcacccgccgccggcgtcacggctaccgtcgacctctccccagtcgcagccgacctcggtggggcgcacctcctgccctgcggcatcaggcagaacggcggcgcccccgtatccgactacttcaagcctagggccacaggtgtggaggtggagggggtgaaagtggaagaggccttttttcgtgggaggaaactgcatggcactaccctagctctcgcggatgggtaccgaggttatgtattggagaagagtcacggacagaattcagatgctgaagtcagcaattttacatcccgagctgaattccccaacataacctactggaatcccgatacagcgccctccccaaaagattccctcccgaggggctccattggctaaccgcccctatgggatgcattaaacatgactggctaaaacctggttaaagggcggcatggagaaacaaggcaagganattctttcttaacgtacccgggaattctagtg

SEQ ID NO: 60593 - protein, 133 aa, Zea mays
  misc_feature: Ceres CLONE 1520286
  misc_feature (28)..(132): Pfam Name: RNase_H1_sml Pfam Description: Ribonuclease H1 small subunit
MEPATPPAPAAGVTATVDLSPVAADLGGAHLLPCGIRQNGGAPVSDYFKPRATGVEVEGVKVEEAFFRGRKLHGTTLALADGYRGYVLEKSHGQNSDAEVSNFTSRAEFPNITYWNPDTAPSPKDSLPRGSIG

SEQ ID NO: 60594 - DNA, 689 bp, Zea mays
  misc_feature: Ceres CLONE 1520287
  misc_feature: Encodes the peptide sequence at SEQ ID NO. 60595
ggagctccccgcggtggcggccgctctagaactagtggatcccccgggctgcaggaattcgtctcacccctagaaaaatattccttcgcttccgtcaggtcgggtccgcagcctccccctctcgcagatccccacctgctccgccgccggccaccgcgttgctcccctcggcagccaggatgacagaagtaccatttctgccacgtgagaggctcttcaagcagcaacattacttccagaacttgaccaagcacacctacctgaaagggcgctacgacgtgatcacctccgtcgccatcccccttgcactcgctgcctcccgcatgttcatgattgggcgtggaagttacaactttttcccgcccccgggaagggggggggagcttccatgggtaactattggttctgcttggaatggaagacaatacggccaagacggcgaagtcctctttcgcttgtaaaataatacgggcccaaataacaaatttgactaaatttttcgcgtcaatttgctgggtggacattggggggtgtggaaacggaccattaatttttaaaaatcgccgccggctccctgttttggggaagggagataccaaatccctttcgaattttttggggacgcctgtttaagaaagaagaagaggagggaggatggaaaatctcacaccaacctcttttgttttgcg

SEQ ID NO: 60595 - protein, 93 aa, Zea mays
  misc_feature: Ceres CLONE 1520287
  misc_feature (9)..(64): Pfam Name: COX7a Pfam Description: Cytochrome c oxidase subunit VIIa
MTEVPFLPRERLFKQQHYFQNLTKHTYLKGRYDVITSVAIPLALAASRMFMIGRGSYNFFPPPGRGGELPWVTIGSAWNGRQYGQDGEVLFRL

SEQ ID NO: 60596 - DNA, 650 bp, Zea mays
  misc_feature: Ceres CLONE 1520288
  misc_feature: Encodes the peptide sequence at SEQ ID NO. 60597
ctggagctccccgcggtggcggccgctctagaactagtggatcccccgggctgcaggaattcgtctcacccctagaaaaagtgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcgcaacgccatcgagggcatgaacggcaaggagctggacggccgcaacatcaccgtcaacgaggcccagtcccgcggcggccgtggaggcggcggcggtgggtacggtggtggccgtggaagctgcggctacggcggtggcgggcgccttgatggcggcggcggctaccgcggtggcggcggcggctacggtggcggccgcggctacgggggtggggccggcgggctacggcgggggcaaaccggggcggcgggttccggcaacctccgacgggaacctggagga

SEQ ID NO: 60597 - protein, 157 aa, Zea mays
  misc_feature: Ceres CLONE 1520288
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAASDVEYRCFVGGLAWATDDHSLHNAFSTYGEVLESKIILDRETQRSRGFGFVTFSTEEAMRNAIEGMNGKELDGRNITVNEAQSRGGRGGGGGGYGGGRGSCGYGGGGRLDGGGGYRGGGGGYGGGRGYGGGAGGLRRGQTGAAGSGNLRREPGG

SEQ ID NO: 60598 - DNA, 639 bp, Zea mays
  misc_feature: Ceres CLONE 1520292
aaagctggagctccccgcggtggcggccgctctagaactagtggatcccccgggctgcaggaattcgtctcacccctagaaaaaactccacgctccccctctcatagtctcctatccacactcacgctctcctgctctgcgagctgccggacacccaccgacaagtccacgtcggcggcttccacacctacagcaaggccatctgcgtccactccctcgtcttcttcgccgccttcaccatcctcacgctcgcgctccacatccacatctacaccggctaaacttcctagctagtagcgcatcacatgccgcctgtctggactcacgaaggcctcaaatctgaaacgaacgcccgccgggggcgcgtcctgtgttgctgctcttgttcctctgcagttcgataaattcgactaatcgctcgtaactacctaagcttcctccttgctatgctagttactctctatctatcatgtaaaggccgccatgatcatccatctgtgactgggcttgcatgcaacaggaactagtgagatgcctttaattacccgatctgtcaggtggtctgcgaggaattaggtttccaagacgctcgaggtacccaattcgccctatatcgagtcatattacgcgcgatcagtg

SEQ ID NO: 60599 - DNA, 714 bp, Zea mays
  misc_feature: Ceres CLONE 1520295
  misc_feature: Encodes the peptide sequence at SEQ ID NO. 60600
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (42)..(42): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
nnnnnnnnnnnnnnnnnnnnnnnnnnnnnggggggggggggntttnnnnnnncatagctggagctccccgcggtggcggccgctctagaactagtggatcccccgggctgcaggaattcgtctcacccctagaaaaaaaaactccgccgtcgcctgtccactttccccgtgcttctccgccgtcgaggccgcgtcccagtgcgaagagaccacgactcagatgaccagccgctgggtccggcccgaggtgtacccgctgttcgcggcaacgggcgtggccgtcggcatctgcggatttcagctcttccggaacatcaccggcaacccggaagtcagggtaaacaaggcagggagggcagctggtgtgcttgagaaccatgaggaggggaggcgttacgccatgcatggcctaagaagctttgtgcacgacaagactcctgagatcatgcctgcagttaacaagttcttcactgaccctaagtgaagcatgttgattggcatactactactactacttgctactggggattttacactttgctggcaactcaatatggtggggacatccctgacctctaaaagtacttttgagtgcttggtgatgacttgctatatgtttgatggtggatgaatttgatccgccatgcttgaatgttctattacatctgtcatctgggatttgcccccccttccgtgaataaaaattgtcatttt

SEQ ID NO: 60600 - protein, 87 aa, Zea mays
  misc_feature: Ceres CLONE 1520295
  misc_feature (2)..(88): Pfam Name: B12D Pfam Description: B12D protein
MTSRWVRPEVYPLFAATGVAVGICGFQLFRNITGNPEVRVNKAGRAAGVLENHEEGRRYAMHGLRSFVHDKTPEIMPAVNKFFTDPK

SEQ ID NO: 60601 - DNA, 561 bp, Zea mays
  misc_feature: Ceres CLONE 1520296
  misc_feature: Encodes the peptide sequence at SEQ ID NO. 60602
aaccgtccccgtctcaccgcactgcttaccccctcctctcgtctgcctcgcttagcttagccgccgctgctacgcactctcgccgtccttgttcccgcgtcgctctgctcgcgatggcgtcccgcgttgcagtgctgttcgtggccgtggcggccgtgctgttcgccgcggcgtcggcgcaggagatggacctgggcgtgccgcccgcgccggcgcccgtcacgggcgcggcagcggggaccgcggcatcggccctggccgtggcttgctctgccgtcttctccatcctcgtcgccggtcgcctcgtgcagtaggcgctgccgtcgacgtggttcggggtccggcggagccctgttcgatcgttttcgccttagctagtagtagaagtagcagtcatgggctgtgttgattgtttccctgtctcccacctggtgggcgttgtgaccttgtgctattgcttattctttttgtaccatactgcattgttccacgtataccttgtgttgaggcgtgtgttgtatgaataaagatgatggatctcgttcgtcaaaaaaaaaaaaa

SEQ ID NO: 60602 - protein, 66 aa, Zea mays
  misc_feature: Ceres CLONE 1520296
MASRVAVLFVAVAAVLFAAASAQEMDLGVPPAPAPVTGAAAGTAASALAVACSAVFSILVAGRLVQ

SEQ ID NO: 60603 - DNA, 712 bp, Zea mays
  misc_feature: Ceres CLONE 1520297
  misc_feature: Encodes the peptide sequence at SEQ ID NO. 60604
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
nnnnnnnnnnnnnnnnnnnnnccgggggnnnnnnnnnnnttttttnnnnccataactggagctccccgcggtggcggccgctctagaactagtggatcccccgggctgcaggaattcgtctcacccctagaaaaaagcctccgcctctccttccagtgtccgccgtcgtgcgctcgctacccctctccctcgaggcctttgccggcgaagagcgcccagtcgcccaccaggatgaagtttgttgctgcctacctgcttgctgtcctcgctgggaactccagcccctctgccgaggacttgacagccattctggagtcagttggctgtgaagttgacaatgaaaagatggaactccttctgtcccaactgagcggtaaggacattaccgagctcattgctgctggcagggagaagtttgcttcagtcccatgtggcggtggcggtgtggctgttgtggcagctgcccctgctgctggcggcgctcctgcagctgaggcgaagaaagaagagaaggtggaggagaaggaagaaagtgatgacgacatgggcttcagcctcttcgactaagcctgtgcaatattcaagagtattgtttttgagtcgcggaagcagagggaagaaaaatcgaagtcatgtttgggactttaactttgttttatggttggaaaggacttgaaaagactttttcctgtgggaaattccaaggcgtaag

SEQ ID NO: 60604 - protein, 111 aa, Zea mays
  misc_feature: Ceres CLONE 1520297
  misc_feature (17)..(110): Pfam Name: Ribosomal_60s Pfam Description: 60s Acidic ribosomal protein
MKFVAAYLLAVLAGNSSPSAEDLTAILESVGCEVDNEKMELLLSQLSGKDITELIAAGREKFASVPCGGGGVAVVAAAPAAGGAPAAEAKKEEKVEEKEESDDDMGFSLFD

SEQ ID NO: 60605 - DNA, 489 bp, Zea mays
  misc_feature: Ceres CLONE 1520299
  misc_feature (143)..(143): n is a, c, t, g, unknown, or other
  misc_feature (147)..(147): n is a, c, t, g, unknown, or other
  misc_feature (282)..(282): n is a, c, t, g, unknown, or other
  misc_feature (489)..(489): n is a, c, t, g, unknown, or other
ggagctcaccgcggtggcggccgctctagaactagtggatcccccgggctgcaggaattcgtctcacccctagaaaaaacatcgattcgcctcctccgctctttactcttcgtcgtactcgtctcctccacccgcaaccgcangggnaaagaaaggggagcccgccgcgcccccggccccagaaaacagaagatcggggacttcgggttctgcgcaaatccttccccggggggggaagaaaaaaagggccgtccccttggcaaaagttgggagaaagggganattcccccccccttttcccggggggttttttcccccggaaaaaaggggaggtttttccggggggcaaattttcccacaaaaaaaacccccccaatattgggaaaaaaaaaaagggggggggaaatgggtaaaaaaaaaaaaaaaaaaaccccccccttagggggggggggggggggggatggaaaaaggggggggaaaacctctttn

SEQ ID NO: 60606 - DNA, 647 bp, Zea mays
  misc_feature: Ceres CLONE 1520311
  misc_feature: Encodes the peptide sequence at SEQ ID NO. 60607
acccgcggtggcggccgctctagaactagtggatcccccgggctgcaggaattcgtctcacccctagaaaaaagaaaaatactgcggcttcaggactcgacctcttgcgccgccgccatgaccttcaagcgccgcaacggcggccgcaacaagcatggccgcggtcacgtcaagtacatccggtgctcaaactgcgccaagtgctgccccaaggacaaggcgatcaagaggtttcaggtgaggaacatcgtggaacaggcggccatcagggacgtccaggaagcatgcgtctatgatggctacgtcctcccgaagctgtacgccaaggtgcaccactgcgtctcgtgcgcgatccacgctcacatcgtccgcgtccgatcccgtgagaagcgcagggaccgcaagccgccggagcgcttcaggcgcagggaggataggcctgctggtggacaaggaggcccccgccctggtcctggtgctgctgctacagctccatctccagcaccggttgctgctcgcccataggctttagcttttcgaccgtgttaagtcttctgcccactcagtttcggagttgtccccctgtgcgtgtgtgaagctgctatattagagttactttttgtctaaagtctgaacatttttcgaaa

SEQ ID NO: 60607 - protein, 135 aa, Zea mays
  misc_feature: Ceres CLONE 1520311
  misc_feature (1)..(117): Pfam Name: Ribosomal_S26e Pfam Description: Ribosomal protein S26e
MTFKRRNGGRNKHGRGHVKYIRCSNCAKCCPKDKAIKRFQVRNIVEQAAIRDVQEACVYDGYVLPKLYAKVHHCVSCAIHAHIVRVRSREKRRDRKPPERFRRREDRPAGGQGGPRPGPGAAATAPSPAPVAARP

SEQ ID NO: 60608 - DNA, 688 bp, Zea mays
  misc_feature: Ceres CLONE 1520312
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (44)..(44): n is a, c, t, g, unknown, or other
  misc_feature (45)..(45): n is a, c, t, g, unknown, or other
  misc_feature (688)..(688): n is a, c, t, g, unknown, or other
nnnnnttttnnnnnnnttttnnnnnnnnnnnntttnnnnnnccnncccttttgtagggtgaaagaaagctggagctccacgcggtggcggccgctctagaactagtggatcccccgggctgcaggaattcgtctcacccctagaaaaaaacaacagcgaacacatctcctcgcatttcttcccatcagatccccccttcgcaaccaaaaccccaactcgccccgcatcgatggcgcccaaggccgagtagaaacccgcggcgaagaagccggcggaggaggagcccgcggtccgagaaagcgccccgccggggaagaaagccggaaagccggaaaaaagcggggttccccccgcttgggccaagtcccgcctgcccaggcaaagggcgggcaaggggcaaaaaaggggccaaaaaaagaaaggggcaaaaaaaaaaaccggggaaaaaccctaacaggaaaccttacaatttttttaaaaggggcgctaaaaaaccagggggggacccccgggaaaaattgtggggaattcttccctccccaaggggccctggggcccaaaccaagagaaaaccccccctctcaaaaaaaaaaaaaaattttttccaaaaaaaaaactctccccctccgggggggggggcccccccaaaaggctcgggggggggctttataaaaaaaaaagagacccn

SEQ ID NO: 60609 - DNA, 673 bp, Zea mays
  misc_feature: Ceres CLONE 1520313
  misc_feature: Encodes the peptide sequence at SEQ ID NO. 60610
  misc_feature (337)..(337): n is a, c, t, g, unknown, or other
  misc_feature (503)..(503): n is a, c, t, g, unknown, or other
  misc_feature (524)..(524): n is a, c, t, g, unknown, or other
  misc_feature (552)..(552): n is a, c, t, g, unknown, or other
  misc_feature (673)..(673): n is a, c, t, g, unknown, or other
aaagctggagctccccgcggtggcggccgctctagaactagtggatcccccgggctgcaggaattcgtctcacccctagaaaaatccactcctctcttacccttcctctcccaacccacgcagcctcactagggtttagcggcggcggcgagatggtgcagcgcctcacgtaccggaagcgtcacagctacgctacgaagtccaaccagacccgagtcgtcaagaccccaggcgggaagcttgtgtaccagtacaccaagaagagggcgagcgggcccaagtgccccgtcaccgggaagaaaatccaggggatccctccccttgaagcctgctgganacaaaaagggcccaggttgcctatgagccccacgccctgtgaaccggccgtttggggggagaaattctctggaaatggcccctagggagaaaaacattccgggcgcttcctgggccgaggaacaaaaaaaatggcccagaagaggcccggaaataacaaaaaaacnaaggaacaagacagcccgccnagtaaaatccgccccggaatgggggaancctttcccctgttttttaaaaccggggaaaaaaaaaatttttggggggaagggaaaaacctacggggccttgtgtagagaatttttcccggggcgtggaattttaaaagaaagccgggacn

SEQ ID NO: 60610 - protein, 89 aa, Zea mays
  misc_feature: Ceres CLONE 1520313
  misc_feature (5)..(79): Pfam Name: Ribosomal_L34e Pfam Description: Ribosomal protein L34e
  misc_feature (62)..(62): Xaa is any aa, unknown, or other
MVQRLTYRKRHSYATKSNQTRVVKTPGGKLVYQYTKKRASGPKCPVTGKKIQGIPPLEACWXQKGPRLPMSPTPCEPAVWGEKFSGNGP

SEQ ID NO: 60611 - DNA, 647 bp, Zea mays
  misc_feature: Ceres CLONE 1520319
  misc_feature: Encodes the peptide sequence at SEQ ID NO. 60612
  misc_feature (460)..(460): n is a, c, t, g, unknown, or other
ctccccgcggtggcggccgctctagaactagtggatcccccgggctgcaggaattcgtctcacccctagaaaaaactggttggttggttggttggttggttggtttcagtgggagttccaagtcgggccttccgtgggtatttcttcaggcgaccaggtctgggtcgctcgctacattcttgagaggatcacggagatcgccggtgtggtggtgacgttcgacccgaagccgatcccgggcgactggaacggcgccggcgcgcacaccaactacagcacggagtcgatgaggaaggagggcgggtacgaggtgatcaaggcggccatcgagaagctgaagctgcggcacagggagcacatcgcggcctacggcgagggcaacgagcgccggctcaccggcaggcacgagaccgccgacatcaacacgttcagctggggcgtggccaaccgcggcgcgtcngtgcgcgtgggccgggagacggagcagaacggcaagggctacttcgaggaccgccgcccggcgtccaacatggacccctacgtggtcacctccatgatcgccgagaccaccatcatctggaagccctgagcgccgcggccgttgcgttgcagggtccccgaagcgattgcaaaacccctgttccttt

SEQ ID NO: 60612 - protein, 100 aa, Zea mays
  misc_feature: Ceres CLONE 1520319
  misc_feature: SWISSPROT Homolog: EC 6.3.1.2 Glutamate--ammonia ligase
MRKEGGYEVIKAAIEKLKLRHREHIAAYGEGNERRLTGRHETADINTFSWGVANRGASVRVGRETEQNGKGYFEDRRPASNMDPYVVTSMIAETTIIWKP

SEQ ID NO: 60613 - DNA, 656 bp, Zea mays
  misc_feature: Ceres CLONE 1520322
  misc_feature: Encodes the peptide sequence at SEQ ID NO. 60614
aagctggagctccccgcggtggcggccgctctagaactagtggatcccccgggctgcaggaattcgtctcacccctagaaaaaagccaggtcgaagcggcacccacccgcaatgagcaaagcaggcggcggccccggctcggccccgggcccgacggccgcggccgcggcggccgcggtgcagaagcagaagtcgctgctgcagaaggcggacgccgacgtctccagcctcgtcgacaatttctcctccctcatcaacatcgcccgagtcaacgatccgccagtgcgcaactcgcaggacgccttccagatggagatgcgcgccgcccgcatggtacattcagcagactctctgttgaaattagtgtcggaacttaagaggacagccatcttttctgggcttgcttcattgaatgagaatgtggataggaggatcgaagtgctggttcagcaagctgatggaactgagagaatgctggataggattgagcaggatgcagcagcaagcctcattgatctagaggcacactactactcatctgttgtgcggtcaccatcctatgattgaggggtatcccaggttatcgtgtaagcgggttgctcttcagggttatcctgggggtttttaattccccttgaattattgcctaaaggaca

SEQ ID NO: 60614 - protein, 151 aa, Zea mays
  misc_feature: Ceres CLONE 1520322
  misc_feature (17)..(143): Pfam Name: SURF5 Pfam Description: Surfeit locus protein 5
MSKAGGGPGSAPGPTAAAAAAAVQKQKSLLQKADADVSSLVDNFSSLINIARVNDPPVRNSQDAFQMEMRAARMVHSADSLLKLVSELKRTAIFSGLASLNENVDRRIEVLVQQADGTERMLDRIEQDAAASLIDLEAHYYSSVVRSPSYD

SEQ ID NO: 60615 - DNA, 693 bp, Zea mays
  misc_feature: Ceres CLONE 1520326
  misc_feature (387)..(387): n is a, c, t, g, unknown, or other
caaagctggagctccccgcggtggcggccgctctagaactagtggatcccccgggctgcaggaattcgtctcacccctagaaaggtaatccagccgtttcccctttccccagagattcgtatattctcgcgatgggagcggaggaggcatagggtactcccccgccgctgcccggcaccggcgagcctgcaagcacggaaagggcgcagccaatatctgcaacacaattcgtctcgtggaagcagagcaaggatgcaaaggtagccgtaacgaaagctgatactactcagaagcgagctgatgatatcgcttcccgagcggtgcagatgaacggccgcgaactgttccaacaagagccctgagtgcttgacggcggggtttagtganatcgtctcaggctaccccccccgcattagaccaagctccagcggaggttacattttggactgctatatcgcctttgcggaactgtgcattttattttcaccgtatattagagtattctgacactaggcattttgatcttggtcccaataccgtttgcccaatctttgggcaatcaccgaatgaaatccggtgggttctattctttttgcaaaactcttacagcggcgataatgggtcggcagacaattttcgatcttcaggatcaaaaaaaaaaataccgaaactcccgaggttccgaattccccc

SEQ ID NO: 60616 - DNA, 672 bp, Zea mays
  misc_feature: Ceres CLONE 1520327
  misc_feature: Encodes the peptide sequence at SEQ ID NO. 60617
aagctggagctccccgcggtggcggccgctctagaactagtggatcccccgggctgcaggaattcgtctcacccctagaaaaaagcagtgacgaactcgaagcttgcgttcttgtagtagaggtcggcagcaagcggtagagcgagaggtcgagaagatgaagagcagcactctgttggcgatcctagttctccaggcccttctggtctctgcggccgtggccaaaggacctgcagggccgacgacgaagaagcagtgctggtgcggcgagtgcaccagctggtcgggcgtgtggacctgcgacgacctcctcaccaagtgcgccgccacctgcaagaactgcgtccccgtgtccacggacaagggcaccaccaagtacaggtgccgcgacttcctccccgaaaactgcggctgcaagatccactagactcatccacagcggcacagccgatggatccttccatgctcctccgtccgtccgccttgctataagcaggcaggcagccaccaataagctagctcttgctgttgttttgcatgtttgattgggtgtcccttcccagtcgagatggaataaaaataatgtcaggcgtaaaaaaaaaaaaaaaacgagacgctcgaggtacccaattcgccctatagtgagtcgtattacgcgcgctcactgggcgg

SEQ ID NO: 60617 - protein, 89 aa, Zea mays; identical to SEQ ID NO: 50292
  misc_feature: Ceres CLONE 1520327

SEQ ID NO: 60618 - DNA, 697 bp, Zea mays
  misc_feature: Ceres CLONE 1520329
  misc_feature: Encodes the peptide sequence at SEQ ID NO. 60619
  misc_feature (409)..(409): n is a, c, t, g, unknown, or other
aaagctggagctccccgcggtggcggccgctctagaactagtggatcccccgggctgcaggaattcgtctcacccctagaaaaacctccactccctcccccccgcctccactaccccactcccaggagccgcccaggtacgtcgccggcggcgatgacgacgcgcttcaagaagaaccgcaagaagcgcggccacgtgtccgccgggcacggccgcatcggcaagcaccggaagcatcccggaggtcgcggtaacgccggtggcatgcaccaccaccgcatcctcttcgacaagtaccatcccggctacttcggtaaggtcggcatgcgctacttccacaagctccgcaacaagttctactgccccgcggtcaacatcgagcgcctctggtcgatggtgcccgccgaanaggcggcggaagccggcggcgacaaggccccgcagatcgacgtcacgcagttcggcttcttcaaggtgctcgggaagggggtgctgccgcccaagcccatcgtcgtcaaggcctagctcatctcctaggtcgccaaaaaagagatcaaggccgccgggcggcgcccttcgtgctcaccgccctagttttcagtcctttattccgcctcttgggttttgaaaatcttttttttgaaactaggcagtcctttcttggcctcaccctattttggggttaagaaaaactttt

SEQ ID NO: 60619 - protein, 123 aa, Zea mays
  misc_feature: Ceres CLONE 1520329
  misc_feature (86)..(86): Xaa is any aa, unknown, or other
MTTRFKKNRKKRGHVSAGHGRIGKHRKHPGGRGNAGGMHHHRILFDKYHPGYFGKVGMRYFHKLRNKFYCPAVNIERLWSMVPAEXAAEAGGDKAPQIDVTQFGFFKVLGKGVLPPKPIVVKA

SEQ ID NO: 60620 - DNA, 681 bp, Zea mays
  misc_feature: Ceres CLONE 1520330
  misc_feature: Encodes the peptide sequence at SEQ ID NO. 60621
aagctggagctccccgcggtggcggccgctctagaactagtggatcccccgggctgcaggaattcgtctcacccctagaaaaagtttctctcttcttccactgcctcccaaccacttcggcttcgccggctcgcaactccttgatgccggccaccgcgagtatcactactactgctatgtcccctctagctctcctcagagcatcagctgctttgcttatactccattcgcgccgactcccgcccctgcaagaacctgtgcatcaagaccaaagccacacacaatgatcagtctgctaaaaagcatcaaaaggtgaacagcatactttgccacgactgccaacgaaatggggcaatcacatgcactcaatgtcgattgcaaatggggtaaattctgttgactattatgaacgcctatttaaagctggatctttatgctggatgtgcatatgtcagagagaaaaccgatgtagcaactgtaatggtgctggattcttgggaggatttctgagcactttcaatgaaactgcgcaataatcatcggattaatttatgtttaaattacattgagcgaaccattatatatgaatcttgatccatggacgcataatcgtattatataacataatatttttaatgaatactcctttcgatccacaaagacaacaatgcgatacactcg

SEQ ID NO: 60621 - protein, 55 aa, Zea mays
  misc_feature: Ceres CLONE 1520330
MSIANGVNSVDYYERLFKAGSLCWMCICQRENRCSNCNGAGFLGGFLSTFNETAQ

SEQ ID NO: 60622 - DNA, 680 bp, Zea mays
  misc_feature: Ceres CLONE 1520331
  misc_feature: Translation starting site: 154
  misc_feature (509)..(509): n is a, c, t, g, unknown, or other
ggagctccccgcggtggcggccgctctagaactagtggatcccccgggctgcaggaattcgtctcacccctagaaaaaagccccactctctccatctagagctccctaactgcaccggccgccacaccaccgtaccccgacccctcgacaacaatggccaccgtcctaggcagcccccgcgcgccggccttcttcttctcgccgtcctccctccgtgccgcgccggcgcccaccgccgtggcgctgcctgcggccaaggtgggcatcatgggccgtagcgccagcagcaggggcaggctgcgcgcgcaggccacctacaacgtgaagctgatcacgccggagggggaggtggagctgcaggtgcccgacgacgtgtacatcctggaccaggccgaggaggacggcatcgacctgccctactcctgccgcgcggggtcctgctcctcctgcgctggcaaggtcgtctccggctccgtggacagtccgaacagagctacctcgacgacggncagatcgcccgcggctgggtgctcacctgccacgcctaccccccttttgaagtcgtcatcgaaacgcacaaggaggaggagctcaccgggggcatatcattcatgcccattcatcttttatctcgggggggcggccttgggggaattttgataacgcgggaaacccactgg

SEQ ID NO: 60623 - DNA, 550 bp, Zea mays
  misc_feature: Ceres CLONE 1520333
  misc_feature: Encodes the peptide sequence at SEQ ID NO. 60624
aaagctggagctccccgcggtggcggccgctctagaactagtggatcccccgggctgcaggaattcgtctcacccctagaaaaaaccactcccagccagtacccacagtcctacgagcagtcgcgcgctggtgtcaagagacgaaacggtcgacgtggctcgcacgcaatctgacgtagcggtcgccgtggtggccgcggagctgctgctggcagcggcggccacgactctgaggcccctcacctgcgggcaggtgagctccccatgcgcctgcctctcctagacccggcagggaccggcccctccacgtctgctgtgcggctcaggaactcagagcgcctcagccctccgccgaaggcgcgcgcctgcactgcatcagaaccccccggggcgtcaacggcctcacgccagcacgccgacagcatcccctccgagtgcggcgtcggaatcccctacaccattcagaccctcccctcaattggctccaggggtgaacttaaaacctaaaacctggggggcaacgaaaagccctccctaaaaaaaaaggaaa

SEQ ID NO: 60624 - protein, 80 aa, Zea mays
  misc_feature: Ceres CLONE 1520333
MRLPLLDPAGTGPSTSAVRLRNSERLSPPPKARACTASEPPGASTASRQHADSIPSECGVGIPYTIQTLPSIGSRGELKT

SEQ ID NO: 60625 - DNA, 465 bp, Zea mays
  misc_feature: Ceres CLONE 1520334
  misc_feature (209)..(209): n is a, c, t, g, unknown, or other
agctccccgcggtggcggccgctctagaactagtggatcccccgggctgcaggaattcgtctcacccctagaaaaaacggcagctctgaagggaaagagatcgatcgtatctgcggaacaagcagcgaaggaatcggagcctatccaatggccgagggcaacagcagcttccggcggcgaactgttctcccagcgcaagctggtgggcnggggccgcccttgttcggtgtttccagccaaaaaaccttggaaaaaaactcctccaccaaacacagaagagtttcccccgggccggggggccaaaaaatcctttgcaaacccgggggggtctcccccgcttttggggggaaaaaatttttccaaaaaaaaaaaaacccccgccgcgggggggtgattttctcttcttaaaaaaacccccccccggggggggtttttttttttttaaaaaaaaaaattcttcccccc

SEQ ID NO: 60626 - DNA, 697 bp, Zea mays
  misc_feature: Ceres CLONE 1520341
  misc_feature: Pfam Name: Aconitase_C Pfam Description: Aconitase C-terminal domain
  misc_feature: SWISSPROT Homolog: EC 4.2.1.33 3-isopropylmalate dehydratase
aaagctggagctccccgcggtggcggccgctctagaactagtggatcccccgggctgcaggaattcgtctcacccctagaaaaaacgcgccattgttgcggagggctacgcgcgcatcttttttcgcaactccgtggccactggagaggtgtaccctctggagctcacggacgttggggcctggaaggagtgcaagacaggggatgtggtcaccgtggaccttgctaactccgtttttattaaccacacctctggcaaggagtacaagctgaaaccaattggtgatgctggccctgtaattgaggcgggagggatctttgcctacgcccggaagacaggaatgattgcgtcgaaagctgctgcatgagggagagatcagcttaggcagccgagcctctgcggagatccccccccctggtattaggaccaagagttgcctgacctacttgatgtcaaccggggcctcgaaaaaaattcgcggccctccgggacttgtggtggaatccattttttttggggccggccaaccgagtcgttttttttttgtttactgaagcccccgggacccaattggaatcccctgggcccggcacaagggggcctaattgttgcctcggaaataaaagggcctcccggtgcgccccctctcaaggacgggcgactatatctgtggtacccccccccaggggagcgcccc

SEQ ID NO: 60627 - DNA, 679 bp, Zea mays
  misc_feature: Ceres CLONE 1520349
  misc_feature (654)..(654): n is a, c, t, g, unknown, or other
aagctggagctccccgcggtggcggccgctctagaactagtggatcccccgggctgcaggaattcgtctcacccctagaaaaaatcttgctctgaacgcgttcctcccatctcccaagacctcctcagacccgagaagcgcatctgcgagccatggacgccaccggctctggagctggagggaaggcgaatactggagcggacggtcgcaaggccgtgcgggccgacgaagaactctgtgaccaggtccgtgaaggccgggctccaattccccgaccgccgcatcgagcgctacctcatcaatggccgctacgcgcagcgcgatccgcagcggtgcccccgtctacctcgcggccgtcctgtagtacctcgccgctgacgtcctggagctcgccagctactctgccaaggacaacgagaatacgcgcatcgtcccgcgccgcgtgctgctggcgatccgcagcgacgaggacctcgagcagctgctgaccggcgtgaccatcgcccacggctgcgtagttgccagcatcgaccctgtagtgctgccaagaagaccgcggacaaggcttctagcggagggatcaggtatgccacgtctctcaagagagctgccagtcctcctagacgcatactgttagtaggcggatccgatgtngtcatgtttccgttgtaatgcggcc

SEQ ID NO: 60628 - DNA, 681 bp, Zea mays
  misc_feature: Ceres CLONE 1520351
agagctggagctccccgcggtggcggccgctctagaactagtggatcccccgggctgcaggaattcgtctcacccctagaaaaaaaaccccacgcagtgacaggccatcgacccgatggacaccgccacgcatcatgccgcctcgatcaggaggcctcctcctctgcgcccgcgtgtccgaagcagctaccctagccgcgaccgaacttaccgtgctcgcatcgacagtggcccagctccctggccaagttgacgactcctatgtctcctgcatgagagtccgcgtcgctgatgacgacagtgccgatgagggaggtcgccacacgcttccacaggctgcccacggcggctgcccgcggagccgtctggttggacgctgaggcgcccgccgggactggcgatgaccccgcaaggatgacaatcaagctggctaaggagtcttgacgccgcctgaggagagttgcctgcatcaacttactgggcaactcctgagggtggatatggaccgggaatcagggctgaaggaggttcaaagcctcgagtttggcggcaccccggcactggcctttcagggatacccctagccttttttacccccacccaagaaaggtttctgaggggcccaatccgggacacctttaggggaagctctcccccgcggggaatccccccctccgggag

SEQ ID NO: 60629 - DNA, 771 bp, Zea mays
  misc_feature: Ceres CLONE 1520358
  misc_feature (571)..(571): n is a, c, t, g, unknown, or other
  misc_feature (635)..(635): n is a, c, t, g, unknown, or other
  misc_feature (636)..(636): n is a, c, t, g, unknown, or other
  misc_feature (660)..(660): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (667)..(667): n is a, c, t, g, unknown, or other
  misc_feature (668)..(668): n is a, c, t, g, unknown, or other
  misc_feature (693)..(693): n is a, c, t, g, unknown, or other
  misc_feature (695)..(695): n is a, c, t, g, unknown, or other
  misc_feature (712)..(712): n is a, c, t, g, unknown, or other
  misc_feature (721)..(721): n is a, c, t, g, unknown, or other
acccgcggtggcggccgctctagaactagtggatcccccgggctgcaggaattcgtctcacccctagaaaaaggttcgcgaatcttccacacataggcagacggcaggactcgcttcaagctcctcatttctcgcagggggcccccctgacatcaccgaaacgatgatgaaggcagttgctgaccacgccagggctgatgtcaagggtagcatcttccttcctaggaagacgacggtggttcccccgtgactcggggtatgcttggccctcccgccgggggaccaggaggtccggtggtcatggtcgcttggggaaatggtttcaggggtgacttggggagagggtgccccttattaagccgggggggcaaaaagaaccaagggaggcatgtgggggggaaaagttccccccctgccccctattttgggggccttacgtttaaagggggaataaaaaaaaagtggggttgttcattgttcgcgtctccaaaatttgcccattctaaccgtttccgatacggagcccctgtccccaaaatctctcgtaaccaccccactttttggcgcgtcnattgtgccaccctcctattatccctttaaccaaaacaagatcctccacctcccttatcaaccanntccacctcatccaaacaccccccngnnnnannttgtatactccccgcgttcttatgntnccattcttgcgcttatncgtaagganggtggacgtcccctctcgggagcgaaagaaatacatttctgccacatata

SEQ ID NO: 60630 - DNA, 706 bp, Zea mays
  misc_feature: Ceres CLONE 1520360
  misc_feature: Encodes the peptide sequence at SEQ ID NO. 60631
  misc_feature (706)..(706): n is a, c, t, g, unknown, or other
ggagctccccgcggtggcggccgctctagaactagtggatcccccgggctgcaggaattcgtctcacccctagaaaaaacttgtgttgcgtacgtcggtcacatgcattgcatctgcatgcgcagtagcgagttctaaacacagcaggcaacaaactgacgtagcccaacgagcgagcgaccaatgggaaccctcaccgccgcccccctcgtcagcgcggccgaccgtcgccacgacgtgtcaggctcgatgtttgccgcatgctgacggtgagagccgatataggtcatgtgcggctccacccactcgaggcggccgagacagcggcgggacggcaacaaaggcacatcgtcatcacttctggccatggccaccagctcggtgaccacttcgaccgcgctggcgctgagagacgagcggatgtctacggagggctaccgggctcaacctgtggctcagcaacagcctgctgggatggatcctgctggacgtcttcggcatcatctggtacctctacaccgtcctacacctccgagctctgctaggatgagtactcccgtctctcactctgaaatgatgcgtctattagtccgagctactgtattatgtgatcaacctgacccgtgagtcctatcgatctatacatgcgttggtgccgactagacttatcatcgatcttgtctgagaccagcattccttagtagcn

SEQ ID NO: 60631 - protein, 112 aa, Zea mays
  misc_feature: Ceres CLONE 1520360
MCGSTHSRRPRQRRDGNKGTSSSLLAMATSSVTTSTALALRDERMSTEGYRAQPVAQQQPAGMDPAGRLRHHLVPLHRPTPPSSARMSTPVSHSEMMRLLVRATVLCDQPDP

SEQ ID NO: 60632 - DNA, 742 bp, Zea mays
  misc_feature: Ceres CLONE 1520361
  misc_feature: Encodes the peptide sequence at SEQ ID NO. 60633
  misc_feature (1)..(1): n is a, c, t, g, unknown, or other
  misc_feature (188)..(188): n is a, c, t, g, unknown, or other
  misc_feature (230)..(230): n is a, c, t, g, unknown, or other
  misc_feature (245)..(245): n is a, c, t, g, unknown, or other
  misc_feature (313)..(313): n is a, c, t, g, unknown, or other
  misc_feature (400)..(400): n is a, c, t, g, unknown, or other
  misc_feature (402)..(402): n is a, c, t, g, unknown, or other
  misc_feature (409)..(409): n is a, c, t, g, unknown, or other
  misc_feature (413)..(413): n is a, c, t, g, unknown, or other
  misc_feature (415)..(415): n is a, c, t, g, unknown, or other
  misc_feature (427)..(427): n is a, c, t, g, unknown, or other
  misc_feature (711)..(711): n is a, c, t, g, unknown, or other
  misc_feature (712)..(712): n is a, c, t, g, unknown, or other
  misc_feature (716)..(716): n is a, c, t, g, unknown, or other
  misc_feature (721)..(721): n is a, c, t, g, unknown, or other
naagagctggagctcaccgcggtggcggccgctctagaactagtggatctcttgggctgcaggaattcctctcacccctagaaaaatccaagctcaaagcaagcagatctaagctccaggcagcgtcgcgacagagtgagctagtgagtagcacgacaacaacaatggcttccctgaaggccgcgaancccagcggagttgcggcgcagggcaaggagccggcgcccaanctcagcgagacggcnacaaagccgtcagccgcgaagagcggcggcgttaataaggctgatcacacgccccgggagaacaaaangaaggtgaaaagcattttactggcggcggcggccaaaaagtgacttacatttttttcccccccccaagggggacagcaggggggaancnacccctncccntntattaaatcttnttccatccaaaacatgaatcttccccgggggggcgggggggggcggccccctcctgggggaaggagccctgaatgaataccaacccaacagagaccctggtggtgagaaaaaaaatgtttttcccgccggctcagtaggcgcccacaccgccacagccggggactcgtccccgccgtaccccctggtggttcccgcgttttgctgcccggccgcggcgagggctgtccccccccaggttgcgccggccccgcgttgcggggcagtgtctcccagcgcccgaggnnaaangaganaaagttatccgccccgtagcc

SEQ ID NO: 60633 - protein, 63 aa, Zea mays
  misc_feature: Ceres CLONE 1520361
  misc_feature (8)..(8): Xaa is any aa, unknown, or other
  misc_feature (22)..(22): Xaa is any aa, unknown, or other
  misc_feature (50)..(50): Xaa is any aa, unknown, or other
MASLKAAXPSGVAAQGKEPAPXLSETATKPSAAKSGGVNKADHTPRENKXKVKSILLAAAAKK

SEQ ID NO: 60634 - DNA, 676 bp, Zea mays
  misc_feature: Ceres CLONE 1520366
  misc_feature: Encodes the peptide sequence at SEQ ID NO. 60635
ctccccgcggtggcggccgctctagaactagtggatcccccgggctgcaggaattcgtctcacccctagaaaaagtcgctcctgcttccccagtattctgctcaagcacaccgcagaaaaagaaaaagaaaaggcaaaggcaaaggaatcccaatcaggcaagcaaaaaggaagaaccaggtgctgcggccggagatgtcgtcgcagctgatcgaggagcaccggtcgggcgcggaggtgcacgtcgggcacgagctgtgcgagcgcaagtcgcgcgagttcatggtggagctgggcctccccgacgggctcctcccgctgcccaggctcgacgaggtgggctacaaccggtcgacggggttcgtgtggctgcggcaggccgccggcctgacccacaccttcgggtccatcggcaagcaggtgtggtacgacagggaggtgacggcgttcgtggagccggggcggatgcacggcctcgccggggtgaagagcaaggagctcctcatctgggtcaccatctccgagatcgtcctcagcccctccggcaccaagatcgtgttccgcacccccgcggggctcggccgcgccttccctgtcaccgccttccagctcgagcccgcggcggccgagggggaccacaaggaggaggccgaggacgccgccgccgccgccgcca

SEQ ID NO: 60635 - protein, 160 aa, Zea mays
  misc_feature: Ceres CLONE 1520366
  misc_feature (4)..(149): Pfam Name: DUF538 Pfam Description: Protein of unknown function, DUF538
MSSQLIEEHRSGAEVHVGHELCERKSREFMVELGLPDGLLPLPRLDEVGYNRSTGFVWLRQAAGLTHTFGSIGKQVWYDREVTAFVEPGRMHGLAGVKSKELLIWVTISEIVLSPSGTKIVFRTPAGLGRAFPVTAFQLEPAAAEGDHKEEAEDAAAAAA

SEQ ID NO: 60636 - DNA, 693 bp, Zea mays
  misc_feature: Ceres CLONE 1520370
  misc_feature: Encodes the peptide sequence at SEQ ID NO. 60637
ggagctccccgcggtggcggccgctctagaactagtggatcccccgggctgcaggaattcgtctcacccctagaaaaaaaccctaccttctcgtgtctccgcgcctccacctccagtctccagccccaaggagtggtggcggcgcatcgtcagttagcttcgtcaccgttagagcccgaaggactctccctcggccctcgccgcctcgccggctcactgtcattggctgcatccgaagccggcagctcacaacgcctcttgtcaaacttcgacgactgctatctatctgtgctgctcatcgccttgatcgttgccgttgcccgcgtgcaccatggccacgcgccccacttcccggagtcctgagtgcctgctgaagttcgcatgtttgcgtagcgctcaaaatctgaaaggtcctagctcgcaatcgcaacgtagtcttgccgatgaacaggatgtgttgactgctgttattgagcttcaaacttcagagaatttgctgctgtgcagcctgctatgtcttaccgaagacttatgtccttgttaactctgtgcaagactatgttgctagctcgtcagtctatgtcgcattgtcgatcatacacttgtaaattgtgaactgttcgatttaaattagtatgaatgcttgtgccagcaaaaaagataaaccacacgctcgatgtacctacttcgccc

SEQ ID NO: 60637 - protein, 70 aa, Zea mays
  misc_feature: Ceres CLONE 1520370
MATRPTSRSPECLLKFACLRSAQNLKGPSSQSQRSLADEQDVLTAVIELQTSENLLLCSLLCLTEDLCPC

SEQ ID NO: 60638 - DNA, 682 bp, Zea mays
  misc_feature: Ceres CLONE 1520380
  misc_feature: SWISSPROT Homolog: EC 2.7.9.1 Pyruvate, phosphate dikinase
aagctggagctccccgcggtggcggccgctctagaactagtggatcccccgggctgcaggaattcgtctcacccctagaaaaattgaaaagctttgtaacctcccctacatgatcgcctcatctggtcgcatgctcggtctacttcacaatgtgatagattacatccctccctcggctcttttggaccatggtattcgcctgaccaagcggcctgtaaaggtgtctccctagagaacggcaccacttgctccaacacccgaggaaatggcgcctcaatctactcttatcgcccaagctgcttacaaagtgctgtgccatgtgggcaagatcatcatccaaatgagttagaacaatgattgagatcaccaccgcaactctcgtgactgataagaaaaccgactaggctgaaatatattccttcacaaccaacgacatgacgcagataaccttatcctacagcacggatgatgtggcaaacttcaataacacctatcatgctcaaggattctccatcttatcccttatagatccacgcaccaagtttgagaagtatagctcgtgaaacatacaagatagagtgtacgcatatcaaaaccaaacttaaaagtcgacatttgcggagaacagaagagagagtccttctctatgcccttcttcacgaaggatgcgatagattacgtc

SEQ ID NO: 60639 - DNA, 636 bp, Zea mays
  misc_feature: Ceres CLONE 1520388
  misc_feature: Encodes the peptide sequence at SEQ ID NO. 60640
aagctggagctccccgcggtggcggccgctctagaactagtggatcccccgggctgcaggaattcgtctcacccctagaaaaaatcgccatggcgtctcgtctcgttgcggcggcggcctcctcctcctccctctcctcagcgtcccccctcgctcgcctaatctctcgccgcggccttgccggtgccgcagacggccatgggtctgcgaaggtgcccttgtggaaagatccgttgagcccgagcaagtggaaggaagagcactttgttctagcaagcctctcaatgtggggggttattttttatggtggttacaagctttttagtggaaagaaggaagccaagactgaggcggcatcaccacaggcataggtggcggagatggagttatacccgtatctgtggcctggcaacaatgttaaataaaaggaatgcttttatgtgtgctttcaagttgataaattgtggcaacaggagatttttgctttcctaggcaaaaatttgggaaactatcttttaccccttcccccaggaaaaaacctttgtgcgccggggggaattttttttgttcggaaaaaaaaaggaaaaacgttttgactcttttttctttcggcaaaggaaaaaaatttaaaggttt

SEQ ID NO: 60640 - protein, 93 aa, Zea mays
  misc_feature: Ceres CLONE 1520388
MASRLVAAAASSSSLSSASPLARLISRRGLAGAADGHGSAKVPLWKDPLSPSKWKEEHFVLASLSMWGVIFYGGYKLFSGKKEAKTEAASPQA

SEQ ID NO: 60641 - DNA, 505 bp, Zea mays
  misc_feature: Ceres CLONE 1520609
  misc_feature (238)..(238): n is a, c, t, g, unknown, or other
  misc_feature (239)..(239): n is a, c, t, g, unknown, or other
aaagctggagctccccgcggtggcggccgctctagaactagtggatcccccgggctgcaggaattcgtctcacccctagaaaaacaatctcgttgcccgttgtgctctctctctctattcgttccccgcctcaccccgagccagccgtctcgctagggtttcgccgccgccgccgccgccgctcgctcgctatgcctcgcctgcaagcttcaaggaagggtcttggccccaccgcccnncaaatataccccggggttgctcccagggggaccgccaagcagacccagggtcccctcaatccttttaaaagggggggcccccattttggggaaaatggggcccccctttttcagggtaggcttttccccgggagcccttgcccacagggtttttttctttttttaaccccccccccctttttcgggaaaagttggtttttaaaaaaaattggggtgggcccccccccccccccccccccaaaaaaaaaaacccccccccccccccc

SEQ ID NO: 60642 - DNA, 706 bp, Zea mays
  misc_feature: Ceres CLONE 1520612
  misc_feature: Encodes the peptide sequence at SEQ ID NO. 60643
  misc_feature (294)..(294): n is a, c, t, g, unknown, or other
  misc_feature (312)..(312): n is a, c, t, g, unknown, or other
  misc_feature (314)..(314): n is a, c, t, g, unknown, or other
  misc_feature (315)..(315): n is a, c, t, g, unknown, or other
  misc_feature (401)..(401): n is a, c, t, g, unknown, or other
  misc_feature (404)..(404): n is a, c, t, g, unknown, or other
  misc_feature (436)..(436): n is a, c, t, g, unknown, or other
  misc_feature (437)..(437): n is a, c, t, g, unknown, or other
  misc_feature (486)..(486): n is a, c, t, g, unknown, or other
  misc_feature (545)..(545): n is a, c, t, g, unknown, or other
  misc_feature (564)..(564): n is a, c, t, g, unknown, or other
  misc_feature (565)..(565): n is a, c, t, g, unknown, or other
  misc_feature (598)..(598): n is a, c, t, g, unknown, or other
  misc_feature (651)..(651): n is a, c, t, g, unknown, or other
  misc_feature (652)..(652): n is a, c, t, g, unknown, or other
  misc_feature (662)..(662): n is a, c, t, g, unknown, or other
aatagctggagctccccgcggtggcggccgctctagaactagtggatcccccgggctgcaggaattcgtctcacccctagagagctcggcctctgctcccggctcccccacggtactccagccgctagcctgcgattccgccagtacgccaccaccaccgagcctggactaccgccgccgcccttcgccgatatcttcagcggcgaacagcgcccaccagatcccgcccctgcgatggagtccgtggtgaacccgaaggcatacccgctggctgatgcgcagctgaccatgggnatcctcgatatcatcccncnnggccgccaactaccaaacagcttaggaagggagcgaatgaagcttttaacccccctcaagggggggggggggggagttttttattnttntccccacaccccacatcctctcgaaaatcttnnccccccttcccctcgtggagcgcgagaaccaaaaccctgccctactgtntttgtccccctggaaaaaagcctttgcgcccgtccgcgtgggccaacagcatccgggtnccgtctccttcggcccccnntattgcgtgggccccatgctggagcccgcgatncgcggatttcaacatggtaccgtgcaaagcattttatttagatatcgccaccnntttttttatntaacgaagcgccccctactgtttatttttccccacgcggtaccg

SEQ ID NO: 60643 - protein, 134 aa, Zea mays
  misc_feature: Ceres CLONE 1520612
  misc_feature (27)..(27): Xaa is any aa, unknown, or other
  misc_feature (56)..(56): Xaa is any aa, unknown, or other
  misc_feature (57)..(57): Xaa is any aa, unknown, or other
  misc_feature (68)..(68): Xaa is any aa, unknown, or other
  misc_feature (104)..(104): Xaa is any aa, unknown, or other
  misc_feature (111)..(111): Xaa is any aa, unknown, or other
  misc_feature (122)..(122): Xaa is any aa, unknown, or other
MESVVNPKAYPLADAQLTMGILDIIPXGRQLPNSLGRERMKLLTPLKGGGGGVFYXXPHTPHPLENLXPPSPRGAREPKPCPTVFVPLEKSLCARPRGPTASGXRLLRPPXLRGPHAGARDXRISTWYRAKHFI

SEQ ID NO: 60644 - DNA, 744 bp, Zea mays
  misc_feature: Ceres CLONE 1520619
  misc_feature: Encodes the peptide sequence at SEQ ID NO. 60645
  misc_feature (1)..(1): n is a, c, t, g, unknown, or other
  misc_feature (69)..(69): n is a, c, t, g, unknown, or other
  misc_feature (185)..(185): n is a, c, t, g, unknown, or other
  misc_feature (215)..(215): n is a, c, t, g, unknown, or other
  misc_feature (220)..(220): n is a, c, t, g, unknown, or other
  misc_feature (229)..(229): n is a, c, t, g, unknown, or other
  misc_feature (234)..(234): n is a, c, t, g, unknown, or other
  misc_feature (243)..(243): n is a, c, t, g, unknown, or other
  misc_feature (246)..(246): n is a, c, t, g, unknown, or other
  misc_feature (316)..(316): n is a, c, t, g, unknown, or other
  misc_feature (317)..(317): n is a, c, t, g, unknown, or other
  misc_feature (319)..(319): n is a, c, t, g, unknown, or other
  misc_feature (355)..(355): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (413)..(413): n is a, c, t, g, unknown, or other
  misc_feature (415)..(415): n is a, c, t, g, unknown, or other
  misc_feature (418)..(418): n is a, c, t, g, unknown, or other
  misc_feature (451)..(451): n is a, c, t, g, unknown, or other
  misc_feature (491)..(491): n is a, c, t, g, unknown, or other
  misc_feature (492)..(492): n is a, c, t, g, unknown, or other
  misc_feature (502)..(502): n is a, c, t, g, unknown, or other
  misc_feature (503)..(503): n is a, c, t, g, unknown, or other
  misc_feature (530)..(530): n is a, c, t, g, unknown, or other
  misc_feature (532)..(532): n is a, c, t, g, unknown, or other
  misc_feature (559)..(559): n is a, c, t, g, unknown, or other
  misc_feature (560)..(560): n is a, c, t, g, unknown, or other
  misc_feature (583)..(583): n is a, c, t, g, unknown, or other
  misc_feature (584)..(584): n is a, c, t, g, unknown, or other
  misc_feature (587)..(587): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (611)..(611): n is a, c, t, g, unknown, or other
  misc_feature (645)..(645): n is a, c, t, g, unknown, or other
  misc_feature (646)..(646): n is a, c, t, g, unknown, or other
  misc_feature (718)..(718): n is a, c, t, g, unknown, or other
  misc_feature (719)..(719): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (727)..(727): n is a, c, t, g, unknown, or other
  misc_feature (728)..(728): n is a, c, t, g, unknown, or other
  misc_feature (730)..(730): n is a, c, t, g, unknown, or other
  misc_feature (731)..(731): n is a, c, t, g, unknown, or other
ncatagctggagctcaccgcggtggcggccgctctagaactagtggattccctgggctgcaggaattcntctcaccccctaggagaggggaagtttcgctctcgcccgcgtcgacttcctagggttcgaggaacgtccgtccgtccgtccggggaaggagcaggagggaggcggaaattatctangtggtgctcaacgaccgcctggggaaaaangtgcnggtcaagtncaacnaggacaacnccntcggcgacctcaagaggctggtggcggcccataccggttaccccccccgagggagacacccttccaaaanntnttcctttttctccaagggactccttccccctccagnaccactttttttcccccccccccggggggaaagaaagggggatttnnntnnncnnncncnccncccttctttttctagaaaaaaaaaacaagattntccggggggggggggggcttatcatatcctacggaacctnntccgcccgcnncccgccgggtcctccgtcggccgtggnanggctttcgcggccttgttcgggttctnngaacgggccgcggggggcgcccnngcnctccnnnggcttccgcgccccggnaatttcgtgggagcccgcgcgttcgtggatcgcnnaaggctcttgcaaggcgtgtcccgcgttggtgcttcatcagtccgcccgtcgctcttcttgtggctcggggnngnnnnnannanngcccacgcggtgg

SEQ ID NO: 60645 - protein, 39 aa, Zea mays
  misc_feature: Ceres CLONE 1520619
  misc_feature (23)..(23): Xaa is any aa, unknown, or other
IAGAHRGGGRSRTSGFPGLQEFXSPPRRGEVSLSPASTS

SEQ ID NO: 60646 - DNA, 663 bp, Zea mays
  misc_feature: Ceres CLONE 1520640
  misc_feature: Encodes the peptide sequence at SEQ ID NO. 60647
ggagctccccgcggtggcggccgctctagaactagtggatcccccgggctgcaggaattcgtctcacccctagaaaaacttgctcgctgcgccgccgccatccgacatcagaccttcatcgccgctagcaaccgataatgcgccggcgttgagatgttggtttatatggatctcctgtctggcgacgagctcctgtcggattcattcacctacaaggagttcgagaacggcgtcctgtgggaggtcgagggaaagtgtgtcacccaaggtcctgttgatgtggacattggtgccaatccatccaccgagggtggtgaggacgaaagcgttgatgaccatctgtgaaggtggttgatattgttgacacattccgtctacaggagcaacctcctttagaaagaaatcatgtgtgcatccatcaaacatacatcagaatctcactgctgtgttgcatcagagaaagcgcatgatatcataagggcgtcgagggtgcaaccaagtttctcggtaggccagctgaaggacgtcccatttatggtcgatgactcaagaacggatgatgcgtctggtgtatttcgccaaataacagggatggtgccccctaatccgaagttccctccaatcccccccaaggccttaaagaaaatcaagtgcctaggggtt

SEQ ID NO: 60647 - protein, 63 aa, Zea mays
  misc_feature: Ceres CLONE 1520640
  misc_feature (1)..(61): Pfam Name: TCTP Pfam Description: Translationally controlled tumour protein
MLVYMDLLSGDELLSDSFTYKEFENGVLWEVEGKCVTQGPVDVDIGANPSTEGGEDESVDDHL

SEQ ID NO: 60648 - DNA, 836 bp, Zea mays
  misc_feature: Ceres CLONE 1520652
  misc_feature: Encodes the peptide sequence at SEQ ID NO. 60649
  misc_feature (21)..(21): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (38)..(38): n is a, c, t, g, unknown, or other
  misc_feature (41)..(41): n is a, c, t, g, unknown, or other
  misc_feature (376)..(376): n is a, c, t, g, unknown, or other
  misc_feature (387)..(387): n is a, c, t, g, unknown, or other
  misc_feature (388)..(388): n is a, c, t, g, unknown, or other
  misc_feature (450)..(450): n is a, c, t, g, unknown, or other
  misc_feature (461)..(461): n is a, c, t, g, unknown, or other
  misc_feature (463)..(463): n is a, c, t, g, unknown, or other
  misc_feature (504)..(504): n is a, c, t, g, unknown, or other
catggggtggaacaaaaaaanaannnnnnncacacacnccnaaaactggaactccccgcggtggcggccgctctataatagtggatcccccgggctgcaggaattcgtctcacccctagaaaaactagaaaaaaaaacgatcactcaccactccacagcagtagcaagagggatagagcaaggccacacacacacacacaccactaggctaggttagccttttaatcgccctcgagaaacaagaaaggcggaggtcgtgagggccgtggcgcaaagcccggtgctggtggtggggcaggcacgggggctgcctagaccacatgtagaaacggctgttgcatgggatcggtgggaacccgggagggttgaaagaaanttaaaaaagtnnagatcacccagggcccacccccccttttcggaggggatttgtagaattttttttaatacgangcccaaccccnanaaaatacttaagggggtttaaaaaggtattgggaactgccncaatcctccgtgttaagctggtgcgtcgtcttgcataaaaggatgggggggcatctgggctccaaattttataaattttggtgttgagaaaagagtaaaaggtggacttatcgtgaatatgatgtgtgtttttacccctatctctcgaaaaaaagaatgaagaaccatgagtcaggccacccctgagagaaagctaaaaaaatatgtccgctgtcgtcgccgccctccaaaacaacacgtcaacaaaaaggacagggataacaaccaagcgacgtagatacaaagggttggttcaagaaagacgctattcttgctcgctatgatcgtgcacg

SEQ ID NO: 60649 - protein, 71 aa, Zea mays
  misc_feature: Ceres CLONE 1520652
  misc_feature (7)..(7): Xaa is any aa, unknown, or other
  misc_feature (8)..(8): Xaa is any aa, unknown, or other
  misc_feature (9)..(9): Xaa is any aa, unknown, or other
  misc_feature (10)..(10): Xaa is any aa, unknown, or other
  misc_feature (13)..(13): Xaa is any aa, unknown, or other
  misc_feature (14)..(14): Xaa is any aa, unknown, or other
MGWNKKXXXXTHXXNWNSPRWRPLYNSGSPGLQEFVSPLEKLEKKTITHHSTAVARGIEQGHTHTHTTRLG

SEQ ID NO: 60650 - DNA, 619 bp, Zea mays
  misc_feature: Ceres CLONE 1520654
  misc_feature: Encodes the peptide sequence at SEQ ID NO. 60651
  misc_feature (301)..(301): n is a, c, t, g, unknown, or other
agtggatcccccgggctgcaggaattcgtctcacccctagaaaaagacaccttccccgcacaccggttgcgatccgccgccatcgcttcaagcagcgaaccctagccgccctcagcgacggattgcagatctcccagccatgacgttcaagcggaggaacggcggacgcaacaagcacgggcgcggccacgtcaagtacatacgctgctccaactgcgccaagtgctgtccaaaggataaggctatcaagcggttcttggtgaggaacattgttgagcaggctgctgtgagggacgtgcangaggcttgtgtgcatgatggatatgttcttcccaaattgaaccgcaaagggttcatcactgtgtccctcagggcccaatccatggcgcacattgtccgtgttccgctctcgtgaaaacgggaaggacccgtgagcccccccccaagcgtttcagggcccccgggaatgaatggcccccaagggcccaggttcagggggccccacccgggcccccaggggggggtgtgggtggcaaaagaaggccccccctgggtggccgtccccccgaaccaaaaatttccgggaaagggcttttccagggggttttaatttcttccc

SEQ ID NO: 60651 - protein, 91 aa, Zea mays
  misc_feature: Ceres CLONE 1520654
  misc_feature (1)..(92): Pfam Name: Ribosomal_S26e Pfam Description: Ribosomal protein S26e
  misc_feature (54)..(54): Xaa is any aa, unknown, or other
MTFKRRNGGRNKHGRGHVKYIRCSNCAKCCPKDKAIKRFLVRNIVEQAAVRDVXEACVHDGYVLPKLNRKGFITVSLRAQSMAHIVRVPLS

SEQ ID NO: 60652 - DNA, 686 bp, Zea mays
  misc_feature: Ceres CLONE 1520661
  misc_feature: Encodes the peptide sequence at SEQ ID NO. 60653
  misc_feature (52)..(52): n is a, c, t, g, unknown, or other
  misc_feature (382)..(382): n is a, c, t, g, unknown, or other
  misc_feature (596)..(596): n is a, c, t, g, unknown, or other
aagctggagctccccgcggtggcggccgctctagactagtggatctcttggnctgcaggaattcgtctcacccctagagagatcgccattcgccacaaagccatttgaaccccccacgtctcctcgcctcgttccccatttgctgcgtctccttgcccgcgccgccgctcgccgtttgcccctcgtctccgcaccgcgcgctgttgtccatccttgtgcagcaaaaatgacggctggctacattgttggctcactggtcggatcctttgccattgcatacctgtgtgacacatttatctctgacaagaaggcatttggaggtagcacccccaagactgtttctgacaaggagtggtgccaagccacagacaccaggtcccantcttgcctcgcactgcccgcccaccggttggcatgacccccttcccccccagaacttcatcgccaagaccccccgagacgttcggacctgaataacctggctccgccacttggggccccctcggcacccccaagtcctttttttacaggctctaagcacatggtccccacccccacaaccccccccccggctttatccacgcgcctcttccttnaatctgtcgcgcgggacactgggggtctatttccccccggccgcccatgcggacctaccgtatctggttcgaactttccccctcctctcc

SEQ ID NO: 60653 - protein, 63 aa, Zea mays
  misc_feature: Ceres CLONE 1520661
  misc_feature (3)..(64): Pfam Name: DUF1138 Pfam Description: Protein of unknown function (DUF1138)
  misc_feature (52)..(52): Xaa is any aa, unknown, or other
MTAGYIVGSLVGSFAIAYLCDTFISDKKAFGGSTPKTVSDKEWCQATDTRSXSCLALPAHRLA

SEQ ID NO: 60654 - DNA, 692 bp, Zea mays
  misc_feature: Ceres CLONE 1520667
  misc_feature: Translation starting site: 154
  misc_feature (434)..(434): n is a, c, t, g, unknown, or other
  misc_feature (522)..(522): n is a, c, t, g, unknown, or other
  misc_feature (537)..(537): n is a, c, t, g, unknown, or other
  misc_feature (547)..(547): n is a, c, t, g, unknown, or other
  misc_feature (554)..(554): n is a, c, t, g, unknown, or other
tccccgcggtggcggccgctctagaactagtggatcccccgggctgcaggaattcgtctcacccctagaaaaaaacctcccactgcattctcgaattccgattcccaatccagcaaaccctaccagccttttgcaaactcagagagggacccgatggcacccaaggcggagaagaagccggcggcgaagaagcccgcagaggaggagcccgcggccccggcggagaaggctcccgctgggaagaagccgaaggcggagaagcggctcccggcgggaaaatccgccggcaaggaaggcggtgttgacaagaaggggcggaagaagccaagaagagcgtggagacgtacaagatctacatcttcaaggtgctgaagcaggtgcacccggacatcggcatctcctcccaggccatgtccatcatgaactccttcatncacgacatcttcgagaagctcgccggcgaggcggcccagctcgcccgttacacaagaagcccaccatcacctcccgggagatccagancctcgtccgcctcgntctacccggngagctcngcaagcacgccgtctcggagggcaccaaggccgtcaccccagtcacctcgtcctaagctcctttcgagtagtccctaagcgccgtggcgccttttgactggatggaatggtggtcatctggaagttgatctgacaagg

SEQ ID NO: 60655 - DNA, 665 bp, Zea mays
  misc_feature: Ceres CLONE 1520675
agagctggagctccccgcggtggcggccgctctagaactagtggatcccccgggctgcaggaattcgtctcacccctagaaaaagagcagtgccaatctcgccgcgagcttccactgctttgccctatgcactatacgccgccccccggactggaaaattgcttccccgcggacctccactccaacggtgcccgtatctcctttgtcctggctggatccgtataatctcctttgtcctccccctcccctcgttcccgtctccctcgcggtcctctcaaccgtacgccgccgacttgctcgcaccgtcgacagtgcctcagtccagatcgaccctccctctacccagatcgggttccagttggactaccgcccccgccgtcctactacaggtgccgaggcctacaccggccaagagcgcccgccagacaaaagaaacccgggaataatgctgctcggttttctcctgactctgacaaccttaaacctggtttacgttcttacaccttccggggcaacaaatttacaattttgtccaaaattcacccctttttggcgccaatttctttcctggccccaaaaaataaggaaattttgggtttcccaaaacaagggccgcggggggcggtttccccatcccacccccttggaaaaaagggtgtgggggt

SEQ ID NO: 60656 - DNA, 704 bp, Zea mays
  misc_feature: Ceres CLONE 1520678
  misc_feature (54)..(54): n is a, c, t, g, unknown, or other
  misc_feature (80)..(80): n is a, c, t, g, unknown, or other
  misc_feature (351)..(351): n is a, c, t, g, unknown, or other
  misc_feature (488)..(488): n is a, c, t, g, unknown, or other
aaagctggagctccccgcggtggcggccgctctagaactagtggatcccctggnctgcaggaattcgtctcacccctagngaagataccaacctacaattgtcacttccattttctcaataccttaagcaaggaccaatgtctcaagcccagccccctcgttcccaagcccagtggaaacacgttaaatttcaggataaccaagctaatggcatgaagggaccaggaaccggtgggtatggtatggcgagaaaaatacaagaataaggatgtggatacaataccctccgaactgaatcaagttaaacaccaggcttgggcgactccaaaaaaaggaaaaccgtgctcccancctttttccccccactgggtcaaaggcgcaggaacctttatcccctctacccgtatccacccccccccccaaaaacccaaaaaattctaaatatgaagtgacggggggggcatgctggcaacctgtcacagagatcncgtcaaccgcgaagagggcaatatcctgggccccttgttttctacgaaggacgccacgccggggggggagcaggaatcgcatacgcggattggtatagaagccggccggcaggcccctcctcttcgctccccgccgccccggttatatatacgttcgggcccctccgtgagtacggacggtcgccccgcccgcatttacgacccccccctcaaccg

SEQ ID NO: 60657 - DNA, 663 bp, Zea mays
  misc_feature: Ceres CLONE 1520688
  misc_feature: Encodes the peptide sequence at SEQ ID NO. 60658
  misc_feature (490)..(490): n is a, c, t, g, unknown, or other
  misc_feature (498)..(498): n is a, c, t, g, unknown, or other
  misc_feature (499)..(499): n is a, c, t, g, unknown, or other
tcccccgggctgcaggaattcgtctcacccctagaaaaagtctcctctccggcctccacccatggctcatcccctcctctcgtccgcgcttgtttgttcgcgtcttctccctgtagggaactccgttccccggccccggctgtgcgtggcgtcagcacgccccgcgggcaggggggtgaggctgctgagcgtgaggtgcgagcagggagccaagggcggtggcgggctggacgtgtggctgagccgcggggcgatgctgggcttcgtcggagcggtggccgtggagctgaccaccgggaaaagcgtgcttcagaatgtgggattgaccgcgccggtgccgacgctggcgctggcgctcaccggcgtggtcggcgtcctcacggccttcctcatcttccagtccgggacgcgggactgatgggtgaattgtcaaagctcccaaaaagacatgcataagtctgtcagagtcttgtgctgtgtatgtctatgnctgtgtanntgccttgccctcacaggaagctgaagagtacacagtgcgaaaaggatattattattatatttaccatttgggtttacagtgaaaaaaaaaaaaaaagagacgctcgagtacccaattcgcctaaagtgatcgtatacgcgcgctcctggccgtcctttacacgc

SEQ ID NO: 60658 - protein, 118 aa, Zea mays
  misc_feature: Ceres CLONE 1520688
MAHPLLSSALVCSRLLPVGNSVPRPRLCVASARPAGRGVRLLSVRCEQGAKGGGGLDVWLSRGAMLGFVGAVAVELTTGKSVLQNVGLTAPVPTLALALTGVVGVLTAFLIFQSGTRD

SEQ ID NO: 60659 - DNA, 699 bp, Zea mays
  misc_feature: Ceres CLONE 1520689
  misc_feature: Encodes the peptide sequence at SEQ ID NO. 60660
gcggtggcggccgctctagaactagtggatcccccgggctgcaggaattcgtctcacccctagaaaaacaggccacacgcacaccaagatatagagattgctggtcgagaagaagagatgttacatatataataactactgtaggcagcggcatctcctgctgggacgaagattcaagaagctagctaagagagaagggcataacgagataataagcagcgcgcgaagatgcaagactgggcgccggtgttcgtctcgctggtgctcttcatcctgctgtcgccgggcctgctgttccagatgccgggcaagtgccggatcatcgagttcggcaacttccagaccagcgccatctccatcctcgtccacgccatcctcttcttcgccctcgcccccatcttcctcgtcgccgtcggggtgcacatgtacctcggctcctaggcggcggcgcggggcgccgtaacttctctctctcggcggcgcggcatcgttcacttcttttatgttcctccccaaaaatataggctgtatgaatgaatgatatcatataataatggacgtaccggtctccatgcatttggcccaaaaaaaaaaaaaaaacgagacgctcaaggaacccattccgccttatagtgagtcgtattacgcgcgcccccgggccgcctttttaaacggcgtggatggaaaaccctggggttc

SEQ ID NO: 60660 - protein, 70 aa, Zea mays
  misc_feature: Ceres CLONE 1520689
MQDWAPVFVSLVLFILLSPGLLFQMPGKCRIIEFGNFQTSAISILVHAILFFALAPIFLVAVGVHMYLGS

SEQ ID NO: 60661 - DNA, 717 bp, Zea mays
  misc_feature: Ceres CLONE 1520695
  misc_feature: Encodes the peptide sequence at SEQ ID NO. 60662
  misc_feature (625)..(625): n is a, c, t, g, unknown, or other
  misc_feature (640)..(640): n is a, c, t, g, unknown, or other
  misc_feature (659)..(659): n is a, c, t, g, unknown, or other
tccccgcggtggcggccgctctagaactagtggatcccccgggctgcaggaattcgtctcacccctagaaatttgtggaggcactgaaactgatggagcaccgctatggggcaagagatttcgtgacgaatcaagatacaagtctgctatccgcaggcacatactatctcacgcacgttgactccaagtacagaaggttctacgacgtgaaaggtgacggtgtcgccactgcaatgtccaacggccactgatctttcttctgcccgaagctgcaacaagtcaaataacagaggcaagtgtcctaagcatccttagattattatatctattaagaggggaagctcgagttatagattaatctatgcccagctgtaaggttgtaaagttagttagagctgcgcatgcttgtttattaaaagctctgctgctcttcagttatttagcgaatcaagcacactgctgggctaataagaattgtaaacaataatctgcagaatcactggctacatccaggttatgctgatgaatgcacgatttcatgtttaacacgatcaatgcatctggttacatccaggttatgctgatgaatggacattttggttccaaaatgtgaagtatgcatacnaagaatttggtgggngcaatatcagattgatcanaaggcatagcttggatgattcgtacgtataataatgtgctggatggattgctatacac

SEQ ID NO: 60662 - protein, 52 aa, Zea mays
  misc_feature: Ceres CLONE 1520695
  misc_feature: SWISSPROT Homolog: EC 2.3.3.10 Hydroxymethylglutaryl-CoA synthase
MEHRYGARDFVTNQDTSLLSAGTYYLTHVDSKYRRFYDVKGDGVATAMSNGH

SEQ ID NO: 60663 - DNA, 705 bp, Zea mays
  misc_feature: Ceres CLONE 1520704
  misc_feature: Encodes the peptide sequence at SEQ ID NO. 60664
  misc_feature (387)..(387): n is a, c, t, g, unknown, or other
  misc_feature (389)..(389): n is a, c, t, g, unknown, or other
  misc_feature (405)..(405): n is a, c, t, g, unknown, or other
ggcggccgctctagaactagtggatcccccgggctgcaggaattcgtctcacccctagaaaaaagcagcagcagcacagtcatccacactaacgaacgaactcttgctccgatcacgagctagctgaggtcgacgatggcggctgtgctgaacagcaggaagacggcgcaggcggtggtggccgtgctggtggcggcggcgctgctggcttcgtccacttcggcggcgatcacctgcgggcaggtggggtcgtcgctggcgccgtgcatcccgtacgcgacggggagggccagcgcgctccccgcgtcgtgctgcagcggcgtcaagagcctcaacagcgcggcgcggaccagcgcggaccgccaggcggcgtgccgctgcctcaanancctcgccaacagcgtncagagcgtcaacatgggcaccgtcgccaccatcccccggcaggtgcggggtctccgttcggatccccctcagcatgttcacccgactggcaccagatcagctaagtttccacgaaccagctaataagcctaccgaacggacccaaacgtcccgcccgctgcccgagtgaatgaacccggggagaattaaaattaacccccctgttttgcccgggacacctgccttatttttccatctaaaatattcccgggcgcggaaacccctttaaaggggaaaatggggggcccccatgccaattct

SEQ ID NO: 60664 - protein, 130 aa, Zea mays
  misc_feature: Ceres CLONE 1520704
  misc_feature (34)..(110): Pfam Name: Tryp_alpha_amyl Pfam Description: Protease inhibitor/seed storage/LTP family
  misc_feature (84)..(84): Xaa is any aa, unknown, or other
  misc_feature (85)..(85): Xaa is any aa, unknown, or other
MAAVLNSRKTAQAVVAVLVAAALLASSTSAAITCGQVGSSLAPCIPYATGRASALPASCCSGVKSLNSAARTSADRQAACRCLXXLANSVQSVNMGTVATIPRQVRGLRSDPPQHVHPTGTRSAKFPRTS

SEQ ID NO: 60665 - DNA, 795 bp, Zea mays
  misc_feature: Ceres CLONE 1520711
  misc_feature: Encodes the peptide sequence at SEQ ID NO. 60666
  misc_feature (419)..(419): n is a, c, t, g, unknown, or other
ccccgcggtggcggccgctctagaactagtggatcccccgggctgcaggaattcgtctcacccctagaaaaaaatcctagtagccgtccgcgcaaaaccctccctgctcagactcgtctgctgcagctcctcctccgccgccgtatcaaacgcactctccttcgccgccgtatcaaacgcactctccttcgccgccgtatcaaacgcactctcctccgccgccgcccgaggcaagatggttctccagaacgacatcgaccttctcaacccgccggcagagctcgagaagctcaagcacaagaagaagcgcctcgtccagtcccccaactcattcttcatggatgccaagtgccccgcatgcctgcggaggaggcggggtttttcaggcatttccaaaacccccccccgccccccccaanctggcaaaaatggttccctgcccccccccctggaagaaaagggaaggcttacgggaaggggtgggtcctttccggccggaaggggaaaataaaagggaagcaggttataaggaacggggaacggggggggaaaaccccccggaagggggggcctttaaggttttttgcgccctggcgccaaaaggtgaggccgcaaagaaatagacctatatggaaggccgcaccccgcgagggtgggttttaagtggcgacctaagtgcctcaccgaggtgggattatgcgcgaacacatatagaaggggggtaggggtgtcgggatagtgaaaagaaacccggggggaggagatgctgtcagatactaggcacgacacaagggc

SEQ ID NO: 60666 - protein, 91 aa, Zea mays
  misc_feature: Ceres CLONE 1520711
  misc_feature (62)..(62): Xaa is any aa, unknown, or other
MVLQNDIDLLNPPAELEKLKHKKKRLVQSPNSFFMDAKCPACLRRRRGFSGISKTPPRPPQXGKNGSLPPPLEEKGRLTGRGGSFPAGRGK

SEQ ID NO: 60667 - DNA, 842 bp, Zea mays
  misc_feature: Ceres CLONE 1520715
  misc_feature (1)..(1): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (350)..(350): n is a, c, t, g, unknown, or other
naaagagacacnnnnnnnnnnnnnnnnngagagannnncgaatttggaactccccaggtggcggccgctctatactagtggacccccgggctgcaggattcctctccccctagaaaaaagcccgacataagacagcccgtcaccccctctcgtttttcctcggccttcgcctccaagcgcgtgggctcctctcctcctccagggaagcgagagcttctgcatacctacgacaaatcacaaccttgatcaactcggtgccaccaaaacccccctagggagttgcggggctgacctcgaccgtcaggcatccccctggctcttatgcggtgcgggaggaaattgtagaaaantaaattaaaaaaaaaaaaaaaaaaaaaaaaaaaaccattttttttttccccccccccgcggggggaagaagggggcataaattttttttttttaatggccccccccccccctggccaaaaactactatgcctacgtgtgcctgtgcgcgccacctcccctagcccccggcacgaatgggtgtgactccccctggcattttggccatctggcgcccccggggagccgccgagttagagagtgagatatgctagccaaggggtagtactcatccccccacagcggagcctataatgagaggcaatgagtcccggggcgggccgtccggtgtgccctacgtcgctcgcgagcggccgaccgcaggacgcgaccccccagcctgtccttgcgaatgtcctcgcggtccaccccaacttccgccccgttgattcaccccctcttctggacgccgggacggagcgccgttgcgcagatctcgctcctcactccccgtt

SEQ ID NO: 60668 - DNA, 626 bp, Zea mays
  misc_feature: Ceres CLONE 1520722
  misc_feature: Encodes the peptide sequence at SEQ ID NO. 60669
ctggagctccccgcggtggcggccgctctagaactagtggatcccccgggctgcaggaattcgtctcacccctagaaaaaaccaactcgatcggtctgctagtgttggagagaagagaatacactacagtactacatggcgaagcagcagcagcagggcatggcggcagtggcgctggtagtgctggtggtgctggcggcgacggcggccgagacggcgtcggcggcttcgtgcaacgccgggcagctggcggcgtgcgcgccggcgatcactgccggcgcgacgccctccgcgtcgtgctgctccaacctcaaggcgcagcaggggtgcttctgccagatcgtgaagagcccacctacgggcgctacatcaacagccccaacgcgcgcaaggtcgtcgccctcctgacggcgtcttcgtggcgcccctgctaggactagaaccgggggctggcccatccatgtaccggccccccgggggctgaatctccccggctggtttccgggccttgcccccccgccctccggggggtttggggccccctttttcgggttaaggccccccccccccgggggaaccggggccccccgggaacccccccccctcaaaaaggccggggcccgggg

SEQ ID NO: 60669 - protein, 90 aa, Zea mays
  misc_feature: Ceres CLONE 1520722
MAKQQQQGMAAVALVVLVVLAATAAETASAASCNAGQLAACAPAITAGATPSASCCSNLKAQQGCFCQIVKSPPTGATSTAPTRARSSPS

SEQ ID NO: 60670 - DNA, 781 bp, Zea mays
  misc_feature: Ceres CLONE 1520724
  misc_feature (33)..(33): n is a, c, t, g, unknown, or other
  misc_feature (36)..(36): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (269)..(269): n is a, c, t, g, unknown, or other
  misc_feature (272)..(272): n is a, c, t, g, unknown, or other
agcacaggagcaaaaaccacccacttttattantcncctttnnnnnnnnnnnnnnnnnnnnnnnaaaactggggctccccgcggtggcggccgctctagaactagtggatcccccgggctgcaggaattcctctcacccctagaaagaggccacttacctgcagtcaccactcccaagccagtacccacagtcctacgagcagtcgcacgcaagtgtcaagagacaaaacgggcgacatggctcccacgcaatctggccgtaacggtcnccnggggggccggcggtgttgctcgtggcaccccccgctaccagcgcggagggtgccatcaccgtcagccggggggggccctcctcccgcgggggggggggggggcacggggggcggcgggttgtgtccgaccccccgccccgggggaggggggggggtgtttttttcccccccccccccggggggggggggggggggggaaccccccaccaaccacacaaacctttttccttgttggcgaaaagagagaaaacggggggcggccgccgcggggcgcggggcgggcccaatcgtggcgggggcggcgggcgtggccgcgggggcggggggcgggcgcgcgggtccgtcgcggggcgggcggggatgggaggcccgtcgacggccccgctctccgccgcgccgcccgcgaggggaaggagtgagcggggtaggggcgggggggccgcgcgtgcgtcgccccctactgccgccgcgcccttctccgccgcggatgcgctccccccgcccccacc

SEQ ID NO: 60671 - DNA, 916 bp, Zea mays
  misc_feature: Ceres CLONE 1520725
  misc_feature: Encodes the peptide sequence at SEQ ID NO. 60672
  misc_feature (10)..(10): n is a, c, t, g, unknown, or other
  misc_feature (38)..(38): n is a, c, t, g, unknown, or other
  misc_feature (405)..(405): n is a, c, t, g, unknown, or other
  misc_feature (409)..(409): n is a, c, t, g, unknown, or other
  misc_feature (916)..(916): n is a, c, t, g, unknown, or other
cggtgggtgncaaccaaagggaggaaaaaaaaaaaaancccactctcactctaaaggaaaccggggggggaccatcataactaaaggatcccccgggctggaggagttcgtctcacccctagaaaaagagcctgacccttacgccttcgctcgcgccgccgccgccgccgccgctacgccccgcacctcgcttcatttcgtgtcgccaagatgacgaagcgcactaagaaggcaggaattgttggcaaatatggaaccaggtatggtgctagcttgcgtaagcaaatcaggaagatggaggtatctcagcattccaagaacttttgcgagttcctgagggaggtttgctgtgaagaggaaagcagttggaatttgagggtgaaaggactgaaaaaaaaaaaaaantaancaaagcttacaccatgaacactgactagtgcgattaacaatatggaacaacgatccccccaccccgaaggaagcaggactgaaagctcgagagaaccctccccaaaataatatgggggatatccaagtaaattgcctccttggtaagagcaggggttggtgggggggccctttatcctgggagggaaaatggtggaaattcacctgggaccttgggcttgtttttggccgagagacccataggcctcctttgggtattttggggatttatagcatctctcggaagttgtagtggatgagagatctggagccgccctcggagggtaacccagagttcccgcccccaatgtaggggaagctccgataagtaaccgcgccggcttcagaccggggagggctccgtgttttataacaacccatgcgtgaaactggggagaagatacactttgggcgggttacaccacatccatgaagagtggcccctgagggagggcgacactccccctcn

SEQ ID NO: 60672 - protein, 64 aa, Zea mays
  misc_feature: Ceres CLONE 1520725
  misc_feature (2)..(65): Pfam Name: Ribosomal_L37ae Pfam Description: Ribosomal L37ae protein family
MTKRTKKAGIVGKYGTRYGASLRKQIRKMEVSQHSKNFCEFLREVCCEEESSWNLRVKGLKKKK

SEQ ID NO: 60673 - DNA, 954 bp, Zea mays
  misc_feature: Ceres CLONE 1520732
  misc_feature (671)..(671): n is a, c, t, g, unknown, or other
  misc_feature (735)..(735): n is a, c, t, g, unknown, or other
  misc_feature (954)..(954): n is a, c, t, g, unknown, or other
gagggggggggaacataaatgaactaaaggaaagcagttagctcaaacataaaataattggtagaggggccgctctagaaaagtggatcccccgggctgcaggagttcgtctcacccctagaaaaaattggaaaaggctgatgtatacaggttaccgtatctatccagtggcgctcctggattcgctttgcttgaagctgccaggaagatcaatttccaagatgtactaagtagaatttccgccggattttcgtccaacggttgggaaaaaccaatactgcttgcatggggaatatctgacaagtacttaccgctctcgatagctgaggaattccagcgagctaaatcccgggcgttgtagaactagagggcgaaaaaaagagcttggtctcatggccgcaagaggaactgtcccgaagaaggttggtgaagggcgcttgaaattccttccctggtagaacatgggccaaagaaacagttatgttcaatcccggcagggggagactatttcaaaaaatgcattgaatggagtggtcctaggactttacacttaaccgtgccctacctaggcccaagaattaggaattaaggcgccttagtggagaatggctttaaaaaattatcagggagcatggatagacgggggtcaagaggaatgtataattttagtnccgaaaggctcttttgtctaattttgatagatattgctcaaacctggggagagaaaagaactcncgcgcataacattgtttaagacccaccacgaattaaaaggagagaggagataggcatgtggggtgagactttcctcggtctctcctttttaaaagagaagatggaaaaagccctggggtctccagaggattattatgctcccctcttgtaatgaataaaataaaattatgacgaggactgtctttggaagggagactcctcttctcacccatgaggggn

SEQ ID NO: 60674 - DNA, 625 bp, Zea mays
  misc_feature: Ceres CLONE 1520733
ctggagctccccgcggtggcggccgctctagaactagtggatcccccgggctgcaggaattcgtctcacccctagaaaaaactaaccgcgtctcctctccagcgcccgccgtcgccgccgccctcctcttggtcccgccgtccgtcgaggtcatcatggtgagggtcagtgtgctcaacgatgcgctcaagtccatgtacaatgcaaagaagaaggggcaagaggcaggtcatgatcaggccgtcgtccaaggtgatcatcaagtttccggaaggtcatggcagcgtcagggatactttggccaagttcagagtacgtggattaaccacaaaacctgggaaaaaattttgggggaaactgaaacgggaaaactaaaacaaaaaggggggggtaaatttacccccccccgtttagatgttttggggtaaaaaagaaaaatccaaaaggtttggaaccgggaggggttggcttttccgtgtttccccaaggtttggggctattaatggggggtattaaacaccccccggcggggaaatttttggtgactcccaagtatacgcccctcacccacaaaaaccttgttaaagaaaaaaacccctgggggctttttttttaaaaaataaaa

SEQ ID NO: 60675 - DNA, 708 bp, Zea mays
  misc_feature: Ceres CLONE 1520734
  misc_feature: Encodes the peptide sequence at SEQ ID NO. 60676
  misc_feature (593)..(593): n is a, c, t, g, unknown, or other
  misc_feature (643)..(643): n is a, c, t, g, unknown, or other
  misc_feature (708)..(708): n is a, c, t, g, unknown, or other
caaagctggagctccccgcggtggcggccgctctagaactagtggatcccccgggctgcaggaattcgtctcacccctagaaaaaaagaccaccgacgcgtagcacagtccattattgccgtctcccttttgcgtgagcaaagaaagagagcgagaagagcagtcgccatgtctggcatcatccacaagatcgaggagaagctccacatggggggcgaccacaagaataaggaggaggagcaccacaagaaggccgaggagcaccacaagaaggaggagggggagcaccacaagaaggacggcggggagcacaaggaaggcatcgtggagaagatcaaggacaagatcaccggcgagcacggtgactagtccggcgaccatcaggaaaagaaggacaagaaaaagaagaaccacggcgagggccacgaccacgacggcgggcacagtagcagcagcagcgacagcgactgagatctggtgtcccctcacaggtgcaacacatgttatgcttgctgggatggaggattcataccagctggattgctgatgtaattgtttcactcggggttattgcctggactctctgcttttanaaatccaatgagatacaaaggaacatcccggtccgggcattggttttggnctggcccattgtgaacactttgtaacaccatcccaccttataaattatgcgccccgccggcgccn

SEQ ID NO: 60676 - protein, 66 aa, Zea mays
  misc_feature: Ceres CLONE 1520734
MSGIIHKIEEKLHMGGDHKNKEEEHHKKAEEHHKKEEGEHHKKDGGEHKEGIVEKIKDKITGEHGD

SEQ ID NO: 60677 - DNA, 500 bp, Zea mays
  misc_feature: Ceres CLONE 1520737
  misc_feature (207)..(207): n is a, c, t, g, unknown, or other
  misc_feature (328)..(328): n is a, c, t, g, unknown, or other
  misc_feature (329)..(329): n is a, c, t, g, unknown, or other
  misc_feature (377)..(377): n is a, c, t, g, unknown, or other
  misc_feature (378)..(378): n is a, c, t, g, unknown, or other
  misc_feature (391)..(391): n is a, c, t, g, unknown, or other
  misc_feature (392)..(392): n is a, c, t, g, unknown, or other
  misc_feature (393)..(393): n is a, c, t, g, unknown, or other
  misc_feature (417)..(417): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
aagctggagctccccgcggtggcggccgctctagaatagtggatcccccgggctgcaggaattcgtctcacccctagaaaaaccggcatcttcctcgatcggcaagacgataggatggggttcccacctgctggcgttcgtgggcggcaagggggcctcatgcaagcgtcaaactgtcgcgcgtcagctcgggtgcgtcgcgcactngcgaagcctccctctgtacggtgctccccgcaaacccgggttaaaaggcccttgggcggggccccctggaacacaagggagccgggggggttcaaaaaaaatttccccccccttttttaannttttaaaaaaaaaaaaccccccggaaaaaaagttaaaaaaaaaaaaannccccccccccccnnnggggggggcttttttttttctttntnnnnncccccccccccccccccggggcggggggaaaaaaaagagaaaggcgggcgggggggggccccttcttttattaataa

SEQ ID NO: 60678 - DNA, 667 bp, Zea mays
  misc_feature: Ceres CLONE 1520739
  misc_feature: Encodes the peptide sequence at SEQ ID NO. 60679
aaagctggagctccccgcggtggcggccgctctagaactagtggatcccccgggctgcaggaattcgtctcacccctagaaaaagaccggatcacccacgtcatgtattcgctcgggccggacggtggcgatactaaccgaggtttaggctgcagatggtccagccattgccagcgccagtacaatggagtacgtctccccttgactacacctcccttgcattacaagaactggcttccttgcaaagacacttgggattcctccttgtgttatccctgctgtaagagtcggatttgtcagaacactcctggaatagcaagaatctaaaattggaaagcagcacatcaaacttctatcacatgttactctcacattacgagagcagtttgtcaaagctaatggtccgctgctggagttatctatgagctttccaggtgacttagagatcgtagaagaacactccggtaacctgagagtttataagactgcacagaccaagacggcgaaccatatgcacggacttttcacaacgttgacatacaacatcatcatcggtgtgtcaaaaggattccactacaagcttcaattagtacgtgtcggagcacgtgctcgagtcgcaaggcaaccatctcgtgatgaacctggcattctcccaccctgttcggat

SEQ ID NO: 60679 - protein, 82 aa, Zea mays
  misc_feature: Ceres CLONE 1520739
MSFPGDLEIVEEHSGNLRVYKTAQTKTANHMHGLFTTLTYNIIIGVSKGFHYKLQLVRVGARARVARQPSRDEPGILPPCSD

SEQ ID NO: 60680 - DNA, 734 bp, Zea mays
  misc_feature: Ceres CLONE 1520740
  misc_feature: Translation starting site: 211
  misc_feature (253)..(253): n is a, c, t, g, unknown, or other
  misc_feature (303)..(303): n is a, c, t, g, unknown, or other
  misc_feature (386)..(386): n is a, c, t, g, unknown, or other
  misc_feature (387)..(387): n is a, c, t, g, unknown, or other
  misc_feature (388)..(388): n is a, c, t, g, unknown, or other
  misc_feature (389)..(389): n is a, c, t, g, unknown, or other
  misc_feature (394)..(394): n is a, c, t, g, unknown, or other
  misc_feature (396)..(396): n is a, c, t, g, unknown, or other
  misc_feature (400)..(400): n is a, c, t, g, unknown, or other
  misc_feature (401)..(401): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (416)..(416): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (491)..(491): n is a, c, t, g, unknown, or other
  misc_feature (497)..(497): n is a, c, t, g, unknown, or other
  misc_feature (513)..(513): n is a, c, t, g, unknown, or other
  misc_feature (531)..(531): n is a, c, t, g, unknown, or other
  misc_feature (532)..(532): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (619)..(619): n is a, c, t, g, unknown, or other
  misc_feature (689)..(689): n is a, c, t, g, unknown, or other
  misc_feature (709)..(709): n is a, c, t, g, unknown, or other
aaagctggagctccccgcggtggcggccgctctagaactagtggatcccccgggctgcaggaattcgtctcacccctagaaaaaagagggagagcagtcaccaaaccaaaaccgctctcgagtctccatccattctctccgctcatccgcagctctcgagtctccagctctagctagccttagcctcgtccaagggacgaaggggccaccatgagcgtggtgatcctggacggctccacggtgcgcggcttcntggcggacgaggcggccttcgcgcgcagcctggacgcgcggttcgccgcnctggacgccaacggctacggcgtgctgtcccgcgccgagctccggggtttttttccacccctcccggcgggggggaggggggnnnntttcngntccnncccaacccnnncccncttcccccaacaaggaagtccgcggctctacgaaggcgggggttcgaaccaaatccaacgcccaaccccannngncgtccntgagacggggtgtaanttcccccaaaagagaatnngccgcagaccgggtcaccggtggccccgagggggcccgggcccgcgacccgaagcggggnnnccggaagagaggaaggaggtgaggnggtgttcttggcccaaaagggagccgagcctccaagcttcgcctgggtattcatcccccgaggccagaanttaaacctgcgcgccgtggngttccgacgggggcagagcggacag

SEQ ID NO: 60681 - DNA, 699 bp, Zea mays
  misc_feature: Ceres CLONE 1520742
  misc_feature: Translation starting site: 164
  misc_feature: SWISSPROT Homolog: EC 1.15.1.1 Superoxide dismutase
aaagctggagctccccgcggtggcggccgctctagaactagtggatcccccgggctgcaggaattcgtctcacccctagaaaaagtttccatcacgatagtttgtacctcggagcagttgcacccggatctccgatccgttataacataaacaatgttcacggatgctggtgtgcttaggagacacctatagcgttaaaggcaacatgtttttcactgaagtgggagatggccctaccactgtcaccggaactgtctctagactcgagcctgccctctatgggtttgatgtgcaggcgcttgtggacacacatcaatggctgcatgtcaactggaccacactacaatgctgcgagcaaggaacatctagcaccacaacatgagaaccgtcatgcccgtgatctatgaaaatgtaaccgctggagcacatggtgttcgcacacattactgttatccaagccagatcccactgactcggccaaactgaatcattgacagagctgtagttgctcacgctgatcacgatgatcttgaagagagtggacacgaactcagcaagaggactgacaacgatagcgaacatgatgattatgcgatcatcgaactccagagctgaactgaaacgaatgctcgctggacttcctggggctcttgagagtgtcgtcaccactccccagcagaggtcgactaatctccctag

SEQ ID NO: 60682 - DNA, 707 bp, Zea mays
  misc_feature: Ceres CLONE 1520744
  misc_feature: Encodes the peptide sequence at SEQ ID NO. 60683
  misc_feature (386)..(386): n is a, c, t, g, unknown, or other
  misc_feature (387)..(387): n is a, c, t, g, unknown, or other
  misc_feature (388)..(388): n is a, c, t, g, unknown, or other
  misc_feature (389)..(389): n is a, c, t, g, unknown, or other
  misc_feature (391)..(391): n is a, c, t, g, unknown, or other
  misc_feature (396)..(396): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
aagctggagctccccgcggtggcggccgctctagaactagtggatcccccgggctgcaggaattcgtctcacccctagaaaaactatggggtggaccgggagggtcggcacaggacatcacggcggagcggccgccgcagcgtctgcacagcgtcaccgttcgtgctggcgtcgccgtcaactccatcgagttcacctatactgacagcgctgggcagaggcgcgccgctgggcgatggggtggactcgggggcaatgttcgaacgatcgaccttggcgactccgaggatgtcagggaagtctcgggaacatacggcgcatttgaaggtgccactacgctgacctcgctcatgctcgtcacccccagcagagggggggggcccctnnnntntcaanaaacnnnacccctttctccgtcacggagcccattcggcggcagcatccggggggattctatgccccggggcgggaaaccaggctctctccaatcctatcggtgttttacttgccgccaaaattaaatcccgaaaaagagccggggaagcttactgttgcctaccgaaccggctccatccccccaatatctttttatttcaattccttcatccacccggcgggggaaattaaataacacggggctcttgtgtccctttgcccgaaaaagaagaaaaatcgtgcgcctttcgaggtccccaattccccttaag

SEQ ID NO: 60683 - protein, 172 aa, Zea mays
  misc_feature: Ceres CLONE 1520744
  misc_feature (129)..(129): Xaa is any aa, unknown, or other
  misc_feature (130)..(130): Xaa is any aa, unknown, or other
  misc_feature (132)..(132): Xaa is any aa, unknown, or other
  misc_feature (134)..(134): Xaa is any aa, unknown, or other
AGAPRGGGRSRTSGSPGLQEFVSPLEKLWGGPGGSAQDITAERPPQRLHSVTVRAGVAVNSIEFTYTDSAGQRRAAGRWGGLGGNVRTIDLGDSEDVREVSGTYGAFEGATTLTSLMLVTPSRGGGPLXXQXTXPLSPSRSPFGGSIRGDSMPRGGKPGSLQSYRCFTCRQN

SEQ ID NO: 60684 - DNA, 622 bp, Zea mays
  misc_feature: Ceres CLONE 1520750
  misc_feature: Encodes the peptide sequence at SEQ ID NO. 60685
ctggagctccccgcggtggcggccgctctagaactagtggatcccccgggctgcaggaattcgtctcacccctagaaaaactctttctcttagactatctgccgctccagcctttcgctagggtttatccaccggcggcgcgcgcgacggcggcaagatggtgcagcgtctgacctaccgcaagcggcacagctatgccacgaagtccaaccagacgcgggtcgtcaagacccctggtggcaagctcgtgtaccagtacaccaagaagagagccagcgggcccaagtgtcccgtgaccgggaagaagatccagggcattccccatctgaggccagctgagtacaaaaggtccaggttgtctaggaaccgcaaaactgtgaaccgtccctatgggggagtactatctggaactgcagttagagaaaggatcatccgtgctttcctggttgaagagcaaaaaaatgtcaagaaggtgtttgaattaccgaagaccaaagacaagacttcctcaaaaaagtaacctctgaaacaaaagtggaccactccttctgccacaagggaaaacattttttgtccaacagttattaaacaaggggctaaatctccttcaacccggttccat

SEQ ID NO: 60685 - protein, 120 aa, Zea mays
  misc_feature: Ceres CLONE 1520750
  misc_feature (5)..(103): Pfam Name: Ribosomal_L34e Pfam Description: Ribosomal protein L34e
MVQRLTYRKRHSYATKSNQTRVVKTPGGKLVYQYTKKRASGPKCPVTGKKIQGIPHLRPAEYKRSRLSRNRKTVNRPYGGVLSGTAVRERIIRAFLVEEQKNVKKVFELPKTKDKTSSKK

SEQ ID NO: 60686 - DNA, 684 bp, Zea mays
  misc_feature: Ceres CLONE 1520755
  misc_feature: Encodes the peptide sequence at SEQ ID NO. 60687
  misc_feature (568)..(568): n is a, c, t, g, unknown, or other
aaagctggagctccccgcggtggcggccgctctagaactagtggatcccccgggctgcaggaattcgtctcacccctagaaaaagtccaccagctgagctgagctgcgcccgtttttagcgagcgagacaggtccgcgcgcgcgtgcgccggcgaggattggattggaaccgtcgcccgtcggtcgtcgatggggatccacctggtggcgttcgtggcggcgaggggcttcctgcaggtgttccaggtgtcggcgccgctgctgtggccgctcaacctctggctgccgctcgcgcgccacctgcccgaggcctgcgccgccttctacgacgccctcgtctcgcacgccgccagcctgcgcgccaccgtccggcgccgccgacgcgacagcggggacgccctcgacgagtacctccgcagcgccatcatgctaaccctctccgactgagactcttgagccgagcgcgcggccaccggccagtgccaggcaacggccagtaccggaggcgggcgtgcacaggccggccgcccggcgcgcgctgtgatgtgagtagcatagctaggatctngtgtatctcgtttgtttttgttgttttcccttggctcgctctttctttgctgcttttcggtcggtgcctaatctagctatctactactagcactagctagctagcatctcaagact

SEQ ID NO: 60687 - protein, 85 aa, Zea mays
  misc_feature: Ceres CLONE 1520755
MGIHLVAFVAARGFLQVFQVSAPLLWPLNLWLPLARHLPEACAAFYDALVSHAASLRATVRRRRRDSGDALDEYLRSAIMLTLSD

SEQ ID NO: 60688 - DNA, 799 bp, Zea mays
  misc_feature: Ceres CLONE 1520757
  misc_feature (411)..(411): n is a, c, t, g, unknown, or other
  misc_feature (412)..(412): n is a, c, t, g, unknown, or other
  misc_feature (420)..(420): n is a, c, t, g, unknown, or other
ggccgctcttacactagtggatcccccgggctgcaggatattcgtctcacccctagaaaaagagctgcggcggccgcatcgactgttagggcgaaaatccgttctagtctctcggcgattttcggcaggcggaggcagcaggatctgcgggaaggatttcgtgtcgagatggctgggcgcaaggaactgcactcgacctggcgaaattcgtcgacaaaggcgtccaggtgaagctcaccggcggccgccaagtgacatgaactcctaagggatatgaacaactactccgctttattgctagatggaagcgatagaaaaagaaaaaaaaatcaatatttttcccccccccccttgggggggggggggggcccctttgggaatatattgtaacccaaccgtccgcgtaaaaannaaaagaantagaagggaaaggaggaggacccgagataaccacccccccccccgctttcccacctgaggacggagagcttatgccttccttacccctacaacaaaaaacaatggtacgcccgagggggaaagagtgtacacctgcttctctccgcggctacccttgaaattcatgcgcgctcaggtgggaggggatgggatattacgcgcttgacaagggagacgacttattgtgcattgcgtatggcaaccctctgacatggcagagccatgccccggctgctccatgaacgacagctcaacctgcttcgaccggcccccctccaccccccacaggactcccacggcactccagaggtccgtgccggtgtcacggaccggtggttgg

SEQ ID NO: 60689 - DNA, 680 bp, Zea mays
  misc_feature: Ceres CLONE 1520767
  misc_feature: Encodes the peptide sequence at SEQ ID NO. 60690
  misc_feature (379)..(379): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
gctctagaactagtggatcccccgggctgcaggaattcgtctcacccctagaaaaatccactctcatcaccagctaagaacagggcttcgtctcaatggaaggcaaaacagggcagctcaggtgctgtttcgtcgccatcgtgctcgtcctgggtcttgtccttgagtcccaccaggctgaagctggaggcaaatggtgctgcgaaaccgccaccggaaaataccattttaatcgctgcgttgactcgggtttggtcgacaatattgggttctgtgcgggtaatgccggttgcatcattatggaagacagatgtggaggccgttggccggtgcctgctcgtgatgcgctttcgctggatgtcatttgattaattataancaagtacgtgaagaaacgagggccaaacgactgtcgtccagcgattggttatttgtgaacttgtcgtttgtcttcttatttcacttttccataagccccttcggggaatgtcatccccctccaaggctgtccactggtactgatacaaatctatatttcaaaaaagaccgggcccaacgtgggtatttgtccctaaaaaaaaaaaaggaaaannnnncnnnnagcggggccgccgaggccccctttcccccttaaggaggccaataaccgcgcccctggggccccttttaacacgcgtgag

SEQ ID NO: 60690 - protein, 90 aa, Zea mays; identical to SEQ ID NO: 53771
  misc_feature: Ceres CLONE 1520767

SEQ ID NO: 60691 - DNA, 711 bp, Zea mays
  misc_feature: Ceres CLONE 1520768
  misc_feature: Encodes the peptide sequence at SEQ ID NO. 60692
  misc_feature (402)..(402): n is a, c, t, g, unknown, or other
ctccccgcggtggcggccgctctagaactagtggatcccccgggctgcaggaattcgtctcacccctagaaaaagacctgcagccaaccatctaccagcgactcagcgagcgagagcagcacacactgcacgcagctagctaggagcagcagcagcggcggcgatggcggcctccatgatctcctcgtcagctctggcggtggcgcctcagggcctgccgcccctcggccgccgcgcctcctccttcgccgtcgtctgctccaagaagaagatcaagaccgacaagccctacgggattgggggtggcctgaccgtcgacgtcgacgccaacgggagaaagggcaagggcaagggcgtgtaccagttcgtcgacaagtacggcgcggacgtcgacggatacancccaatctacaacgaggatgactggtctcccaccggcgacgtctacgtcggtggaaccactgggcttctgatctgggccgtcacctcgctgggatcctcggcggcggcgcccctcctcgtctacacaccagcgccctctccggctaaggatatccaatgcatgcgcttcttgcgattcctcatgtaaaatcagggtgtcctgcctatatctagccccaggaatgctccaccttcgtcatgaaacataatcaggggtccccttcttaaataattttggtggctttttttcaaaaaaaaaaaaaaccgggg

SEQ ID NO: 60692 - protein, 141 aa, Zea mays
  misc_feature: Ceres CLONE 1520768
  misc_feature (32)..(127): Pfam Name: PsbR Pfam Description: Photosystem II 10 kDa polypeptide PsbR
  misc_feature (80)..(80): Xaa is any aa, unknown, or other
MAASMISSSALAVAPQGLPPLGRRASSFAVVCSKKKIKTDKPYGIGGGLTVDVDANGRKGKGKGVYQFVDKYGADVDGYXPIYNEDDWSPTGDVYVGGTTGLLIWAVTSLGSSAAAPLLVYTPAPSPAKDIQCMRFLRFLM

SEQ ID NO: 60693 - DNA, 693 bp, Zea mays
  misc_feature: Ceres CLONE 1520773
  misc_feature: Translation starting site: 209
  misc_feature: Pfam Name: TFIIA_gamma_N Pfam Description: Transcription initiation factor IIA, gamma subunit, helical domain
  misc_feature: Pfam Name: TFIIA_gamma_C Pfam Description: Transcription initiation factor IIA, gamma subunit, beta-barrel domain
cagagctggagctccccgcggtggcggccgctctagaactagtggatcccccgggctgcaggaattcgtctcacccctagaaaaactctccctttctttcccgcggcgacggtgacgacgaccgcgcgagcgccgccgactccctactgcatcaggtgcctcggccttcgtcgtgctctccgccggcaacgagtatagacgggcgcgcatggccaccttcgagctgtaccggaggtccaccatcggcatgtgcctcaccgagacgctcgacgagatggtctccaacggcaccctcagcccggagctcgctatccaggtcctcgtccagttcgacaagtccatgacggatgctctggagaaccaagtgaagagcaggttactgtcaggggtcacctgcacacctacaggttctgtgacaacgtgtggaccttcatcttgacagacgccagcttcaagaatgaggaggcccggagcaggtgggcaagttaaaaattggggcctgtgattccaaatttgctcggacaataggctgtgttccccccaaggtcaaggaggaaagcttttaagtgcgggcaagggcgggtctgttctccccgccccctggaacgcccttgggccccccgggagggggggtctgcttccggacgcttgtacccccctatgggtttccccccaaacgggttttctattttc

SEQ ID NO: 60694 - DNA, 711 bp, Zea mays
  misc_feature: Ceres CLONE 1520774
  misc_feature: Encodes the peptide sequence at SEQ ID NO. 60695
gcggtggcggccgctctagaactagtggatcccccgggctgcaggaattcgtctcacccctagaaaaaaacagcgtcccgaatcctcgaagcctccgacccccttcttctctccctccgccgccgtgtgctcacgcaaggaacaagcgacatgggcgtgctacactttcctgtgccgcaacaacggcagcgagtgtaccgccaagcagcactccgacaagatctaggcttccgccgctaccccatacgagctgcagcgccgcctcgtcgccgctgcctccgcggccgactctgcctacggcgtccagtcttccttctccatggtcacccccagctccgccgtgttccaggtgatcgacggtgctgttggtggaggtgcaatgatggtgagcggaagtggcgtccgtgctgctgcatctggtggtgctgctgccgaggctcacaacgaggagaagaaggaacagcagaacgaagacatcgaccaccacatgggattctccctgttcaactatagttgagtgagtcatctgtatctcagaagcggcgctttgatcctgatgccatagttagttttgctgtgctagctgagaacctgaagaactcttgataattgctcacagcgacctgctccagtttatgacagaagttgatgaaacggtcgaatcatatattctcattgcatttgctgagattatacagtgccaatacgtac

SEQ ID NO: 60695 - protein, 65 aa, Zea mays
  misc_feature: Ceres CLONE 1520774
MVTPSSAVFQVIDGAVGGGAMMVSGSGVRAAASGGAAAEAHNEEKKEQQNEDIDHHMGFSLFNYS

SEQ ID NO: 60696 - DNA, 460 bp, Zea mays
  misc_feature: Ceres CLONE 1520783
  misc_feature: Encodes the peptide sequence at SEQ ID NO. 60697
attagctgggagctccccgcggtggcggccgctctagaactagtggatcccccgggctgcaggaattcgtctcacccctagaaaaaaccatcacacagcaatccacacaagcacttcgacgtcacacgggcgctgcgcacagacacaccaagcgtcggcaccaatggcttactaccaggaggtggactactgctcggaggaggtgaggtcggtggccccggccgggcttcggccgccacggcgggcgggcgttcccagcagcaccttcctccaaggaaaaagtcgaggaggcaaaaggtttagggcgggccaccacacaccctggcccagggggccggttttgggggggaaaaccggggcaaaaaaaaccaacccccccccggggaattccccaaaacccgggggaaaattccccccccccggggggttaatatttaaaaccccccccgggggggggggc

SEQ ID NO: 60697 - protein, 99 aa, Zea mays
  misc_feature: Ceres CLONE 1520783
MAYYQEVDYCSEEVRSVAPAGLRPPRRAGVPSSTFLQGKSRGGKRFRAGHHTPWPRGPVLGGKTGAKKTNPPPGNSPKPGGKFPPPGGLIFKTPPGGGG

SEQ ID NO: 60698 - DNA, 699 bp, Zea mays
  misc_feature: Ceres CLONE 1520790
  misc_feature: Encodes the peptide sequence at SEQ ID NO. 60699
  misc_feature (202)..(202): n is a, c, t, g, unknown, or other
  misc_feature (237)..(237): n is a, c, t, g, unknown, or other
  misc_feature (254)..(254): n is a, c, t, g, unknown, or other
aaagctggagctccccgcggtggcggccgctctagaactagtggatcccccgggctgcaggaattcgtctcacccctagaaaaactacactaaacgatctttcaaattggtcaagactctcaagtttatggccccttctatatggtaccagttgttgtttcattgaatttgcttcattaataggctcacgattcgactttgnatcgtatggatttggtaccagatcaaagtctagancagcggaactaattttnacagctggtacggtaacaatgaaaatggctccatctttagtgcgattatttgagcaaatggttggacccaaaatacgtcattgctatgggaacccgtactatttacagccctaaaaaaaaagtttcaaaaccaatttccaataaaatgttccaagaaaattaaaaaattaatttcccggggaaactttccctggcgggtttgcccccccaaaaccaaagacgtttttataaatgccccaaaaaaaaatttcttaaaaaaaaaacgcccggaaaaaatttttgggggacgaaccccttttttaaaaaatcaaaaaaaaaaaaaaatttttttttacccccccccaaaaaatttttttgttggggggggagttccccccggggaatattttaaaaaaaaaaattggttttttaaaccacaccccccctctttagaaaaacacctccc

SEQ ID NO: 60699 - protein, 31 aa, Zea mays
  misc_feature: Ceres CLONE 1520790
MKMAPSLVRLFEQMVGPKIRHCYGNPYYLQP

SEQ ID NO: 60700 - DNA, 728 bp, Zea mays
  misc_feature: Ceres CLONE 1520792
  misc_feature: Encodes the peptide sequence at SEQ ID NO. 60701
  misc_feature (728)..(728): n is a, c, t, g, unknown, or other
ccccgcggtggcggccgctctagaactagtggatcccccgggctgcaggaattcgtctcacccctagaaaaaaaaaaagaacggtccgtgctcggctgccgtgaatctctctcacctccccgaagcaatcgagcggggcagcgcgccaggaaggatcggaggagacgccatcaatcagcacttgcacgcgcgcggtcggccgcaggtggaggaagaagatgggcctgtgctcgtgctgctgccggtgcctggagctgctgtgctcggtcctcctcccgcccctcggcgtctgcctccgccacggctgctgctccatggagttctggatcagcgtgctgctcaccatcctcggctacctccccggcgtcctctacgccgtctacgtcatctgctccgtcaacccccaccgccaccgcgacaacgacgactacgtctacgtcgcatgacaagatggaccggtccccgtggtgctctggtccgtgtctctgctgctacctccgtccgctgggttgggggcatctttttgtttgggttagtaaactaaatccatccctgtggccttctggaaactgtaaattaatatgtccaatctgacaatctgggacaaattctttccataaactaaaaactggtggttgcgggatcgggggaattaattaggggtcactttgctccctccgttcaagttggggggggggaaatggaacctgccaaaggggtaaaaaatn

SEQ ID NO: 60701 - protein, 75 aa, Zea mays
  misc_feature: Ceres CLONE 1520792
  misc_feature (8)..(59): Pfam Name: UPF0057 Pfam Description: Uncharacterized protein family UPF0057
MGLCSCCCRCLELLCSVLLPPLGVCLRHGCCSMEFWISVLLTILGYLPGVLYAVYVICSVNPHRHRDNDDYVYVA

SEQ ID NO: 60702 - DNA, 626 bp, Zea mays
  misc_feature: Ceres CLONE 1520796
  misc_feature: Encodes the peptide sequence at SEQ ID NO. 60703
aagctggagctccccgcggtggcggccgctctagactagtggatcccccgggctgcaggaattcgtctcacccctagaaaacccattttcttcgaggcgaggagagcgtgaaagacagggcaccggcagcgacgatgtcggggcgcggcaagggcggcaaaggtctgggcaagggcggagcaaagcgccaccggaaggtgctccgtgacaacatccagggcatcaccaagcccgccatccggaggctggctcggaggggcggcgtgaagcgcatttcggggcttatctacgaggagacccgcggcgtcctcaagatcttcctcgagaacgtcatccgcgacgccgtcacctacaccgagcacgcacgccgcaagactgttaccgccatggacgtcgtctacgcgctcaagcgccagggccgaaccctctacggcttccggaggctaagctggaacgcctcttctccttgctgtcctgggatgcctgtttgttgttaaggttaccttccgttagttccctggccggtaacgtgttggactaattgttaagaacaatcccgggaagttgggtttccaaatggaatccacatccttaatcgtccaaaaaatgaaaatcgaatccccggg

SEQ ID NO: 60703 - protein, 120 aa, Zea mays
  misc_feature: Ceres CLONE 1520796
  misc_feature (25)..(94): Pfam Name: Histone Pfam Description: Core histone H2A/H2B/H3/H4
MSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFRRLSWNASSPCCPGMPVCC

SEQ ID NO: 60704 - DNA, 620 bp, Zea mays
  misc_feature: Ceres CLONE 1520799
  misc_feature: Encodes the peptide sequence at SEQ ID NO. 60705
ggagctccccgcggtggcggccgctctagaactagtggatcccccgggctgcaggaattcgtctcacccctagaaaaaacggcagctctgaagggaaagagatcgatcgtatctgcggaacaagcagcgaaggatcggagcctatccaatggccgagggcaacagctgctccggcggcgacctgttctccagcggcaagctggtggcgggggccgccgtgtcggtgttccttcataagagcgtggagaacgtccacaagcatgaggtcgccggcgcggcagccgagctcctgcacgcggcgtccgcgtacggtaagctcgacgacaagccggccgggcagtacgtcgagaaggccgaggggtacttgaaggagttcagcgcgggcgcgggacacgccaccgagcatgagtcagctgcggcggcagcaggcgacgacgcggcccccaaccaacggggcccggaggcgcccaaggagccggcgagggtgcctgcgccggccccgtaggaagcaccacagcctccggagggctttcggcctccgcgacctctttgagggcacccagctactgttgggagggtaagcccatggccgccggggaggaaacccccggcgggctttg

SEQ ID NO: 60705 - protein, 118 aa, Zea mays
  misc_feature: Ceres CLONE 1520799
MAEGNSCSGGDLFSSGKLVAGAAVSVFLHKSVENVHKHEVAGAAAELLHAASAYGKLDDKPAGQYVEKAEGYLKEFSAGAGHATEHESAAAAAGDDAAPNQRGPEAPKEPARVPAPAP

SEQ ID NO: 60706 - DNA, 717 bp, Zea mays
  misc_feature: Ceres CLONE 1520800
  misc_feature (490)..(490): n is a, c, t, g, unknown, or other
atagctggagctcaccgcggtggcggccgctctagactagtggatcccccgggctgcaggaattcgtctcacccctagaaaaaaccaaactgctagcagcgtcagcgcccgaccaaatttcccccctcacctccccctctcccgtcgtcggcatggccaccgacgtgctgcgcgcgcgcaacatcctcttgccggcgccgccgcaaaggatccgggcggcggcggcggcgcgccggaagggagctggtagcgacagccaccaccccggcgccaccgccatcatgaagaggtcgccagctgtcaggacttcgtcccccggcgggcgggccgaagaatccccaggagggcaggagggccaccccccccccccccccccctgaggcgcgaggccatccgtgcctctaaccttcccccacaaccaccacccccgcaccctgatttggccgcgcggatgggggtggcaaccaacacgccccccgcgcccgtggtnctttgaaccggtggcgtgtgcgaagggtgcgcccagccgcgcacaccccactaccttaaagataaaatcccgcgcagcgcggaggttggcgggcggggggcgcaggtggcctggtcgctccccacaacaaagcgggggggcgaaaaccacccccccttccaggcccgcccccccgacacacacacgcgcgggccccaacccgctccgcagcgaaacccccactgcgc

SEQ ID NO: 60707 - DNA, 687 bp, Zea mays
  misc_feature: Ceres CLONE 1520801
  misc_feature: Encodes the peptide sequence at SEQ ID NO. 60708
  misc_feature (493)..(493): n is a, c, t, g, unknown, or other
  misc_feature (494)..(494): n is a, c, t, g, unknown, or other
  misc_feature (505)..(505): n is a, c, t, g, unknown, or other
  misc_feature (526)..(526): n is a, c, t, g, unknown, or other
  misc_feature (527)..(527): n is a, c, t, g, unknown, or other
aaagctggagctccccgcggtggcggccgctctagaactagtggatcccccgggctgcaggaattcgtctcacccctagaaaaagtgctttcttagaggtgggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtaccgtggtggccgtggaagcnngcgctacggcngtggcgggcgccctgatggcnngtgcggctacgggcgtgggcgcggctacggtgggcgcggggctacggtggtgttggcgcggctacggcggtgcaaccgtgggcggcggctacgcaactcgaacggaactggagaactgaacgggggggcccccccggccaagttatctggtccctaccgg

SEQ ID NO: 60708 - protein, 168 aa, Zea mays
  misc_feature: Ceres CLONE 1520801
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (104)..(104): Xaa is any aa, unknown, or other
  misc_feature (108)..(108): Xaa is any aa, unknown, or other
  misc_feature (115)..(115): Xaa is any aa, unknown, or other
MAASDVEYRCFVGGLAWATDDHSLHNAFSTYGEVLESKIILDRETQRSRGFGFVTFSTEEAMRNAIEGMNGKELDGRNITVNEAQSRGGRGGGGGGYRGGRGSXRYGXGGRPDGXCGYGRGRGYGGRGATVVLARLRRCNRGRRLRNSNGTGELNGGAPPAKLSGPYR

SEQ ID NO: 60709 - DNA, 656 bp, Zea mays
  misc_feature: Ceres CLONE 1520804
  misc_feature: Encodes the peptide sequence at SEQ ID NO. 60710
  misc_feature (656)..(656): n is a, c, t, g, unknown, or other
aagctggagctccccgcggtggcggccgctctacactagtggatcccccgggctgcaggaattcgtctcacccctagaaaaaatcttctcccccagctccccagcaccagtccccaattatttggcctccgtcagagaggggagaaagacccgttcgaggcggcggcgatgtcggggcgcggcaagggcggcaagggtctgggcaagggtggagccaagcgccaccggaaggtgctccgcgacaacatccagggcatcaccaagccggcgatccggaggctggctcggaggggcggcgtgaaacccatctcggggctcatctacaaggagacccgcggcgtgctcaagatcttcctcgagaaccccctccgggggggggggggcgtgcaccgatcactcgctcctcaacccccccccggccctggatgtcgtccacgcgctcaagcaccagggaccgaccccctaccgcttcggaaggttagcggcctcctccaaccgggcgactgctcatggtgaacgtctcttcgcccctcggggcgctaagtttcccgcgcctccctgatgtcataccatttcctcttcttcctccatcgacgaaatgcctggtccgccctcccctccctgcgctttggcggacgccctccgtgcattcgtcn

SEQ ID NO: 60710 - protein, 115 aa, Zea mays
  misc_feature: Ceres CLONE 1520804
MSGRGKGGKGLGKGGAKRHRKVLRDNIQGITKPAIRRLARRGGVKPISGLIYKETRGVLKIFLENPLRGGGGVHRSLAPQPPPGPGCRPRAQAPGTDPLPLRKVSGLLQPGDCSW

SEQ ID NO: 60711 - DNA, 677 bp, Zea mays
  misc_feature: Ceres CLONE 1520805
  misc_feature: Encodes the peptide sequence at SEQ ID NO. 60712
aagctggagctccccgcggtggcggccgctctagaactagtggatcccccgggctgcaggaattcgtctcacccctagaaaaaaccaggcaccagcatagatctcgttctcgccactattattctgcacagcaacgcatcaagccttctagaaccatctcgccgccgccacaccacaacccgtcgaagcgaagcaagcaatggccggagtcggatcgaaggccctcgccgttgccgccgttctggcggccgtctccctctcggtggccgccgcggccgaggcgccggcgcccagccccgtctccgccgccgtcgcggcgtcgtcgcccttcgccgcggccctcgtcgcctccgccgccgccttcctcttcgccgccccccgccactgagccgatggggcctcgtgcctgcaggctacctaggagtactttcgccgctgctgccgccgcccgcctagatctatttattggaatgctatcccgtagtactaagtagtagtggaaatttctttcggtggctggtcgggtcccccgtcgcaattttgggtcggaatcggggtttcccttggtggcagggaggggttttcctatacccatggtcaccggatagccaattttggggggaacccccatccccccccattagtaaaaataagaaccccctggactaattctgcgg

SEQ ID NO: 60712 - protein, 62 aa, Zea mays
  misc_feature: Ceres CLONE 1520805
MAGVGSKALAVAAVLAAVSLSVAAAAEAPAPSPVSAAVAASSPFAAALVASAAAFLFAAPRH

SEQ ID NO: 60713 - DNA, 705 bp, Zea mays
  misc_feature: Ceres CLONE 1520806
  misc_feature (235)..(235): n is a, c, t, g, unknown, or other
  misc_feature (360)..(360): n is a, c, t, g, unknown, or other
  misc_feature (386)..(386): n is a, c, t, g, unknown, or other
  misc_feature (391)..(391): n is a, c, t, g, unknown, or other
  misc_feature (399)..(399): n is a, c, t, g, unknown, or other
  misc_feature (522)..(522): n is a, c, t, g, unknown, or other
  misc_feature (526)..(526): n is a, c, t, g, unknown, or other
  misc_feature (527)..(527): n is a, c, t, g, unknown, or other
  misc_feature (529)..(529): n is a, c, t, g, unknown, or other
  misc_feature (530)..(530): n is a, c, t, g, unknown, or other
  misc_feature (534)..(534): n is a, c, t, g, unknown, or other
  misc_feature (535)..(535): n is a, c, t, g, unknown, or other
  misc_feature (545)..(545): n is a, c, t, g, unknown, or other
  misc_feature (578)..(578): n is a, c, t, g, unknown, or other
gcggtggcggccgctctagaactagtggatcccccgggctgcaggaattcgtctcacccctagaaaaaactctctcttgtctcccagtttctaaccctagccgccaaggccaagctccctcccaagtccaaagtcccaaactgctcgtatgcggtgcaaggctgcaggcatccacctccatcaggcgctgacccagtttccgccatccaccaggcgtcctcagaatacggtgcanggctgccgagcagcgagcagcaagccgccgagcagcgagcactgaggactgtcgagcagccgagcaccgagcagcgagcagaggacagcgaccgtcgagcacccgagtcgcgagtcttctctggntaattttaacagcttggatgaattantgttncgatttanagttttggacagatacttgtatggatttgaaaagatacttgtatgaaaccgtgaaattggtgtttgctggctaaaaatatatgggatgctggtggaatgttaatttgggtaaattcccgcctnggcnngnngggnnccggaacggngaaagaacccactggttacactttagaaaaaanaaaaaagcggccgctccgggacccattcccccaaaggggaccaaaaaccgcccccgggcccggttttttaacggcgggagtggaaaacccggggttacccaattttacccttgagacaacccccttc

SEQ ID NO: 60714 - DNA, 748 bp, Zea mays
  misc_feature: Ceres CLONE 1520807
  misc_feature: Encodes the peptide sequence at SEQ ID NO. 60715
aacctggagctcaccgcggtggcggccgctctagactagtggatttcttgggctgcaggaattcgtctcacccctagaaaaaccggactgagtccagtccaacctcgcaggcaaagatggcggacgtcacccgcaacggcttcgggggccggaacccgccggggctgctgcagaacgcggccaagaacaagcatgcgttcgtgcagctgttcctcatgacgggcgtcctcttggtgagcctgcggaccttgggccagaagcacctcctccacgacctcgccgccgactacacctatttccgccgccacagccacgggctctccccactattgagggaccaccaggacccgctcattattgatgtgggctcctactggggggggaggggattttctatcccgataacacccccccccccccaacctttgtcttaaacatgtttctcgggagccggcggggcggttccccccctaaaatctgaccctgccccgggcgcccgtctacttaaccttttggttgcgggtacgtcctcggaagttggccgccccccgcatggtaagtataccacgtattccggctgtctaacgcgcccccgccctgtttgcgggggccgtagtaatcgctcaccgccaccacccagggtgatattttgaggggtggcccgtaacagggtataaaatggggcggggccctcatacctgttgactatgcgatgcactcaacgtctccttatgggggcgtaatcttc

SEQ ID NO: 60715 - protein, 105 aa, Zea mays
  misc_feature: Ceres CLONE 1520807
MADVTRNGFGGRNPPGLLQNAAKNKHAFVQLFLMTGVLLVSLRTLGQKHLLHDLAADYTYFRRHSHGLSPLLRDHQDPLIIDVGSYWGGRGFSIPITPPPPQPLS

SEQ ID NO: 60716 - DNA, 798 bp, Zea mays
  misc_feature: Ceres CLONE 1520810
  misc_feature (350)..(350): n is a, c, t, g, unknown, or other
  misc_feature (427)..(427): n is a, c, t, g, unknown, or other
  misc_feature (428)..(428): n is a, c, t, g, unknown, or other
  misc_feature (431)..(431): n is a, c, t, g, unknown, or other
  misc_feature (472)..(472): n is a, c, t, g, unknown, or other
  misc_feature (506)..(506): n is a, c, t, g, unknown, or other
  misc_feature (545)..(545): n is a, c, t, g, unknown, or other
  misc_feature (781)..(781): n is a, c, t, g, unknown, or other
aaacagtggggctccccgcggtggcggccgctctagaactagtggatcccccgggctgcaggaattcgtctcacccctagaaaaacggccgcctgtatttcctcacccaactccgtccctctctcccagcccagatagatctttcccccgtcctccctcgccttcgcctcgagcggaaggagatttccaccaccaccgccggaccaccccgaccctccttccctctcgcgctatggcccagactgttgtgctcagggttggcgtgtcctgagagggctgtgttggatctgtcacccggggcctgggcgagatgaaaggcggcgagttttttgacgtagattttagggatnttatggtcttttttttctccccccccccgggggaagatgggggggctattttttttttaaaacccccccccttcacnntcnttctgggagggttggggggggtgatggtgggaagagaatgngggctggccggggggcacctcccaggcctggggnccaacggactcgtgaattgtccccttagaggaaaaaggnagagggagttagagtagtggagattggtggcaatggttttgggagagaggactagcgggcgtccgggcgcgggtttcgcggtaagctgttttcggtatcgcagtggggcggccgagctacgcgcgggcgcgcgggggtgtggtggagataggacggtggctagtgtgagggcgggcgccgctcctcctcgacgcgtattgcagcataatcaatcacgccccgcctccgcccagggnctcctcgggcaacacat

SEQ ID NO: 60717 - DNA, 735 bp, Zea mays
  misc_feature: Ceres CLONE 1520812
  misc_feature: Encodes the peptide sequence at SEQ ID NO. 60718
  misc_feature (55)..(55): n is a, c, t, g, unknown, or other
  misc_feature (735)..(735): n is a, c, t, g, unknown, or other
ccacgctggagctcaccgcggtggcggccgctctagaactagtgaatttcttggnctgcaggaaatcgtctcatctttagggaggcaactcgcagatcgagtccaagcattcacctgagaatcccaaatcacactctccagtaaccgtccgcttctccagccgcatctctagccgagtctatctcctcctccgccgccgcaactatcctaatggctcgcttcgccgtggtcgccgccatcgtcgccctcctcgccgtcgtcgcggcggcgcaggccccgaccacagctcccaaggccgcgcccaggatggccccgctgccgccaccccctgtgcggtccccggccaccgtcctggtgccgggcgccaagccgcgggagggggggcggtccgttccccgctggccccccccccccgccccgccgcagcgaggggccccgccccccccgcgccccgtccctcgaagggtccggaccttggcctgtcgcccactgccccccgccagggggccgctaacgggcgggccccttccgacgagatccgcccgattgcgagcctgctccccttcctgggggtttcgcgcctccctgtccctggcgccggcatgcgacccggtggccgtgggacacagaacacgcttcgcgggaaggggaggggggggcgcggtgcccggtggtcgccccgacccggcggtgtgattgtcctgcggggggcatcgcacgaccccgaacccgccn

SEQ ID NO: 60718 - protein, 44 aa, Zea mays
  misc_feature: Ceres CLONE 1520812
MRPGGRGTQNTLRGKGRGGRGARWSPRPGGVIVLRGASHDPEPA

SEQ ID NO: 60719 - DNA, 684 bp, Zea mays
  misc_feature: Ceres CLONE 1520813
  misc_feature: Encodes the peptide sequence at SEQ ID NO. 60720
  misc_feature (245)..(245): n is a, c, t, g, unknown, or other
  misc_feature (281)..(281): n is a, c, t, g, unknown, or other
  misc_feature (283)..(283): n is a, c, t, g, unknown, or other
  misc_feature (315)..(315): n is a, c, t, g, unknown, or other
  misc_feature (319)..(319): n is a, c, t, g, unknown, or other
  misc_feature (345)..(345): n is a, c, t, g, unknown, or other
  misc_feature (346)..(346): n is a, c, t, g, unknown, or other
  misc_feature (425)..(425): n is a, c, t, g, unknown, or other
  misc_feature (477)..(477): n is a, c, t, g, unknown, or other
  misc_feature (502)..(502): n is a, c, t, g, unknown, or other
  misc_feature (510)..(510): n is a, c, t, g, unknown, or other
  misc_feature (627)..(627): n is a, c, t, g, unknown, or other
  misc_feature (656)..(656): n is a, c, t, g, unknown, or other
atagctggagctccccgcggtggcggccgctctagaactagtggatcccccgggctgcaggaattcgtctcacccctagaaaaaacctacgttactgctgaagatccagccggcacacacagacaccatcggcgaagaagaggccggagagaggatgatactggccgtgctcttcgccaactccgatggaaacatccttgtcgagcgattccatggggttcccgcggaggagaggctccactggngctccttcctggtgaagctcggatccgagaacctcntngggtccttgaaagaggagctggaggttgggtncganaaggctggggctttttgttttttccnntgtccggggatgtctggctgcccccttctccgccacgcggggagctggtgatcctttgctttggttgttgccccccccnccccactccctcccttagtctcatggatgcttggacaaaccccgcgcgcagncatccaccccctcctcctcgcccancccccggncggcagcggcctctccccccacctacacccgctccgccccctccccctcacccccaaaacacccgcccgacacccccgcccctcacgccccgcccgccggcgtccccgctccccccncccaccccccccacccccccccacccccnccctccccccgcctccccactccccccg

SEQ ID NO: 60720 - protein, 80 aa, Zea mays
  misc_feature: Ceres CLONE 1520813
  misc_feature (31)..(31): Xaa is any aa, unknown, or other
  misc_feature (43)..(43): Xaa is any aa, unknown, or other
  misc_feature (54)..(54): Xaa is any aa, unknown, or other
  misc_feature (55)..(55): Xaa is any aa, unknown, or other
  misc_feature (64)..(64): Xaa is any aa, unknown, or other
MILAVLFANSDGNILVERFHGVPAEERLHWXSFLVKLGSENLXGSLKEELEVGXXKAGAFCFFXCPGMSGCPLLRHAGSW

SEQ ID NO: 60721 - DNA, 678 bp, Zea mays
  misc_feature: Ceres CLONE 1520819
  misc_feature: Encodes the peptide sequence at SEQ ID NO. 60722
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
tggagctccccgcggtggcggccgctctagaactagtggatcccccgggctgcaggaattcgtctcacccctagaaagatgcctcggtcggtcgaacaatcttcaataacccagtcggcaggcgtgacccgatgctctctcgtcgtcggatcgccgccaccgtctcctccgcgtctacaccgatatggacgaccggcagtatgccggactgaccaaggcaggcttgggcgtgctggccttcaactcgggcctcgccatctacaactcctggggcgacgcgagctccgtcgcgttcgtgctctccgcggactccatcctcgtgctgctcttcctctgcctccctgagctggagctgcaggggccggggggccccccgccagggccaaggatttttggattaatcaaaccccgggggggacgcttaaaacctttcttctcggcatagtcccccctaaggggggggcctttaaagaccccccttcccccccccccccccttgggcaaaagtttggggcactgccccccgcggggtttgggggggctctcccctttaaatttttgggtttgcggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 60722 - protein, 86 aa, Zea mays
  misc_feature: Ceres CLONE 1520819
MDDRQYAGLTKAGLGVLAFNSGLAIYNSWGDASSVAFVLSADSILVLLFLCLPELELQGPGGPPPGPRIFGLIKPRGGRLKPFFSA

SEQ ID NO: 60723 - DNA, 707 bp, Zea mays
  misc_feature: Ceres CLONE 1520830
  misc_feature: Encodes the peptide sequence at SEQ ID NO. 60724
ctgaactagtggatcccccgggctgcaggaattcgtctcacccctagaaaaaatccacacctgagtcccctccgccgcatgccgcactgtcctgcgacgacacaaccacacgttcacgggagcgagagcttatcgtcatcggcggtgaacatggtgtcgctgatcctgaagaagctgttcgccgctagcgtcctcaagtgtgtgaaaggcaaagtctggcttgacccctatgaagtcagcgagatctccatggctaactcccgccagaacatccggaagttggttaacgatgggtttatcatcaggaagcctcacaatgttcactctacgtcccgtgcaagaggtcacatgaggccaaccagaatgtaagcactctggatacggcaagcgcaagggtaccaggcagggtaggctccccaccagattctgtggatgcagacgatgcgtgttctgatgcgactgctccgcaagtacgtgacggcaatgagatcgaccagcacatgtatcttgacctgtacatgaaggtcagggctccaatgttttacaacaggaggttgcgttatggagagtataccccagtcccatgggttaaaagccaaaagaaaaaaacttttctgatcagtttggagcccagcttgctataaaaaaggcaacccggggaaaggaaattggttcggggggaggaaagtgtggccccggggccaaaa

SEQ ID NO: 60724 - protein, 72 aa, Zea mays
  misc_feature: Ceres CLONE 1520830
  misc_feature (2)..(73): Pfam Name: Ribosomal_L19e Pfam Description: Ribosomal protein L19e
MVSLILKKLFAASVLKCVKGKVWLDPYEVSEISMANSRQNIRKLVNDGFIIRKPHNVHSTSRARGHMRPTRM

SEQ ID NO: 60725 - DNA, 604 bp, Zea mays
  misc_feature: Ceres CLONE 1520831
gcggtggcggccgctctagaactagtggatcccccgggctgcaggaattcgtctcacccctagaaaaaagccacgctccccgtaacgaacgacgcagcccaacccgttcccaccaaaccagcggcaccacccatggcttcggcggcggcgagatccggtctccggtcgctggcggtgcgcgccgcccctttgaggcgccgcatgtcctcctccgtccacgaacgacgctctatgagaacgggcccaggtggggagaaagaaatcaccctaaccgccgggggaaaccgggggacccggggcccccccccccttggggggggggggttaaaaaaaccctgtccccaagggggggcccccccccccccttttttcaaaataaacccccccccccaaaaaaacccccctttttttgtggggcaatatttcccccaaaaaaaaaaggggggtgtttttcccctctgggggggggcccccccccgggaggggagggggtgttttttttagaaaaaaaaaaaagaggggggggccccccccccccccccggggggggggcccccccccccttttttttttataaaaaaaacccccccccccccccttttgg

SEQ ID NO: 60726 - DNA, 677 bp, Zea mays
  misc_feature: Ceres CLONE 1520832
  misc_feature: Encodes the peptide sequence at SEQ ID NO. 60727
  misc_feature (356)..(356): n is a, c, t, g, unknown, or other
  misc_feature (382)..(382): n is a, c, t, g, unknown, or other
  misc_feature (420)..(420): n is a, c, t, g, unknown, or other
  misc_feature (603)..(603): n is a, c, t, g, unknown, or other
  misc_feature (604)..(604): n is a, c, t, g, unknown, or other
gcggtggcggccgctctagaactagtggatcccccgggctgcaggaattcgtctcacccctagaaaaaaacagtcaatgtgaaggttataatggcaactaatcgggcagacactctagatcctgctttgttgcgtcctggtagacttgacaggaaaattgagttccctctgccagaccggcgtcagaagaggcttgtttttcaagtttgcactgccaaaatgaacctgagcgatgaggttgatttggaagattatgtttccagaccggataagatcagtgctgctgatattgctgctatctgccaagaggctggcatgcatgctgtccgcaaaaaccgatatgtcatcctccccanggactttgaaaagggctacggaaccnacgtgaagaagcccgagacagactttgatttctacaantgagtcaacccagagtgttgaactcgtttcttttctgcaatgagtcaacccagagtgttgaactcgtttcttgtttatcattgattatcttttacatcagctgagttatggatagttgcattacaaatattcagtcctcaatgatgatgggggtctgaaatgatttttggaatgttgcctgcnntcaggggatcggctcacaaattaaggggggttgtttataaacactattttagtccaaaaaaccaaaaaaaaaa

SEQ ID NO: 60727 - protein, 109 aa, Zea mays
  misc_feature: Ceres CLONE 1520832
  misc_feature: SWISSPROT Homolog: EC 3.6.4.3 Microtubule-severing ATPase
  misc_feature (89)..(89): Xaa is any aa, unknown, or other
  misc_feature (98)..(98): Xaa is any aa, unknown, or other
MATNRADTLDPALLRPGRLDRKIEFPLPDRRQKRLVFQVCTAKMNLSDEVDLEDYVSRPDKISAADIAAICQEAGMHAVRKNRYVILPXDFEKGYGTXVKKPETDFDFY

SEQ ID NO: 60728 - DNA, 679 bp, Zea mays
  misc_feature: Ceres CLONE 1520836
  misc_feature: Encodes the peptide sequence at SEQ ID NO. 60729
  misc_feature (48)..(48): n is a, c, t, g, unknown, or other
  misc_feature (354)..(354): n is a, c, t, g, unknown, or other
cacagctggagctcaccgcggtggcggccgctctagaactagtggatnccccgggctgcaggaattcgtctcacccctagaaaaagaacacaccggcgaagaggaggcgaagaagcgatgggcgtgaccaaggaggacgtcgaggcggccatcacctctgctctcagcccttccaatctcgtggtgacggacacgtccggagggtgtggcgcgagctacgagatcgaggtggtgtcggagaagttcgaggggaagcggctgctggagaggcaccggatggtgaacaccgcgctggcgtctcacatggcggaaatccacgccgtctccatcaagaaggcgctcaccccggctcangcccagccccaggcccaggcggaggggggcgccgataagccccaggcttaagtgcctaacaccccccaaaacgggtttgatcccctatgccgaatgcccgattacattgggctatctggcttgaataatggccgcggaatgcccttgccaaaattgccaggatgttatccttgccttgattaaaaaccttccgcccccgggccttttaacttccggggcccccgccgaggcggtcccaggatgctcccccccccggacccttgcccccaaaccgctgtgttgccattacctcctgttaaggttcctgcccgggggggggttttcc

SEQ ID NO: 60729 - protein, 95 aa, Zea mays
  misc_feature: Ceres CLONE 1520836
  misc_feature (3)..(80): Pfam Name: BolA Pfam Description: BolA-like protein
  misc_feature (79)..(79): Xaa is any aa, unknown, or other
MGVTKEDVEAAITSALSPSNLVVTDTSGGCGASYEIEVVSEKFEGKRLLERHRMVNTALASHMAEIHAVSIKKALTPAXAQPQAQAEGGADKPQA

SEQ ID NO: 60730 - DNA, 694 bp, Zea mays
  misc_feature: Ceres CLONE 1520837
  misc_feature: Encodes the peptide sequence at SEQ ID NO. 60731
  misc_feature (339)..(339): n is a, c, t, g, unknown, or other
  misc_feature (350)..(350): n is a, c, t, g, unknown, or other
  misc_feature (388)..(388): n is a, c, t, g, unknown, or other
  misc_feature (420)..(420): n is a, c, t, g, unknown, or other
  misc_feature (480)..(480): n is a, c, t, g, unknown, or other
  misc_feature (495)..(495): n is a, c, t, g, unknown, or other
  misc_feature (529)..(529): n is a, c, t, g, unknown, or other
cgctctaaactagtggatcccccgggctgcaggaattcgtctcacccctagaaaaacttcccctcgcgcaccgctcctgtccaccctgccaccgccgccgccgccccgccgcatcaactgtcaccgtcgctatggcccgtatcaaggtgcacgagctccgggggaagagcaagacggacctgcaggcgcagctcaaggagctgaagtctgagctctccctcctccgcgtagccaaggtcaccggcggcgcacccaacaagctctccaagatcaaggtggtgcgcacctcgatcgcgcgcgtgctcacagtgatctcgcagaagcagaagtcggcgttgncgggagcgtancagaagaagaacctgctccccctcgacctccgccctangaagacccgtgccatccgcccgcgtctgaccnagcaccagctttctctgaagaccgagagggaaagaagcgtgagaagtacttccccatgangaagtatgctatcanggcctaggtcagaactgtgagatgctgtgcttancatatcatcggctggggtttaatttttgggttgagggacatttgttgaaataaatggattcctctgtttcaaaaaaatgggtaaattggtttgactggcaaaaaaaaaaaaaaaaaaaaagaaaaccctcgggtacccaattccccttaaaggggggccaatttc

SEQ ID NO: 60731 - protein, 115 aa, Zea mays
  misc_feature: Ceres CLONE 1520837
  misc_feature (6)..(64): Pfam Name: Ribosomal_L29 Pfam Description: Ribosomal L29 protein
  misc_feature (70)..(70): Xaa is any aa, unknown, or other
  misc_feature (73)..(73): Xaa is any aa, unknown, or other
  misc_feature (86)..(86): Xaa is any aa, unknown, or other
  misc_feature (97)..(97): Xaa is any aa, unknown, or other
MARIKVHELRGKSKTDLQAQLKELKSELSLLRVAKVTGGAPNKLSKIKVVRTSIARVLTVISQKQKSALXGAXQKKNLLPLDLRPXKTRAIRPRLTXHQLSLKTERERSVRSTSP

SEQ ID NO: 60732 - DNA, 626 bp, Zea mays
  misc_feature: Ceres CLONE 1520842
  misc_feature: Encodes the peptide sequence at SEQ ID NO. 60733
ggagctccccgcggtggcggccgctctagaactagtggatcccccgggctgcaggaattcgtctcacccctagaaaaagtgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggccgcggcggtgggtacggtggtggccgtggaggcggcggctacggcggtggcgggcgccttgatggcggcggcggctacggcggtggcggcggccgctacggtggcggcggccgctaccggggtggtggcggcggcttccgccggtgcaaccggggcggcggctacgggtactc

SEQ ID NO: 60733 - protein, 149 aa, Zea mays
  misc_feature: Ceres CLONE 1520842
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAASDVEYRCFVGGLAWATDDHSLHNAFSTYGEVLESKIILDRETQRSRGFGFVTFSTEEAMRNAIEGMNGKELDGRNITVNEAQSRGGRGGRGGGYGGGRGGGGYGGGGRLDGGGGYGGGGGRYGGGGRYRGGGGGFRRCNRGGGYGY

SEQ ID NO: 60734 - DNA, 653 bp, Zea mays
  misc_feature: Ceres CLONE 1520850
  misc_feature: Encodes the peptide sequence at SEQ ID NO. 60735
  misc_feature (653)..(653): n is a, c, t, g, unknown, or other
ataactggagctccccgcggtggcggccgctctagaactagtggatcccccgggctgcaggaattcgtctcacccctagaaaaaagccatggcgaccgcgacgcggaggctgctccccgggctcctcaagaccctagctccagccggcgcgcgcggcctctccaccgagaaggatggtggtgaagacgccatcttcggcagccacgccggttactggatgcacgacacgagcaagaagtcgccacatggaactgatcaacgaggtacctcccatcaaggttgatggtcccattgccgtctgtgaacgggcttctgaaagtgttggacttgaccacccaattgagtacatctgccttgatctggaggcacctaatgcgtgcaagtactatggcctccactatgttcaagctcaccaccactaaattgagaaaatactgccgtctaccgctgcaaaagctgatctgacgagcctatgtgcacacacatttgctccacaatgactctgtagtgtactttgtactatgcttgctaggcaacatattacctttgatgatcatgcctctatctcggacgatcagtctattaatccctgaacttagtatgcgtctcatttctctacacatgaaattgtgctccatattttcagaactctn

SEQ ID NO: 60735 - protein, 82 aa, Zea mays
  misc_feature: Ceres CLONE 1520850
MVVKTPSSAATPVTGCTTRARSRHMELINEVPPIKVDGPIAVCERASESVGLDHPIEYICLDLEAPNACKYYGLHYVQAHHH

SEQ ID NO: 60736 - DNA, 670 bp, Zea mays
  misc_feature: Ceres CLONE 1520860
  misc_feature: Encodes the peptide sequence at SEQ ID NO. 60737
  misc_feature (419)..(419): n is a, c, t, g, unknown, or other
aaagctggagctccccgcggtggcggccgctctagaactagtggatcccccgggctgcaggaattcgtctcacccctagaaaaaaccgagacaccgcgtgcgaaccaagcagaccccagcagaagaagcgaagtcgtcgccggagcaggaggaagagcgagcagcaagatgtcgtggcaggcgtacgtcgatgaccacctgctgtgcgacatcgaaggccagcacctcagcgccgccgccatcgtcggccacgacggcagcgtctgggcacagtccgagaacttccccgagttaaagcctgaggaggttgctgggatgataaaggactttgatgaacctggaactcttgcaccaactggtctttttgttggaggtacgaagtacatggtgatccaaggtgaaactggagttgtcatccnaggaaagaagggcactggaggcattactatcaagaaaactggcatgtccttgattatcggtatctatgatgagccaatgactccagggcaatgcaatatgggggtggaagaggctcggcgattacctgatcgaaccgggcttcctaagttgccataatgcttttttgggtcattggggcacttaagttttgcacccccatttggtttctcggtaaaaggtgggccttggggccttgtgccttgggcatatt

SEQ ID NO: 60737 - protein, 135 aa, Zea mays
  misc_feature: Ceres CLONE 1520860
  misc_feature (2)..(125): Pfam Name: Profilin Pfam Description: Profilin
  misc_feature (84)..(84): Xaa is any aa, unknown, or other
MSWQAYVDDHLLCDIEGQHLSAAAIVGHDGSVWAQSENFPELKPEEVAGMIKDFDEPGTLAPTGLFVGGTKYMVIQGETGVVIXGKKGTGGITIKKTGMSLIIGIYDEPMTPGQCNMGVEEARRLPDRTGLPKLP

SEQ ID NO: 60738 - DNA, 706 bp, Zea mays
  misc_feature: Ceres CLONE 1520868
  misc_feature: Encodes the peptide sequence at SEQ ID NO. 60739
aaagctggagctccccgcggtggcggccgctctagaactagtggatcccccgggctgcaggaattcgtctcacccctagaaatactccccaccccactattcctttctgctgagctcaggaaatcccctctggtctccccgtcccccattccacccgccgccgccgacgcgccgcgcctgttcaagatgaatgtggagaagctcaagaagatggcgggtgctgtgcgcactggaggaaagggcagcatgcgcaggaagaagaaggcagtccacaagaccgcaaccaccgatgacaagcggcttcacagcacgttgaaaagaattggagtgaacactattcctggtattggaggaggtcaacatcttccagggatgatagggtgggtccggattccagaacccctaatagtgccaagcatcccattccctgcgaattacatgggggtaggtccagtggaagtacccccacgacaaaaaaggcctaacaagaaccttttctgcccagcaatttatccaaccgaaactggggcccctggaaaaccctgggagaaaactccaaaaaggcttgacatgaagccattttccagaaaagcaggcaccccttggtggccaaaaagcacaacgcccggatgcaagcctgccccaggtatgtaaggaacgattgttcccttgaatctttgtccccacggaaagaaaagtttggagg

SEQ ID NO: 60739 - protein, 155 aa, Zea mays
  misc_feature: Ceres CLONE 1520868
MNVEKLKKMAGAVRTGGKGSMRRKKKAVHKTATTDDKRLHSTLKRIGVNTIPGIGGGQHLPGMIGWVRIPEPLIVPSIPFPANYMGVGPVEVPPRQKRPNKNLFCPAIYPTETGAPGKPWEKTPKRLDMKPFSRKAGTPWWPKSTTPGCKPAPGM

SEQ ID NO: 60740 - DNA, 688 bp, Zea mays
  misc_feature: Ceres CLONE 1520870
  misc_feature: Translation starting site: 178
  misc_feature: SWISSPROT Homolog: EC 2.7.11.1 Non-specific serine/threonine protein kinase
  misc_feature (48)..(48): n is a, c, t, g, unknown, or other
  misc_feature (55)..(55): n is a, c, t, g, unknown, or other
  misc_feature (56)..(56): n is a, c, t, g, unknown, or other
  misc_feature (65)..(65): n is a, c, t, g, unknown, or other
  misc_feature (81)..(81): n is a, c, t, g, unknown, or other
  misc_feature (85)..(85): n is a, c, t, g, unknown, or other
  misc_feature (297)..(297): n is a, c, t, g, unknown, or other
  misc_feature (308)..(308): n is a, c, t, g, unknown, or other
  misc_feature (416)..(416): n is a, c, t, g, unknown, or other
  misc_feature (419)..(419): n is a, c, t, g, unknown, or other
  misc_feature (447)..(447): n is a, c, t, g, unknown, or other
  misc_feature (532)..(532): n is a, c, t, g, unknown, or other
  misc_feature (626)..(626): n is a, c, t, g, unknown, or other
  misc_feature (668)..(668): n is a, c, t, g, unknown, or other
cacagctggagctcaccgcggtggcggccgctctagaactagtggatnccccggnnctgcaggantcgtctcacccctagnaaanctaccaccagtaccacaccactccgcgctagctgaggacggtacagcggcacagaggtgcgacgtacgacgacgacgacgcaggcgccacacatggcatcccagctctccgccgccgtgccccggttccacggcctccggggctacgccgcgcccaggtccgcggtggcagcgctgccgtccgtgagggtgggcaggaagaggtcgtcgtcncagggcatccnctgcgactacatcggctccgccaccaacctgatcatggtgacgacgacgaccctgaaccctctccccgggggggggtgggggctgggcgccttccggcaaacccccanggngacggggggggcttgaaggttggagggngcccgaatgccggccctggaaaccgggggacccccccccgggtttcaccctcccccgaaaacgctgggccctggcggcgcctgcnggccaccttcccccggccgccggcgtcccagcgcccgggtccagaaacacccggggcgccccaacccagatccgcgcgccaagagccccaccgncccccccggtcaaccacccaaacccacgctccctcccctcgncgcccgcccccccggcgggt

SEQ ID NO: 60741 - DNA, 594 bp, Zea mays
  misc_feature: Ceres CLONE 1520884
  misc_feature (1)..(1): n is a, c, t, g, unknown, or other
  misc_feature (220)..(220): n is a, c, t, g, unknown, or other
  misc_feature (221)..(221): n is a, c, t, g, unknown, or other
  misc_feature (231)..(231): n is a, c, t, g, unknown, or other
  misc_feature (232)..(232): n is a, c, t, g, unknown, or other
  misc_feature (248)..(248): n is a, c, t, g, unknown, or other
  misc_feature (249)..(249): n is a, c, t, g, unknown, or other
  misc_feature (272)..(272): n is a, c, t, g, unknown, or other
  misc_feature (337)..(337): n is a, c, t, g, unknown, or other
  misc_feature (498)..(498): n is a, c, t, g, unknown, or other
  misc_feature (499)..(499): n is a, c, t, g, unknown, or other
  misc_feature (539)..(539): n is a, c, t, g, unknown, or other
  misc_feature (541)..(541): n is a, c, t, g, unknown, or other
  misc_feature (543)..(543): n is a, c, t, g, unknown, or other
  misc_feature (546)..(546): n is a, c, t, g, unknown, or other
  misc_feature (550)..(550): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (568)..(568): n is a, c, t, g, unknown, or other
  misc_feature (570)..(570): n is a, c, t, g, unknown, or other
natagctggagctccccgcggtggcggccgctctagaactagtggatcccccgggctgcaggaattcgtctcacccctagaaaaaaagcaaataagacgacttgtttcattgattcttgaagagatcgagcttcttttgcaccacaaggtcgaggatgtcttgcaactgcggatcaagctgcggctgcggctcaagctgcaagtgcggcaagaagtaccnnctgacctggnnaggagaacgaagcacnncgccgcgcaggggccaccgtcgntccctcgggccgtggcccccggggaagaaagaaaagggcccgcccgcccccccaaagttttccgncccgaaagggcccccccgggggcggaaaaatcccccgggggaaaagggccccccccccccccccccctggggggggggttgggggggaaaaaaccccccccccaataaagggaaccaccccccccgccgagaaggggggggtggtaaaacccccccccccnnagcaaaacaaaaaaaccagggggggataatataaaatatntntnttntttntnnnnnnnnnnttttttncncttcccccacaaacgcgggggggg

SEQ ID NO: 60742 - DNA, 696 bp, Zea mays
  misc_feature: Ceres CLONE 1520887
  misc_feature (1)..(1): n is a, c, t, g, unknown, or other
  misc_feature (353)..(353): n is a, c, t, g, unknown, or other
  misc_feature (400)..(400): n is a, c, t, g, unknown, or other
  misc_feature (696)..(696): n is a, c, t, g, unknown, or other
nctaagctggagctccccgcggtggcggccgctctagaactagtggatcccccgggctgcaggaattcgtctcacccctagaaaaattccttccattttacccctccgtccgtctctcacactgtctctctccaccctctcgctctccgacaaggcgacgacgggtaggccaccgccgccggcgccgtcccactacgacaagtgctgaggccttcatcgctttcttcgccggcgacgagcacccaccaactaaggtcatggaagagatgatagatctaacgggggatggaggcgtccttaaaacactaccccccaaaccaaaacatgatgctattacaccatccaaaaacctnccccttccccccccccccccccggggggggggggcgcgggcgccggntcatcttttccacccccccccgggggggggaggcctattctcctcatttgaaaatgggacgaaggcggcgggcgccccaaccaggggggcaaccccccggacaaccttcggagggctcccccaagggggcaaaaaacgacgtggcgatgtgagaatcccacctctcgcaaccctcacggcccccccccccaccgatccccccccaaaagtaaaccccgcccgcgcgcaagcgcccccgcagtgcgctccgccccccccccaccacgcgggccccacccacccaacggacccccccn

SEQ ID NO: 60743 - DNA, 748 bp, Zea mays
  misc_feature: Ceres CLONE 1521017
  misc_feature: Encodes the peptide sequence at SEQ ID NO. 60744
  misc_feature (388)..(388): n is a, c, t, g, unknown, or other
  misc_feature (738)..(738): n is a, c, t, g, unknown, or other
  misc_feature (739)..(739): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (747)..(747): n is a, c, t, g, unknown, or other
aaaactggagctccccgcggtggcggccgctctacactagtggatcccccgggctgcaggaattcgtctcacccctagaaaaaccgccccctcgatcggtcggccggtcagctatgacgccgggaagctcggccgccggatccggcgtcgtcgttcctcggaacttcaggctcctagaagagcttgaacgtggagagaagggcattggagatgggacagtgagctatggaatggatgacgcagatgacctctacttgcgatcatggactggcactattattggccctcataaaaccgtccatgagggtcgcatcttacaggctgaagttgttcttgccacaaggactattttttgagagggggagacccccccccaaccgccccgcanagggagggggggggggggcccccccatcaaacctgtaactgcgctaactctcacaaagctccgcctttgttggcgctaccttgtgtcttgctccccccgtctcggccataactccctaacgcttcccctgaatagcgtataatatttcgctcccacaacttcgaacgtttgcttgatcttttttccgacgagaggacacctatcgcacctacgttgcccccaactcttggcctccccagcctggcgcacgccctccgctggccgtcctcccttttgcccggcaacagtgcaccaaagatgcgcgaaggcgtgatatacgcgtggatcctctcctccctgtttcctcggtnnaannnncng

SEQ ID NO: 60744 - protein, 80 aa, Zea mays
  misc_feature: Ceres CLONE 1521017
MTPGSSAAGSGVVVPRNFRLLEELERGEKGIGDGTVSYGMDDADDLYLRSWTGTIIGPHKTVHEGRILQAEVVLATRTIF

SEQ ID NO: 60745 - DNA, 655 bp, Zea mays
  misc_feature: Ceres CLONE 1521021
  misc_feature: Encodes the peptide sequence at SEQ ID NO. 60746
  misc_feature (585)..(585): n is a, c, t, g, unknown, or other
aaagctggagctccccgcggtggcggccgctctagaactagtggatcccccgggctgcaggaattcgtctcacccctagaaaagtgctttcttagaggtgggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctactgcggtggcgggcgccgtgattgcggtggcggctacggcggtggcggcggctacggtggcggccgcggctaccgtggtgggtgcngcggctaccgcggtggcaaccgtgggcgcggctacgggaactcccaacggaactggaggaactgagcggg

SEQ ID NO: 60746 - protein, 155 aa, Zea mays
  misc_feature: Ceres CLONE 1521021
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (135)..(135): Xaa is any aa, unknown, or other
MAASDVEYRCFVGGLAWATDDHSLHNAFSTYGEVLESKIILDRETQRSRGFGFVTFSTEEAMRNAIEGMNGKELDGRNITVNEAQSRGGRGGGGGGYGGGRGGGGYCGGGRRDCGGGYGGGGGYGGGRGYRGGCXGYRGGNRGRGYGNSQRNWRN

SEQ ID NO: 60747 - DNA, 718 bp, Zea mays
  misc_feature: Ceres CLONE 1521024
  misc_feature: Encodes the peptide sequence at SEQ ID NO. 60748
agctccccgcggtggcggccgctctagaactagtggatcccccgggctgcaggaattcgtctcacccctagaaaaagtctaatcaatcccgcattccccattgcacgccgtctccgctagggttttactccgcagccacaccgcgccgccggagcagcgcgagacccgcgaggcgagccacgcgagagagatgaggctcctgacgcacaacatgctggcgtcgaacgtccggggcgcaaccaccggctacccgctgacgctggaggcgaccaactggtgcaccaaggaggtggagctcaactccgacttcatccgcggtctcctccccaagatcgactggcgcgcgctcgtcgccgccacccgcgcgatcggcctccccgagctcctccccgaggagcagccccccgaggaggagatcttcgccgagggcgccgccgacgtcgagggaagcgccatccgccgcatccaccacgcgctcctcgagttcatgatcaggagggctccctcgtctgccccgacaccagccgctgcttccccatcaacatgggcatccccaacatgatgctccacgaggacgaagtctgattttgccgtgtcagtttcgccctggcctcttttgctcgccacctgctctacatggtctgtcgcggagggtatcggccctgtgggactccgactcaaattgtacctgtgaggatggaatgcagcctgcagattg

SEQ ID NO: 60748 - protein, 123 aa, Zea mays
  misc_feature: Ceres CLONE 1521024
  misc_feature (2)..(104): Pfam Name: Trm112p Pfam Description: Trm112p-like protein
MRLLTHNMLASNVRGATTGYPLTLEATNWCTKEVELNSDFIRGLLPKIDWRALVAATRAIGLPELLPEEQPPEEEIFAEGAADVEGSAIRRIHHALLEFMIRRAPSSAPTPAAASPSTWASPT

SEQ ID NO: 60749 - DNA, 707 bp, Zea mays
  misc_feature: Ceres CLONE 1521025
  misc_feature: Encodes the peptide sequence at SEQ ID NO. 60750
  misc_feature (341)..(341): n is a, c, t, g, unknown, or other
  misc_feature (347)..(347): n is a, c, t, g, unknown, or other
  misc_feature (435)..(435): n is a, c, t, g, unknown, or other
  misc_feature (455)..(455): n is a, c, t, g, unknown, or other
  misc_feature (458)..(458): n is a, c, t, g, unknown, or other
  misc_feature (489)..(489): n is a, c, t, g, unknown, or other
  misc_feature (495)..(495): n is a, c, t, g, unknown, or other
  misc_feature (554)..(554): n is a, c, t, g, unknown, or other
  misc_feature (580)..(580): n is a, c, t, g, unknown, or other
ccgagctggagctccccgcggtggcggccgctctagaactagtggatcccccgggctgcaggaattcgtctcacccctagaaaaagactactgactagagggggagagagagaggcgaggactgacggagagagcacgggggcttgatcaaagatggatgccggagcaaaggtggtgaagaaggccgcggtggggcgtctcggcgggggcggccccaacaagaagccggtctctcgctccgtgaaggccggactccagttccccgtaggctgtatcggccgctacctccaggagggtcgctactcccagggtgacggcaccggcgcccccgtctacctcgntgccgncctcgagtagctggggggcgagttccccgagttgggggggaactctgctgtgggttaaccacaaaaaccggatcatcccgggaaaggnactgctggcgatccgccccnaangaggaactcgggaagtttcggggctgggggnccattncaaccgggggggggtcctccccaaatgcgccccggtgctggtccccaaggaaaaacggnggtcgctggccacccaaggaaggggntagagaaaacaagccccccgagaaaggtcggcagcccaccaagaccccccaaacaaggtggcccctcctcttttttgtcctctgggaaatgtttgaacaaactgctctttcctctctaccacccctg

SEQ ID NO: 60750 - protein, 67 aa, Zea mays
  misc_feature: Ceres CLONE 1521025
  misc_feature (63)..(63): Xaa is any aa, unknown, or other
  misc_feature (65)..(65): Xaa is any aa, unknown, or other
MDAGAKVVKKAAVGRLGGGGPNKKPVSRSVKAGLQFPVGCIGRYLQEGRYSQGDGTGAPVYLXAXLE

SEQ ID NO: 60751 - DNA, 724 bp, Zea mays
  misc_feature: Ceres CLONE 1521026
  misc_feature (443)..(443): n is a, c, t, g, unknown, or other
  misc_feature (444)..(444): n is a, c, t, g, unknown, or other
  misc_feature (667)..(667): n is a, c, t, g, unknown, or other
  misc_feature (674)..(674): n is a, c, t, g, unknown, or other
acccgcggtggcggccgctctagaactagtggatcccccgggctgcaggaattcgtctcacccctagaaaaagctattcgtgtcctggcatccgcagagagtttgttccgtccaggcaaccaaaaagcgttgccccgccgcgcagaggaagaagagagcagaggaggatggctcgtacgaagcagaccgcccgcaagtccacgggaggcaaggccccccgcaagcagctcgccaccaaggcggcgaggaagtcggcgccgacgaccggcggcgtgaagaagccccacaggtacaggcccggaaccgtggcgctgcgcgagatccgcaagtaccagaagagcacggagctgctgatccgcaagctgcccttccagcgcctggtgcgcgagatcgcgcaggacttcaagacagacctccggttccagagccacgccgtgctgcgnnctccaggaggccgccgaggcctacctcgtcggcctcttcgaggacaccaacctctgcgccatccacgccaagcgcgtcaccatcatgcccaaggacatccagctcgcccgccgcatccgtggcgagcgcgcgtagccatcatctccgaagatctgatgaatgtctagttaccaacaaatagccgtattagcgtcgttgttctgtatttcgtattttgggatcngttgcangggaaaacagctttactgatcaaaaaaaaaaaaaaacgagacgctcgagt

SEQ ID NO: 60752 - DNA, 584 bp, Zea mays
  misc_feature: Ceres CLONE 1521027
  misc_feature (372)..(372): n is a, c, t, g, unknown, or other
  misc_feature (373)..(373): n is a, c, t, g, unknown, or other
ccgagctggagctcaccgcggtggcggccgctctagaactagtggatttcttgggctgcaggaattcgtctcacccctagagagacaacactcatcgatctacacacatacatagtttcttctactacacgacgacaaacatggggaagcctgcgaagatcggagagtggggtggatacgccggcgatcgtcgggatctgagggctactcctggacccggcttgatccgaggggtggaaaggttccccgggggcggaaaaaaaaaaaaggagggggggaggcgggccccccccccttctgtcaaaacgggggggcggtggggggaaacccccccaaagagggggggccccagggggggtcctcttcccgccnntttttgggtgcgacgaaacaaaaaaaagattttcgggggggcaaaaaaaacttccgggaaaaatttggggggaaaaaaccccccccccctccacaaaaaaaaaaatagggggggaggtgcctctcacacaagctttcccccccccacacaaaaccctttttctactccatcaatcatgtagggagacagaagatagccaccccccccttcg

SEQ ID NO: 60753 - DNA, 683 bp, Zea mays
  misc_feature: Ceres CLONE 1521029
  misc_feature (50)..(50): n is a, c, t, g, unknown, or other
agagctggagctcaccgcggtggcggccgctctagactagtggattcttnggctgcaggattcgtctcatcttagggaggtcatccagtgctctctcctcttgcgattcgctcgctcgatcctagcttcccttccaagaagcgcagcgcccatggccatggccacgcaagcctccgccgccacgcgccacctgctggccgccgcctgggcgccggcggcgaagccgcggcagctgagctcgcagctcgcgctgccgtcgtcgtcctcccgcgggccggccccgctccgcgcgtccaccgaggaggcggtggaggcgcccaaggggttcgtggccccgcagctggaccccagtacttcttcccccacctcgggcggggggggggggcatcctcctccccaacgcccacccccacgaattctgacgcatcacggggacggcccccaagggagcgggggtctccaaagccaccccgcggcccccccatcagggaggaggcccccaccccttagaacgggctcccaggcaatactgacgggggcagagggcaggctggccccattgtccggggcccccacctctgcataccaggttcccccccgggggggggcgcatcacagccccgcgaagggaacggcccctgcgcaaaaaaggcctgcgccccgcccgaggggccccgccgccc

SEQ ID NO: 60754 - DNA, 735 bp, Zea mays
  misc_feature: Ceres CLONE 1521030
  misc_feature: Encodes the peptide sequence at SEQ ID NO. 60755
  misc_feature (505)..(505): n is a, c, t, g, unknown, or other
  misc_feature (539)..(539): n is a, c, t, g, unknown, or other
  misc_feature (544)..(544): n is a, c, t, g, unknown, or other
ggagctccccgcggtggcggccgctctagaactagtggatcccccgggctgcaggaattcgtctcacccctagaaaaagctacttcccctccgatcctcgtcgccgacgcatccacccgaaccctcctccgcgacctcgccgtcgccgcagccttggccatgtcgatcttcgagtataatgggtccgccgtggtggcgatggtggggaagaactgtttcgcgatcgccagcgaccggcggctgggcgtgcagcttcagaccatcgcgacagacttccagcgggtgttcaaggtccacgacaagctttacatcggcctctctgggctcgccactgacgcccagacgctgtaccagcggttggtgttcaggcacaagctgtatcagctgcgggaggagagggacatgaagcccgagaccttttgcagccttgtctctgcgctcctctacgagaagagattcgggccatatttctgccagccagtcattgctggacttggagatgacnacgtaccattttatttgtactatggactggctangtgcnaaggagctgggccaaggatttttgtgtatctgggacagcatcaaaatctttgtatggtggcttggggagtccatgtacaagcccgaacatgggaccctgatgaactctttcgaaactggattccaagcctttgaattcttccataaaaccgggactgcctttaaggggtgggggggggctaggtttcggat

SEQ ID NO: 60755 - protein, 172 aa, Zea mays
  misc_feature: Ceres CLONE 1521030
  misc_feature (5)..(157): Pfam Name: Proteasome Pfam Description: Proteasome A-type and B-type
  misc_feature: SWISSPROT Homolog: EC 3.4.25.1 Proteasome endopeptidase complex
  misc_feature (116)..(116): Xaa is any aa, unknown, or other
  misc_feature (127)..(127): Xaa is any aa, unknown, or other
  misc_feature (129)..(129): Xaa is any aa, unknown, or other
MSIFEYNGSAVVAMVGKNCFAIASDRRLGVQLQTIATDFQRVFKVHDKLYIGLSGLATDAQTLYQRLVFRHKLYQLREERDMKPETFCSLVSALLYEKRFGPYFCQPVIAGLGDDXVPFYLYYGLAXCXGAGPRIFVYLGQHQNLCMVAWGVHVQARTWDPDELFRNWIPSL

SEQ ID NO: 60756 - DNA, 707 bp, Zea mays
  misc_feature: Ceres CLONE 1521031
  misc_feature: Encodes the peptide sequence at SEQ ID NO. 60757
  misc_feature (444)..(444): n is a, c, t, g, unknown, or other
  misc_feature (498)..(498): n is a, c, t, g, unknown, or other
  misc_feature (547)..(547): n is a, c, t, g, unknown, or other
ctccccgcggtggcggccgctctagaactagtggatcccccgggctgcaggaattcgtctcacccctagaaaaaaacgattctcgtcggtcgttctgtgccctatccgtcgtcggctatcgcaacagcagcgcctcttccctgtcgccctgactcctccctagcagcagaaaaccggcggcaagtcttcggtggcggcgagggaaggccaaggctttgcctgagagaatgcaagacccaagggatgatgatttcttggcgccaaagttgcataagaagaaggttgtctaccggccgcagccatcaggccatctgaagggtgaacctgaactgttgcggagagagtttccgcaatcatcaggcatggtccaaaagccacccaaaagaagcttgaagggtgagcctcgcacgcccccttccgacagggggacccggggatcctgcnggaatctggggtctacgacgaataccgtgcgttaaaggagaagtacctgatgcntggagaagagaactttgcactgaacaaagactgagcatggaagatgaangaatgaaggcccctagagatgaaaagctggcactgcctgatcagcttgttgctttgaaaggcttgtcaagcatccccagtgcagtctcaactaggcggtaaggggtttgggtaaggaaaaaccgtgccggtcataaattcagctaaagaagctgttaaca

SEQ ID NO: 60757 - protein, 83 aa, Zea mays
  misc_feature: Ceres CLONE 1521031
  misc_feature (73)..(73): Xaa is any aa, unknown, or other
MQDPRDDDFLAPKLHKKKVVYRPQPSGHLKGEPELLRREFPQSSGMVQKPPKRSLKGEPRTPPSDRGTRGSCXNLGSTTNTVR

SEQ ID NO: 60758 - DNA, 742 bp, Zea mays
  misc_feature: Ceres CLONE 1521034
  misc_feature (52)..(52): n is a, c, t, g, unknown, or other
  misc_feature (383)..(383): n is a, c, t, g, unknown, or other
  misc_feature (742)..(742): n is a, c, t, g, unknown, or other
aaagctgaagctcaccgcggtggcggccgctctagactagtggattcttggnctgcaggattcgtctcaccttagggagatccagtcgcatctccctctccgaaatcaaggtagcgtacaccgctgcagtttctagagccctctctgccactcgtgatcccactagtcacaatgcctgccctcgccaagcccgcctcccgcaccgccaagcccgccgcggctccgaagccgaagcctgccgccgccaagccgaaggcggccaccgctggtgcctcccacccgcctaactgcaagatgatcaaggaggctatcatcggcctcaaggagagggaccgcccccggctcgcaagcaatccgccaagcgcgcggggggagaggctctnccctttctctacccctccggcccccccaccatgttttcaatcccacttccttgggcccccccccccagggcgaatcgtgcggaatgttgaggtgcgccgaaccgcccttgttccccgccttaatctcggccttccccccggagcctgccgtcccgccgttgacgcatcgctccgggacccgctatcccgccttcgcgcggcgtttggactggggtcgcgccctcccctgagcgtcacaccggggcgcgcccctcttgctgtcccctacgacctgtccccggcggtacatgggcccctcgcggtgtaacgcggcccgtcccgggcgcccccgggagcgattgcgaccccggccccgagtn

SEQ ID NO: 60759 - DNA, 447 bp, Zea mays
  misc_feature: Ceres CLONE 1521037
aactggctccccgcgggcggcgctctagacttggatcccccgggctgcaggattctctcacccctagaaaaaggacaggttgcatttgcatctgagttcctgatcgttgtattccagtttcttccgtgagttttgtgggatcgcgaggaaaaggatgtctgctgcgagcactgcgtgcggccgctgcagtgcgacgctgcgagtgcagagtccggactgctgacagtgacacacacacaccgattatctgggtgccatcaaggcgggcagcggcgcgactaaacgcggtcaatcgggccatgcctgcacctgaccgaagtaactccaggggcggcatacctccggctccgccctaggggtcaaaggcctttttctccggcaattaaaccccccaaaagaattccccgggccttgcggggtttccaacccttaacactcccccggccg

SEQ ID NO: 60760 - DNA, 689 bp, Zea mays
  misc_feature: Ceres CLONE 1521039
  misc_feature: Encodes the peptide sequence at SEQ ID NO. 60761
agagctggagctccccgcggtggcggccgctctagaactagtggatcccccgggctgcaggaattcgtctcacccctagaaaaagccaacggcggcgacgagaagtggcgagccccgagagcgggtttagttagaggctacgggcggtcgggcgcggcggcggcggcggccatgagcagcgggagcgagagcactaccgccagcaggtggcccgagctggccacgctgcgcgcgctggcgcgcgacgccgcggagcagcttcggctgccgcgggccggcacgtcggcgtcggcgtcggcgtcggcgtcgtcgtcgccgtggcgcgggcgcgaggaccacctccacggccacggcaagacggccaaggtgatgcacctgctgctctggggaccccagtgaagcggcggcgagacgccaccgtaccgccgggctctcccgccggcgttgctcgttttgctctgcctgcaatcccgcccgcacggactgtactgtacctatacacctatatactacgacgtgcacctgtactacgacgtgctgctggaccaaactataccagggccctgctgctccttggaaaaaaaaaaaaaaaacgagaccctcgaggtcccaatttcccctaaagggaggcgtatatccccccgctcctggccccccgtttaaaaccgccgggccggggaacacctggg

SEQ ID NO: 60761 - protein, 75 aa, Zea mays
  misc_feature: Ceres CLONE 1521039
MSSGSESTTASRWPELATLRALARDAAEQLRLPRAGTSASASASASSSPWRGREDHLHGHGKTAKVMHLLLWGPQ

SEQ ID NO: 60762 - DNA, 699 bp, Zea mays
  misc_feature: Ceres CLONE 1521041
  misc_feature: Encodes the peptide sequence at SEQ ID NO. 60763
  misc_feature (369)..(369): n is a, c, t, g, unknown, or other
  misc_feature (413)..(413): n is a, c, t, g, unknown, or other
  misc_feature (507)..(507): n is a, c, t, g, unknown, or other
  misc_feature (590)..(590): n is a, c, t, g, unknown, or other
  misc_feature (593)..(593): n is a, c, t, g, unknown, or other
acccgcggtggcggccgctctagaactagtggatcccccgggctgcaggaattcgtctcacccctagaaaaaaccagcaacccccaacagcgccactgtccagtgcgcgcgtcaagcttgcttagctagccgccatggcctccctcgccgccgtctccgtgaagcccgtggccatcaagggtctcgccggcagctccatctccggaaggaagctcgccgtcgccaggccgtcggcccgctccatccgcaggccccgcgcagccgccgtggtggccaagtacggcgacaagagcgtctactttgacctcgacgacatcggcaacaccaccggacagtgggacctctacggctctgacgcgccctcgcccntacacccgctacagagcaagttcttcgagacgttcgcggctccngtcaccaagagagtctgctgctcaagttcctgctgctgggcggcggctcacttctggcctacgtcagcgcgtcggcgtcaccggacctcctgcngatcaagaaggggactcaggagccgcggcagcccggcccgccgcggaagatctaagctcagcttctccatttgcatgggctantancttgctttgtactgctagcgccgggccaatccgtcccaatcggcatggaacatctctccaatcttggtggtaccccggtcaaaattttggaaattttgccattccc

SEQ ID NO: 60763 - protein, 158 aa, Zea mays
  misc_feature: Ceres CLONE 1521041
  misc_feature (5)..(144): Pfam Name: PSI_PsaH Pfam Description: Photosystem I reaction centre subunit VI
  misc_feature (79)..(79): Xaa is any aa, unknown, or other
  misc_feature (125)..(125): Xaa is any aa, unknown, or other
  misc_feature (152)..(152): Xaa is any aa, unknown, or other
  misc_feature (153)..(153): Xaa is any aa, unknown, or other
MASLAAVSVKPVAIKGLAGSSISGRKLAVARPSARSIRRPRAAAVVAKYGDKSVYFDLDDIGNTTGQWDLYGSDAPSPXHPLQSKFFETFAAPVTKRVCCSSSCCWAAAHFWPTSARRRHRTSCXSRRGLRSRGSPARRGRSKLSFSICMGXXLALYC

SEQ ID NO: 60764 - DNA, 640 bp, Zea mays
  misc_feature: Ceres CLONE 1521044
  misc_feature: Encodes the peptide sequence at SEQ ID NO. 60765
  misc_feature (329)..(329): n is a, c, t, g, unknown, or other
tccccgcggtggcggccgctctagaactagtggatcccccgggctgcaggaattcgtctcacccctagaaaaattttcttctcgcccaagccgcgccgccggcgcggtcctttgtaaaggcctcgcggcacgggagcggcctgcgctccctctctctggattaggcaaagcatcctcctgtttggatcggcatggagaagacgacgacgatggcgcagccggtctgcgcgcaggagtcgctggctctgctcaactgcgtcgcctcggtcccctacgaccgggataggtgcctcgccctcgtcgacgccctcccgtgatgcatcgtgcgncagagggtgaagaagttttcgctggcagaaccaagctccacccacaccaccgaagctctgaggagcgatacgaagccctgagcattctgcaaagaaaactgtatcatctgatttgggcgcgttgatgataagtctatgcctgtaaatgtagcgtaagatttgtactttttgaacccatgccagatgtacttggcccaaaatcaccaatctgtttgactgaaaacgttacccgatgtcaccccaaatgatacagtccatgatgccattttcaataaaaaggccccatccttcccaggtttttctacaaaaaa

SEQ ID NO: 60765 - protein, 41 aa, Zea mays
  misc_feature: Ceres CLONE 1521044
MEKTTTMAQPVCAQESLALLNCVASVPYDRDRCLALVDALP

SEQ ID NO: 60766 - DNA, 784 bp, Zea mays
  misc_feature: Ceres CLONE 1521045
  misc_feature: Encodes the peptide sequence at SEQ ID NO. 60767
aaagctggagctccccgcggtggcggccgctctagaactagtggatcccccgggctgcaggaattcgtctcacccctagaaaaaggtagccgtcggttcacttctccaggtaaggaaagggttcgtactcatggcgccgccgcagccaaagtcgggcctcttcgttggcatcaacaagggtcatgtcgtcaccaagcgcgagctgcctccccgcccgtgccaccgcaaggggaaatcaacgaagagggtgtctatggtcaggggcctgatcagagaggttgctgggtttgctccttatgagaagcgtatcactgagcttctgaaggttggcaaggacaagcgtgccctgaagcttgctaagagaaagcttgtaactcacaagagggcaaagaagaagagacaccacaccgcgggcgttcctcaagaaagatgaggtcggctggctaccccacactggccaaaaaaaaatagcaaagcattttcaagttccatggaagctggattgcccaaaaaattatgttcccaggtgccctaattttcccctacaatggaaaaaacttatataaacattgtcaaaagaattaatggaatccaaaccagcttctaggggaattttggcccccttccaatggcaacccgggggtttaagtgtttcccacaccagttttaagggaaacttggcccctttatttcaaaaggctccacaggggtttgtggaaccctaaaaaaaaataaataaaaaacccaaccgcctccgaggaaccccaaatatcccccctaaaag

SEQ ID NO: 60767 - protein, 100 aa, Zea mays
  misc_feature: Ceres CLONE 1521045
  misc_feature (5)..(101): Pfam Name: Ribosomal_L36e Pfam Description: Ribosomal protein L36e
MAPPQPKSGLFVGINKGHVVTKRELPPRPCHRKGKSTKRVSMVRGLIREVAGFAPYEKRITELLKVGKDKRALKLAKRKLVTHKRAKKKRHHTAGVPQER

SEQ ID NO: 60768 - DNA, 730 bp, Zea mays
  misc_feature: Ceres CLONE 1521051
  misc_feature (603)..(603): n is a, c, t, g, unknown, or other
ctccccgcggtggcggccgctctagaactagtggatcccccgggctgcaggaattcgtctcacccctagaaaaatttagaaggggtgatatcctgtttttgcatatgatcaatcatcctattctcacatgagaaatatttgttttcaatatctatcggccttgagataccatttgtctaccgagtgattaaggtccatgaacgctcggacactgcggaagtggacatcctcgccgaaggtgacaataattttggggatgaccgactattatatgcgcatggccagatttggctccagcaacaccacattatgaggcgtgcgatggcctaccttccatatgttgcctggtttacaattatcatgactgagacaccgtttattaagtacctgctgattggacactgggcttgctggtcataacgtcgagagattagtgatgtcaaacttcacggcatgaagatgatgctcttatggcatacagcacatatcactgcctgtgtagcgtttgaagatgccgctatgtcgcgccatgtatccaacgatgagatctctttatctactgcgaagacacctgctcattgattagatagactgttctaatcnaacatccatcatttggatttgtggcctaactcatgatgttgcacagtccgatgggctctatttcatggaaaaaagaaagcaaaatgaaacgttcgaggtaacaaaatccgccctataatgagtcgaa

SEQ ID NO: 60769 - DNA, 709 bp, Zea mays
  misc_feature: Ceres CLONE 1521053
  misc_feature: Translation starting site: 172
  misc_feature (375)..(375): n is a, c, t, g, unknown, or other
ctggagctccccgcggtggcggccgctctagaactagtggatcccccgggctgcaggaattcgtctcacccctagaaaaaacggccatagaaatcgaccgagcgaatccctcgcatcgcattcgcagcctttgctgcatcacaccaccgcgaaaccccagcagccgcatcgatggcgcctaaggcggagaagaagccggctgcgaagaagccagcggaggaggagcccgctgccgcgaaggccccggcggggaagaagcccaaggccgagaagcgcctcccggcggccaagtcgtccggcaaagaaggcggcgacaagaagggtaagaagaaggcgaagaagtcggtggagaccctacagatctacatcttcaanggtgctgaagcaggtccacccggacatcggcatctctcccaaggccatgtccatcatgaactccttcatcaacgacatcttcgaagagctcgccgggcgaggctgccaagcttgcgcgctaacacaagaggcccacatcaccctctcgggagattcaaacctctgtccggcttggtccttccccgggagacttcccaagccaccgggtcttccaagggcaccaagggccgtccccaaagttcccctcactttaaaatttgagggaaaaaccctttgggggggggttgggaaacctgtgccccaatttggcccgcccccaaaaggggggagagaa

SEQ ID NO: 60770 - DNA, 682 bp, Zea mays
  misc_feature: Ceres CLONE 1521057
  misc_feature: Encodes the peptide sequence at SEQ ID NO. 60771
  misc_feature (184)..(184): n is a, c, t, g, unknown, or other
  misc_feature (230)..(230): n is a, c, t, g, unknown, or other
  misc_feature (231)..(231): n is a, c, t, g, unknown, or other
  misc_feature (232)..(232): n is a, c, t, g, unknown, or other
  misc_feature (359)..(359): n is a, c, t, g, unknown, or other
  misc_feature (400)..(400): n is a, c, t, g, unknown, or other
  misc_feature (427)..(427): n is a, c, t, g, unknown, or other
  misc_feature (428)..(428): n is a, c, t, g, unknown, or other
  misc_feature (449)..(449): n is a, c, t, g, unknown, or other
  misc_feature (452)..(452): n is a, c, t, g, unknown, or other
  misc_feature (479)..(479): n is a, c, t, g, unknown, or other
  misc_feature (482)..(482): n is a, c, t, g, unknown, or other
  misc_feature (485)..(485): n is a, c, t, g, unknown, or other
  misc_feature (494)..(494): n is a, c, t, g, unknown, or other
  misc_feature (521)..(521): n is a, c, t, g, unknown, or other
  misc_feature (530)..(530): n is a, c, t, g, unknown, or other
  misc_feature (554)..(554): n is a, c, t, g, unknown, or other
ccccgcggtggcggccgctctagaactagtggatcccccgggctgcaggaattcgtctcacccctagaaaaccgtgctttcttagaggtgggttggcttctcctccccctccggttcgggttcgggttcgtgaggttctccggggttcgggttcgtgggtgagcggatcgagatggcggcgtcngatgttgagtaccgctgcttcgtcggcggcctcgcctgggccacgnnnacgacactcctccacaacgccttcagcacctacggcgaggtcctcgagtccaagatcatcctcgatcgggagacgcagaggtcccgcggcttcggcttcgtcaccttctccacggaggaggcgatgncgaacgccatcgagggcatgaacggcaaggagctggacggnccgcacatcacccgtcacgaggcccanntcccgcgcggccgtggaagcngcngcggtgggtacggtggtggccgtgaangcngcngctacggcngtggcgggcgccctgatggcggttgcngctaccgcngtggcgccggctacggtgccgccngcggctacggtggtggtggcggccggctacggcggttgcaaccggggggggcggctacggccacctcccaggggaattggaggaattggacggggggggcccccccgggcccaaattttccctgtttc

SEQ ID NO: 60771 - protein, 170 aa, Zea mays
  misc_feature: Ceres CLONE 1521057
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (20)..(20): Xaa is any aa, unknown, or other
  misc_feature (63)..(63): Xaa is any aa, unknown, or other
  misc_feature (85)..(85): Xaa is any aa, unknown, or other
  misc_feature (86)..(86): Xaa is any aa, unknown, or other
  misc_feature (93)..(93): Xaa is any aa, unknown, or other
  misc_feature (94)..(94): Xaa is any aa, unknown, or other
  misc_feature (103)..(103): Xaa is any aa, unknown, or other
  misc_feature (104)..(104): Xaa is any aa, unknown, or other
  misc_feature (105)..(105): Xaa is any aa, unknown, or other
  misc_feature (108)..(108): Xaa is any aa, unknown, or other
  misc_feature (117)..(117): Xaa is any aa, unknown, or other
  misc_feature (120)..(120): Xaa is any aa, unknown, or other
  misc_feature (128)..(128): Xaa is any aa, unknown, or other
MAASDVEYRCFVGGLAWATXTTLLHNAFSTYGEVLESKIILDRETQRSRGFGFVTFSTEEAMXNAIEGMNGKELDGPHITRHEAXXPRGRGSXXGGYGGGREXXXYGXGGRPDGGCXYRXGAGYGAAXGYGGGGGRLRRLQPGGAATATSQGNWRNWTGGAPPGPNFPCF

SEQ ID NO: 60772 - DNA, 734 bp, Zea mays
  misc_feature: Ceres CLONE 1521058
  misc_feature: Encodes the peptide sequence at SEQ ID NO. 60773
  misc_feature (433)..(433): n is a, c, t, g, unknown, or other
ctggagctccccgcggtggcggccgctctagaactagtggatcccccgggctgcaggaattcgtctcacccctagaaaaaaaggcaccaaaccaatctagccaccaaggcaccaaccaagagccatggcatccccgttctgcgccgctgccgccgcttgccgccttgccgtccccgccccgtcccctcccgccgcacgggcgcctaggccccgacgcggcctggtggcggtgcgcgcggaggcgggcggtgggataaacccggccatccggaaggaggaggacaaggtggtcgacaccgtcctcaccggcgagctcgccaagccgctcaccgcgtactgtcggtgttggagatcaggaacattcccactgtgcgatggatcccatgtgaagcacaacaaagcaaccggtgataaatgtggccccccctgctcngtaagaagtagatgcagtttcgttcgacttttgccctaacatcatgttgagcgctgagctgaacactatctgtctgtcatgatatatggtttttttagcccagattaactatcacgacgcaacgatccttctttcaaaataaagtagctgctcatgtcaaaaaaaaaaaaaaacgagacgctcgaggtaccaattcgccctatagggagtcgaatacgcgcgctcactggcgtcgtttaacacgtcgtgactgggaaaaccctggggtaccccacttaatcgcttgcagcaatcccccttt

SEQ ID NO: 60773 - protein, 115 aa, Zea mays
  misc_feature: Ceres CLONE 1521058
MASPFCAAAAACRLAVPAPSPPAARAPRPRRGLVAVRAEAGGGINPAIRKEEDKVVDTVLTGELAKPLTAYCRCWRSGTFPLCDGSHVKHNKATGDKCGPPCSVRSRCSFVRLLP

SEQ ID NO: 60774 - DNA, 701 bp, Zea mays
  misc_feature: Ceres CLONE 1521060
  misc_feature: Encodes the peptide sequence at SEQ ID NO. 60775
  misc_feature (389)..(389): n is a, c, t, g, unknown, or other
  misc_feature (666)..(666): n is a, c, t, g, unknown, or other
  misc_feature (667)..(667): n is a, c, t, g, unknown, or other
  misc_feature (690)..(690): n is a, c, t, g, unknown, or other
  misc_feature (701)..(701): n is a, c, t, g, unknown, or other
agagctggagctccccgcggtggcggccgctctagaactagtggatcccccgggctgcaggaattcgtctcacccctagaaaaactcctaccactacactaccaccgtttcagtgctataggataggattttcttttgacggccatgaaaccccctcagctgccggccggggagcgctcctgggctcacgaggtcaagcaggccctccgtgagaaactccggcgctcctacggcgccgcctccgccacaccggcggccggtgaaccgagccgtggcgccgactgccgtggctcggccgccgaggaccccataaggagagtcatgttcttggctccctggggccacacataaaacacagacccagatctgggcttgcaagagcatggccngatctgcaaagaactgctcaaccatacttaaaaggaactggagcttgtcttgtaaactatggagcatgctgcttgcaccacgaacataaacgcatggctgggttaacaggtagatatatgggtgtggatgggggaagaaaaaaaaaaccagggatgtattccacccccctctctgatcttggagggaaaggcttaaatcttgggaagcccagcctgggcctggggtgtggttaaaatttgaaactttgtgacccccccccttggtttccccaaaccnntgtgaaagaggggggaccgggtnttaaagcggan

SEQ ID NO: 60775 - protein, 68 aa, Zea mays; identical to SEQ ID NO: 60450
  misc_feature: Ceres CLONE 1521060

SEQ ID NO: 60776 - DNA, 673 bp, Zea mays
  misc_feature: Ceres CLONE 1521061
  misc_feature: Encodes the peptide sequence at SEQ ID NO. 60777
aaagctggagctccccgcggtggcggccgctctagactagtggatcccccgggctgcaggaattcgtctcacccctagaaaacccggccgtctcgatcccagcatccgagagagctccacaggccaggtccccatcgccgcggcgcttgccccacctctcccccgcccggtagtagcctcgccgccgttgccgagatggggttcgtgtccttcgtcgggagggtgctcttcgtcgccgctttcctcctctccgcctaccaggagtttaatgaattcggtgctgatggtggaccagcagctaaggcccttcggcccaaattcaacgtgtttgtcaaaaatgtatctgctcatctgggagtagctgtgccacacattgagttgaagcatgtgattgctgctacaattggtcttaacggtcttggaagcctcctttttattttgagcagctctctcggtgcttatctcctgctgctgtacctgctttgatcactcctatcatccatgacttctacaactacaatatggagaaggcagattttgcaggcctctttgccaagtttcacccagaattggcgctaatcggagccttgctccttctttctgggcattaaaaaactcctccccaaaccggaggggcggaaaaaaaaaggccccccaggggaaaaccaattag

SEQ ID NO: 60777 - protein, 96 aa, Zea mays
  misc_feature: Ceres CLONE 1521061
  misc_feature (1)..(96): Pfam Name: HR_lesion Pfam Description: HR-like lesion-inducing
MGFVSFVGRVLFVAAFLLSAYQEFNEFGADGGPAAKALRPKFNVFVKNVSAHLGVAVPHIELKHVIAATIGLNGLGSLLFILSSSLGAYLLLLYLL

SEQ ID NO: 60778 - DNA, 758 bp, Zea mays
  misc_feature: Ceres CLONE 1521062
  misc_feature: Encodes the peptide sequence at SEQ ID NO. 60779
  misc_feature (348)..(348): n is a, c, t, g, unknown, or other
aagctggagctccccgcggtggcggccgctctagaactagtggatcccccgggctgcaggaattcgtctcacccctagaaaaaaagcgaatggtaacgcggagcgcggatgatcggatgtaggagatctcgaccaagccggaggcggagtagatgaggacgttcgacccgtggacggtctttttccgccgggagtggaagcgcaactggcccttcctcacgggtttcgccatcaccggattcatcatcacgaagatgacgtccaacttcaccgaggaggacctcaagaactccaagttcgtccaggaacacaagaagaagcgctgacgaaccaagtgaaagataaacncatgtttgcccaaccacccctgtggtgggggggagggaagaatttagaggcctctttccccccccccctaatcgaaatgcttggaactctatggttccttttgtaacggaattaggagggccatggaatttgaaccgaacaccgatcccccttcggggttgaaaaatattccattgtggccatggggtgcccccgaaaggttagcggggattggccttctaattcccggtcgaatttggccgaaaaggaaaattccggcccttttaagcggcgggctaattttaaaaacgggaggtggtggaaaaaaccctggcttgggcctttttaagccccttgccaaacgtacctatatttcggaaaggaaaaaggtggtttgtccctttgttgtccccagggcttctccctggggg

SEQ ID NO: 60779 - protein, 57 aa, Zea mays
  misc_feature: Ceres CLONE 1521062
MRTFDPWTVFFRREWKRNWPFLTGFAITGFIITKMTSNFTEEDLKNSKFVQEHKKKR

SEQ ID NO: 60780 - DNA, 777 bp, Zea mays
  misc_feature: Ceres CLONE 1521064
  misc_feature: Encodes the peptide sequence at SEQ ID NO. 60781
  misc_feature (1)..(1): n is a, c, t, g, unknown, or other
  misc_feature (2)..(2): n is a, c, t, g, unknown, or other
  misc_feature (10)..(10): n is a, c, t, g, unknown, or other
  misc_feature (11)..(11): n is a, c, t, g, unknown, or other
  misc_feature (316)..(316): n is a, c, t, g, unknown, or other
  misc_feature (324)..(324): n is a, c, t, g, unknown, or other
  misc_feature (355)..(355): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (410)..(410): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
nnaacaactnncaacaccccgaactccacgcggtggcggccgctctagactagtggatcccccgggctgcaggaattcgtctcacccctagaaaagcaaacaccccgtccactgcacagacaattccccatcgcgataggcccgttcgcacgaatcactgctctgctttcaccccccgaatcgaacctcacccccgatctgagcgaatcgaaggctgcggcggcaatggacctttacaacggcggtggccaccccgacgactacttccaccagagggtatggagcatgactgttttccccaagggggaggacgtcncttggggnatttttttctacctcgcccaggttaggcgcnacccatttttttttccccccccccccgggggggggggaggggggttaannnnttnttttttnnnccccccccaatacaaaaagaaaaaaaccttacaaagcgggggggggggcccggcccccgtaaagaacgccccagaaagggttgaagaaggtggcaaaccacgcatcttaccccgtcgtttgagcggaaaacccagaggtcccacgcacgtaatggtgcggagaaataatataaagagcctacgccctagaaactgacaagcagaggagaacatatttttcccctgccgacactgcgatgagacgataagcttcaccccagctagcccaacaatgactgtcggagtcaaagagagataaaccgattatgaaagacaccgctgggcgatagaaacacaactatcgtagggctcataagcg

SEQ ID NO: 60781 - protein, 129 aa, Zea mays
  misc_feature: Ceres CLONE 1521064
  misc_feature (31)..(31): Xaa is any aa, unknown, or other
  misc_feature (44)..(44): Xaa is any aa, unknown, or other
  misc_feature (60)..(60): Xaa is any aa, unknown, or other
  misc_feature (61)..(61): Xaa is any aa, unknown, or other
  misc_feature (62)..(62): Xaa is any aa, unknown, or other
  misc_feature (64)..(64): Xaa is any aa, unknown, or other
  misc_feature (65)..(65): Xaa is any aa, unknown, or other
MDLYNGGGHPDDYFHQRVWSMTVFPKGEDVXWGIFFYLAQVRRXPFFFPPPPGGGGGGLXXXFXXPPQYKKKKTLQSGGGGPAPVKNAPERVEEGGKPRILPRRLSGKPRGPTHVMVRRNNIKSLRPRN

SEQ ID NO: 60782 - DNA, 708 bp, Zea mays
  misc_feature: Ceres CLONE 1521065
  misc_feature: Encodes the peptide sequence at SEQ ID NO. 60783
  misc_feature (405)..(405): n is a, c, t, g, unknown, or other
  misc_feature (436)..(436): n is a, c, t, g, unknown, or other
aaagctggagctccccgcggtggcggccgctctagaactagtggatcccccgggctgcaggaattcgtctcacccctagggagcttccactgcaggttcctaacccccacccacctcgcccaaattgcaaccttccccgagtgctccaggtcccgtggccggcccccagatcctctccaatcccaatccaagtatcgaacggatcccatcggtggcgctcgagcgagcgagtgcggccggaaccgagcgaagatgggcatctcgagcatgccggcgcccgaggacagcctgctggggttcgtgctgtacaacacggcggcgtcggtggcgatcctggcggggctggtgcgcgccgcgctgctgttcctgggcctggcggcggcggaggacgaggagccgcggcancaggcggaggccgtgacggtcacggccgtgnggcccagcctcgcggaccggttccggagcaggttccggccgtcgcgctacgggcggcgcccgggcgggaactgccccgtgtgcctggtgcggttccagacggagtccgggggtgcgccggctcccctgcggccaccttcttcaaccgcgcctgcctcgaaaacctggatcgactaccaaccacgccacctggcccgctggggcgcccaccggccttcctgccccccggcggttgccggccgaacaaagtggcccccgaattgccctgaatag

SEQ ID NO: 60783 - protein, 151 aa, Zea mays
  misc_feature: Ceres CLONE 1521065
  misc_feature (51)..(51): Xaa is any aa, unknown, or other
  misc_feature (62)..(62): Xaa is any aa, unknown, or other
MGISSMPAPEDSLLGFVLYNTAASVAILAGLVRAALLFLGLAAAEDEEPRXQAEAVTVTAVXPSLADRFRSRFRPSRYGRRPGGNCPVCLVRFQTESGGAPAPLRPPSSTAPASKTWIDYQPRHLARWGAHRPSCPPAVAGRTKWPPNCPE

SEQ ID NO: 60784 - DNA, 665 bp, Zea mays
  misc_feature: Ceres CLONE 1521066
  misc_feature: Encodes the peptide sequence at SEQ ID NO. 60785
  misc_feature (422)..(422): n is a, c, t, g, unknown, or other
  misc_feature (428)..(428): n is a, c, t, g, unknown, or other
ggagctccccgcggtggcggccgctctagaactagtggatcccccgggctgcaggaattcgtctcacccctagaaaaaagccgtgacggatccagccgaaccccctcgcagtcgcagccccctcacgccacgcgacatgggcaagatcaggatgcccgtgccgtccctgttccgccgccgctcctccaagccgccgccgccgcagccgcagcagcaggcgcctgccgcgggcgacggcgacagcaacgggtccccggagcgggcgacggcggaagaggacatggcgcgcgtgttccgcaagttcgacgcgaacggcgacgggcggatctcgcggtcggagctgggcgcgctgttccagagcctgggccacggcgcgtcagacgacgaagtgtcgcgcatgatggccgaggcggactcggacngctacngcttcatcaccctgcccgagttcgcggccatcaacgcacgggtggccggcaacccgggccgccatcaaagaggacctgggccacgcctttccgggttttcaagccggagggagcggcgccttttccggcccccgaattcgggggcgttcctccgaaagccttggggaaagcggcctccggtgggggaaggccccccccatgaataaaagggcttcaccaaaaaggggaaacggcccc

SEQ ID NO: 60785 - protein, 165 aa, Zea mays
  misc_feature: Ceres CLONE 1521066
  misc_feature (48)..(76): Pfam Name: efhand Pfam Description: EF hand
  misc_feature (96)..(96): Xaa is any aa, unknown, or other
  misc_feature (98)..(98): Xaa is any aa, unknown, or other
MGKIRMPVPSLFRRRSSKPPPPQPQQQAPAAGDGDSNGSPERATAEEDMARVFRKFDANGDGRISRSELGALFQSLGHGASDDEVSRMMAEADSDXYXFITLPEFAAINARVAGNPGRHQRGPGPRLSGFSSRRERRLFRPPNSGAFLRKPWGKRPPVGEGPPHE

SEQ ID NO: 60786 - DNA, 699 bp, Zea mays
  misc_feature: Ceres CLONE 1521067
gctctataactagtggatcccccgggctgcaggaattcgtctcacccctagaaaaacagaacgatctcaatctccctagcaatctctagcagcagatcctcgtgcgaagcacagcgctagcccccttcgtagtgtcccgatggcccgcacgaagtagactgtgaggaagtccactggccgacacgcgcccaggaaccccctgggcaccccggcgggccgcaattctgccccggctaccggcggatggaacactcccccccttttgccgcccgagacgccccaccccgggttatccacatgggctaaaaggagcgcctagcgtttttttttttgtggctggcgataacgggggggggcccctccttttaatccccgacccaaacaaccccccccgcccagtaagtgactataccacccccgcgcccccccagacacacccaaagggataagctacgtcggcctcccggggactttgtgcgcaggactcgggtctccccgacccccccccctttcccgcgcggccaggggccgcacctcccgataaaagagaatccctgccgccggcgtgatcaaccctcccttatttcctccgcggcgaggcgttgggattatttgtgcgccccccccttctcttccaccgccccaaagtccatcgcggtcattgatgccagcccttcgtgtttttccccccccgccccg

SEQ ID NO: 60787 - DNA, 703 bp, Zea mays
  misc_feature: Ceres CLONE 1521071
  misc_feature: Encodes the peptide sequence at SEQ ID NO. 60788
  misc_feature (583)..(583): n is a, c, t, g, unknown, or other
ctccccgcggtggcggccgctctagaactagtggatcccccgggctgcaggaattcgtctcacccctagaaaaacctagcctccaccccatccggcagcagccaaaccctacataggcgccgccgcaggcggcccccccgcatcgtcgccaaagatgcagatctttgtgaagactctgacggggaagaccatcactttggaggtggagtcctcggacaccatcgacaatgtgaaggccaagatccaggacaaggagggcatccccccggaccagcagcggctcatcttcgccggcaagcagctcgaggacggtcgcaccctcgccgactacaacatccagaaggagtccacactccacctggtgctccgcctccgcggcggcgccaagaagcgtaacaagaacacgtacaccaagccccagaagatcaagcacaagcacaagaaagtcaagctctccgtgcctgcagtctataaagtggacgacaccactagctagggtgacccgtctccgcaaggagtgcccccacacagagtgcggcgcgggcgtcttcatggccaacacttcgaccgccactactgcggnaagtgcggcctcacctttgtctacaccaggaggcgtgattgcttggcccaatttgtttttcagctaccctatcgagaatcagtggttggtacccgaatggaccccatgaaatctgcggag

SEQ ID NO: 60788 - protein, 113 aa, Zea mays
  misc_feature: Ceres CLONE 1521071
  misc_feature (6)..(74): Pfam Name: ubiquitin Pfam Description: Ubiquitin family
  misc_feature: SWISSPROT Homolog: EC 3.1.2.15 Ubiquitin thiolesterase
MQIFVKTLTGKTITLEVESSDTIDNVKAKIQDKEGIPPDQQRLIFAGKQLEDGRTLADYNIQKESTLHLVLRLRGGAKKRNKNTYTKPQKIKHKHKKVKLSVPAVYKVDDTTS

SEQ ID NO: 60789 - DNA, 642 bp, Zea mays
  misc_feature: Ceres CLONE 1521072
  misc_feature: Encodes the peptide sequence at SEQ ID NO. 60790
agagctggagctccccgcggtggcggccgctctagaactagtggatcccccgggctgcaggaattcgtctcacccctagaaaaaaccggcgagccacatcgagaacacgatcgagcacacaagcacgaagactcgtttaggagaaaccacaaaccaccaagccgtgcaagcatcatggagtacggtcagcatgggcagcgcggccacggcgccacgggccatgtcgaccagtacggcaacccagtcggcggcgtcgagcacggcaccggcggcatgaggcacggcacgggaaccaccggcggcatgggccagctgggtgagcacggcggcgctggcatgggtggcgggcagttccagcctgcgagggaggagcacaagaccggcggcatcctgcatcgctccggcagctccagctccagctcgtcggaggacgacggctatgggcggaaggaggaagaagggaatcaaggagaagatcaaagaggagcttgcccggaggccacaaggacgaccagcacgccacggcgacgaccgggcggcgccctatgggcagcagggacacaaccggcagcgcctaacgggcaacaagggacacaacgggcgggcccctaatcccaccggaacccaagggcacccggcaag

SEQ ID NO: 60790 - protein, 145 aa, Zea mays
  misc_feature: Ceres CLONE 1521072
  misc_feature (14)..(130): Pfam Name: Dehydrin Pfam Description: Dehydrin
MEYGQHGQRGHGATGHVDQYGNPVGGVEHGTGGMRHGTGTTGGMGQLGEHGGAGMGGGQFQPAREEHKTGGILHRSGSSSSSSSEDDGYGRKEEEGNQGEDQRGACPEATRTTSTPRRRPGGALWAAGTQPAAPNGQQGTQRAGP

SEQ ID NO: 60791 - DNA, 705 bp, Zea mays
  misc_feature: Ceres CLONE 1521077
  misc_feature: Encodes the peptide sequence at SEQ ID NO. 60792
  misc_feature (705)..(705): n is a, c, t, g, unknown, or other
ccccgcggtggcggccgctctagaactagtggatcccccgggctgcaggaattcgtctcacccctagaaaaaatctcacggctagctagcacaagcatagtgcaggggcttgccacctaagtaaggcccgcctgagagccatggcatccaaggccgtcctcttcttggctctcaacctcctgttcttcacggtggccaacgcctgcggcaactgcccgaccccaacgcccccggtcgagccaccgccgccgcctcctgctgctaccccacccccttcgtccagcggcaagtgcccgctgaacgcgctcaagttcagcgtgtgcgcctatgtgctcggcctcctcaaaggcaatgttggcaaggtgcctgccgagccatgctgtaccctcatcaaaggccttgcggacttcgaggccgccgtctgcctctgcacggccatcaaagccaacgtgctcggcgtcgtcgtcgatgtccccatcaagctcagcgcgctcgtcaactactgtggcaagtgcgtgcccaagggctacatgtgcgcgtaagcagctccgggcgggtacacactcgtagctgttccgtacaatattatatatgcacgcaccctgcatggcacgaatgcatgcattgtgtccgctaaatatctctcctgcctcagtgtgccactagcttttcggtctacaaacctaaaaccattccaccaaatan

SEQ ID NO: 60792 - protein, 133 aa, Zea mays
  misc_feature: Ceres CLONE 1521077
  misc_feature (51)..(132): Pfam Name: Tryp_alpha_amyl Pfam Description: Protease inhibitor/seed storage/LTP family
MASKAVLFLALNLLFFTVANACGNCPTPTPPVEPPPPPPAATPPPSSSGKCPLNALKFSVCAYVLGLLKGNVGKVPAEPCCTLIKGLADFEAAVCLCTAIKANVLGVVVDVPIKLSALVNYCGKCVPKGYMCA

SEQ ID NO: 60793 - DNA, 714 bp, Zea mays
  misc_feature: Ceres CLONE 1521080
  misc_feature: Encodes the peptide sequence at SEQ ID NO. 60794
aaagctggagctccccgcggtggcggccgctctagaactagtggatcccccgggctgcaggaattcgtctcacccctagaaaaaatccatctccaaaacgatgggcagctgacctacccaaccaccaagagctgaagagcaaattcctgtcccgcacatctgctcgccgcccagcgaacctgatggcgctcgtcgacgcgaaggccgccggcgcgtccacctccaccgtggccgctgcgcccacggtggagcacctgttgttcctcgtcgtcctcgacggcgtcgagacgcccatccacgaggggacgctgtacggaagcgccgggggcacagtcaccgtcaccggccctggccagctctccgccgacggcctcgagagcgtcctggtgcgcggcggcgggaccggggccggcgccgtgcggttcacgctctgcgccgacgcggccgccgagggcgtcggcgcggcgtgcttcgagcggtgcggcgcggcccgcgtggaaggcgcgcgcgaggtgtccctgtcctcctgcccccccgtgggaggtggagcgcgcgggcagggttcaccctcgaccggtggccgcgacgcgcggcttcccggggggaggggcggctccgtgcccaggcggggcgcggggcgcttgacctccaagaggcttcggcggggggggcccctgggcgcggttgcaaaggacttgaccgcgcccgaccggg

SEQ ID NO: 60794 - protein, 177 aa, Zea mays
  misc_feature: Ceres CLONE 1521080
MALVDAKAAGASTSTVAAAPTVEHLLFLVVLDGVETPIHEGTLYGSAGGTVTVTGPGQLSADGLESVLVRGGGTGAGAVRFTLCADAAAEGVGAACFERCGAARVEGAREVSLSSCPPVGGGARGQGSPSTGGRDARLPGGRGGSVPRRGAGRLTSKRLRRGGPLGAVAKDLTAPDR

SEQ ID NO: 60795 - DNA, 691 bp, Zea mays
  misc_feature: Ceres CLONE 1521081
  misc_feature: Encodes the peptide sequence at SEQ ID NO. 60796
aagctggagctccccgcggtggcggccgctctagaactagtggatcccccgggctgcaggaattcgtctcacccctagaaaaaaaaaactctcgctccctctcgcagacgcgcctaggtctagctagggtctggtctcgctgccccgccgcgcgcgcattcacaagcttctagacgttccgaggaggaggggaggtacccgccgccgcagccatggcgtcgactaaggtccagcgtatcatgacccagcccatcaacctcatcttccggttcctacagagcaaagcgcgcatccagatctggctcttcgagcagaaggacctccggattgagggtcgcattatcggattcgatgagtacatgaacttggtcctcgaagacgctgaggaaatcaacgtcaagaaaaacactaggaaatcactgggccggatactcctcaaaggtgacaatataactttgatgatgaacagtggcaagtgaagattcttatggcaggaacgatgtttggtgctcgcttcgattatctgtgacacatgtactccatccatccgtccagaactaaatgaaggatcaagtcatgggggtaaaggaaagttggtaaactccctgaggaacctccgtggtacctaattgctaaaagcttgggacgggaaccatttcaggggcccctggggtcccaaaaaaaaaaaaaa

SEQ ID NO: 60796 - protein, 88 aa, Zea mays
  misc_feature: Ceres CLONE 1521081
  misc_feature (19)..(85): Pfam Name: LSM Pfam Description: LSM domain
MASTKVQRIMTQPINLIFRFLQSKARIQIWLFEQKDLRIEGRIIGFDEYMNLVLEDAEEINVKKNTRKSLGRILLKGDNITLMMNSGK

SEQ ID NO: 60797 - DNA, 714 bp, Zea mays
  misc_feature: Ceres CLONE 1521082
  misc_feature: Encodes the peptide sequence at SEQ ID NO. 60798
  misc_feature (442)..(442): n is a, c, t, g, unknown, or other
  misc_feature (572)..(572): n is a, c, t, g, unknown, or other
  misc_feature (644)..(644): n is a, c, t, g, unknown, or other
  misc_feature (666)..(666): n is a, c, t, g, unknown, or other
  misc_feature (667)..(667): n is a, c, t, g, unknown, or other
  misc_feature (671)..(671): n is a, c, t, g, unknown, or other
  misc_feature (672)..(672): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (681)..(681): n is a, c, t, g, unknown, or other
  misc_feature (691)..(691): n is a, c, t, g, unknown, or other
  misc_feature (692)..(692): n is a, c, t, g, unknown, or other
  misc_feature (700)..(700): n is a, c, t, g, unknown, or other
  misc_feature (703)..(703): n is a, c, t, g, unknown, or other
tccccgcggtggcggccgctctagaactagtggatcccccgggctgcaggaattcgtctcacccctagaaaaaaaaggacacatcatctcttccaaatcccaccagcaaatccccaattcctccgagttcgagcgaccatgtcggggcgtggcaagggcgggaagggtctgggcaaaggcggcgccaagcgtcaccgcaaggttctccgcgacaacatccagggcatcacgaagccggcgatccggaggctggcgaggaggggcggcgtgaagcgcatctcggggctcatctacgaggagacccgcggcgtgctcaagatcttcctcgagaacgtcatccgcgacgccgtaacctacacggagcacgcccgccgcaagaccgtcaccgccatggacgtcgtctacgccctgcagcgccagggtcgcaccctctacggattcngcggctgagaagcgctaccgccgctggtggccgtggcaaaagtcttgggtcgcggtcagaaatcgagagtattctggatgacgtgcttagtttcgtagtattattatcactagtgcttatttgtagcggntgttgggttcgaccactctaagccactgtcaacagtaatatgagtaccgcatttcccgtgttcgacttctanatatcataatcctatggaaaannaaannttnnntaanaaaaaaaaannaaaaaaanttnaaagaaccaaa

SEQ ID NO: 60798 - protein, 103 aa, Zea mays
  misc_feature: Ceres CLONE 1521082
  misc_feature (25)..(94): Pfam Name: Histone Pfam Description: Core histone H2A/H2B/H3/H4
  misc_feature (102)..(102): Xaa is any aa, unknown, or other
MSGRGKGGKGLGKGGAKRHRKVLRDNIQGITKPAIRRLARRGGVKRISGLIYEETRGVLKIFLENVIRDAVTYTEHARRKTVTAMDVVYALQRQGRTLYGFXG

SEQ ID NO: 60799 - DNA, 707 bp, Zea mays
  misc_feature: Ceres CLONE 1521083
  misc_feature: Encodes the peptide sequence at SEQ ID NO. 60800
  misc_feature (339)..(339): n is a, c, t, g, unknown, or other
  misc_feature (444)..(444): n is a, c, t, g, unknown, or other
  misc_feature (560)..(560): n is a, c, t, g, unknown, or other
ccccgcggtggcggccgctctagaactagtggatcccccgggctgcaggaattcgtctcacccctagaaaaaggcgccacggcggcgacgagaagtggcgagccccgagagcgggtttagttagaggctacgggcggtcgggcgcggcggcggcggcggccatgagcagcgggagcgagagcactaccgccagcaggtggcccgagctggccacgctgcgcgcgctggcgcgcgacgccgcggagcagcttcggctgccgcgggccggcacgtcggcgtcggcgtcgtcgccgtggcgcgggcgcgaggaccacctccacggccacggcaagacggccnaggtgatgcacctgctgctctggggacccaagtgaagcggcgagaggccaccgtacccgcggggctctccgctgggcgtgctcgttttgctctgcctgcaatccngcccgcacggactgtactgtacctatatatacacctacatactacgacgtgcacctgtactacgacgtgctgctgtaccatactaaatactagtgcgctgctgctccctggcttcntgcttgcacagccactcggctttttgctcaaacatcgactgctcgtgtcccgtccggccacgccgggcctcaatttgggtgggccactcaccggaaagctcttttttggggacccctgcctgcaaagttagcgacgtggacttagtt

SEQ ID NO: 60800 - protein, 70 aa, Zea mays
  misc_feature: Ceres CLONE 1521083
  misc_feature (60)..(60): Xaa is any aa, unknown, or other
MSSGSESTTASRWPELATLRALARDAAEQLRLPRAGTSASASSPWRGREDHLHGHGKTAXVMHLLLWGPK

SEQ ID NO: 60801 - DNA, 855 bp, Zea mays
  misc_feature: Ceres CLONE 1521084
  misc_feature (349)..(349): n is a, c, t, g, unknown, or other
  misc_feature (401)..(401): n is a, c, t, g, unknown, or other
  misc_feature (855)..(855): n is a, c, t, g, unknown, or other
agagctggagctccccgcggtggcggccgctctagaactagtggatcccccgggctgcaggaattcgtctcacccctagaaaaactcctctatcttcgcatctggcacgagcagccaagcaaataaaagtagagcggcgagcgacgaccggcctgggccaccctttcgggcgagcgtagccgagcaggtcgtcgtcgtcgtcgcagcaccccgccgggtagcatggccaccaggaggcagtgtggggggcggagcctgctgctgctggcggcgtgggggttgcgccgccgccgggcaggcggccgcctggaggtggacccctttgccatcaggtgggagggggaattanggaaaaaaaaatttaccccccccccccccgggggggggtggggggggttttnatcctcccccccccccccccccggggggggggctggtggacgggaaaaatggggcgccccccacctgcgctctcggctacatacatccccccctttggggtgaccccggtggtgccagaatccgtgtctcatgtccgcgcgagggccctggcggctttctttgaccgagctcctcggggccccccccccggccgccgctgggtaccctacccctcaagtcctccgtgggttctacgccgtttggcagttgaaccccggatcactagcccgattatccgccggtgttctatcgggattctcccgccccccatgtgaccctgcggactctcctggggacagcacctccccgccacctcctgggcgtgccccctctcgttgcccctcaacgcccggggagcgtgtagccttgctgcccctcggtgctcgtggcgcctctccctcgcgcccgcccccn

SEQ ID NO: 60802 - DNA, 718 bp, Zea mays
  misc_feature: Ceres CLONE 1521087
  misc_feature: Encodes the peptide sequence at SEQ ID NO. 60803
  misc_feature (329)..(329): n is a, c, t, g, unknown, or other
  misc_feature (406)..(406): n is a, c, t, g, unknown, or other
  misc_feature (473)..(473): n is a, c, t, g, unknown, or other
  misc_feature (477)..(477): n is a, c, t, g, unknown, or other
  misc_feature (592)..(592): n is a, c, t, g, unknown, or other
ctccccgcggtggcggccgctctagaactagtggatcccccgggctgcaggaattcgtctcacccctagaaaaaagcaaggccaagaatgccacacccacccatggcgctcctcctctccccgaccgtttccttcctggtctccccgtgtgctccacgccctcgagctctctccgctgccgccaatgtatcctaccccgcctcaaggctgcaatgcaagaacctgtcctcccaacagagccctctgaatgtgactgctacctgtgcttctttcgctgagaagaggctggttcttgtccatgccacggcagagggttctgaggctggtgncgagcagccagaagagccgaaaccagcgaccaagatcgaggaaatgccgctcgagtcgaagcagaagatgatcatgnagcaaagagcgcggatgaagcttgcaagaaactgaagcagcggcgcaagcggcttctccgcaagaangagnctaggaaagaggccaggtggccaccgtccaagatggaaaactccagaatgtatgaccagcggcaccgttaactggcatctgccttggttttatgggttggaattgaattgcacanctaccaattttgtggtcaaatttgaaacccgggacctaaaaaatggaacccggttttcacgaattgagaactctctaccgccaaaaaaaaaaaaaaaaaaaaacctctcagggacccaatttcccc

SEQ ID NO: 60803 - protein, 112 aa, Zea mays
  misc_feature: Ceres CLONE 1521087
  misc_feature (76)..(76): Xaa is any aa, unknown, or other
  misc_feature (102)..(102): Xaa is any aa, unknown, or other
MALLLSPTVSFLVSPCAPRPRALSAAANVSYPASRLQCKNLSSQQSPLNVTATCASFAEKRLVLVHATAEGSEAGXEQPEEPKPATKIEEMPLESKQKMIMXQRARMKLARN

SEQ ID NO: 60804 - DNA, 688 bp, Zea mays
  misc_feature: Ceres CLONE 1521091
  misc_feature: Encodes the peptide sequence at SEQ ID NO. 60805
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (554)..(554): n is a, c, t, g, unknown, or other
  misc_feature (555)..(555): n is a, c, t, g, unknown, or other
  misc_feature (564)..(564): n is a, c, t, g, unknown, or other
aaagctggagctcaccgcggtggcggccgctctagactagtggatcccccgggctgcaggaattcgtctcacccctagaaaactagccgccgccagaccattcgtttctcgcgagccatcgcttctgcatccggaagaaatggccaagtcgaagaaccacacggcgcacaaccagtcgttcaaggcgcacaagaacggcattaagaaacccaagcgccaccgccagacctccaccaaggggatggaccccaagttcctgaggaacctgaggtattctaggaagggcaacaaaaagagtggtgaggctgaagctgaggagtaggaaggaaagcatggctttgtttcctctgtttttagctcagttccacctttaggacctggggttttgctaaagatggaacttaagtggtgttactgtatgatggcaaggaccttttgccccccaacggtatgttttgaagttcatgctaccttttaaagtacggattaccttgtgcccaaaaaaaactaaaccctcaaatttacataatannngtatttaatatatggaaaannaaataaaanccgggaccccccagggacccaaattccccccttaggggggcccaaatacacccccccccccgggccccctttttaacaaccccttggctggggaaaacccctgggttttccccaatttaatccc

SEQ ID NO: 60805 - protein, 60 aa, Zea mays; identical to SEQ ID NO: 2158
  misc_feature: Ceres CLONE 1521091
  misc_feature (3)..(42): Pfam Name: Ribosomal_L29e Pfam Description: Ribosomal L29e protein family

SEQ ID NO: 60806 - DNA, 676 bp, Zea mays
  misc_feature: Ceres CLONE 1521095
  misc_feature: Encodes the peptide sequence at SEQ ID NO. 60807
  misc_feature (473)..(473): n is a, c, t, g, unknown, or other
  misc_feature (526)..(526): n is a, c, t, g, unknown, or other
ctggagctccccgcggtggcggccgctctagaactagtggatcccccgggctgcaggaattcgtctcacccctagaaaaaattagcaaggcgatagataagaggaaggaaagaacataggcagccgaagcgactgtcgcgaggcaaggccatcgtccgccatgacgctctccctctccacctctttcctccccatccccgccgccgcgaggaccaccgcccgcaccctacgctccgtcgtcccctcccaggggatgcgctgctcgatgcgcaagaaggggttgcacccggagatctacgaggacgcgaaggtgtactgcaacggcgagctggtgctggtgacggggggcaccaagccggagtacacggtggacgtgtggtccggaaaccacccctactacgtcggcgacacctcggcgctcgtggtcatggacagccagatcgagaagttccgcaagaagtggggcacatcanggagtactggcccgaggaccagtggagggagatgcacccagacggcgacccgnagttcgagccctgaggggggacactgatgatggctccccgtcttcctcacccggtgcgtggtcacccggtcagtttacatttgccctcttgatgggaattgaaccctgttctgtcccttgcttctcaggggttcggttaaggttcggatg

SEQ ID NO: 60807 - protein, 99 aa, Zea mays
  misc_feature: Ceres CLONE 1521095
  misc_feature (5)..(73): Pfam Name: Ribosomal_L31 Pfam Description: Ribosomal protein L31
  misc_feature (74)..(74): Xaa is any aa, unknown, or other
MRCSMRKKGLHPEIYEDAKVYCNGELVLVTGGTKPEYTVDVWSGNHPYYVGDTSALVVMDSQIEKFRKKWGTSXSTGPRTSGGRCTQTATRSSSPEGGH

SEQ ID NO: 60808 - DNA, 725 bp, Zea mays
  misc_feature: Ceres CLONE 1521096
  misc_feature: Encodes the peptide sequence at SEQ ID NO. 60809
ggagctccccgcggtggcggccgctctagaactagtggatcccccgggctgcaggaattcgtctcacccctagaaaaaaaaaccagtccccgccgccgactgggaatgtcgtcggccgagatcggatgcccatctgtgctgcttcacggcgccagagttctcgtcgacgttcggtaacttgctccgtccttggggagatggaaagacaagcatgactagagcgacaaggggctcttctcgaacatgatgcacggtgttgccggtggtcatggctacccccaccatggataccctccgcatggctacccaccgcaaccagtagcatacccgcctccgccaggggcgtatcctcctcctccaggggcatatcctcctccacctgaggcatacccaccacaatatgggtaccctcaaccaggtggctacccgcctcagggtggatatcctcctgcaggctaccccggctcatctcaccagtgttatggcagcaccacggcgggtgccacggcggcatcatgtagacggtggcaatgctagcaggatgtgctgccgcgactgctgcctcttatggaacaacaagctttctcatggccatagcggacatcgtgtacatggcgcctttcgcagctatggtcacttgtgatcaccgtcacggtatcgtcgtccacgggatgtcaagtatgtgcctggccaccacgctgagtcaaacacgggtacggcaagtt

SEQ ID NO: 60809 - protein, 97 aa, Zea mays
  misc_feature: Ceres CLONE 1521096
MMHGVAGGHGYPHHGYPPHGYPPQPVAYPPPPGAYPPPPGAYPPPPEAYPPQYGYPQPGGYPPQGGYPPAGYPGSSHQCYGSTTAGATAASCRRWQC

SEQ ID NO: 60810 - DNA, 689 bp, Zea mays
  misc_feature: Ceres CLONE 1521097
  misc_feature: Encodes the peptide sequence at SEQ ID NO. 60811
aaagctggagctccccgcggtggcggccgctctagaactagtggatcccccgggctgcaggaattcgtctcacccctagaaaaatagaaaaaatccactctcatcaccagctaagaacagggcttcgtctcaatggaaggcaaaacagggcagctcaggtgctgtttcgtcgccatcgtgctcgtcctgggtcttgtccttgagtcccaccaggctgaagctggaggcaaatggtgctgcgaaaccgccaccggaaaataccattttaatcgctgcgttgactcgggtttggtcgacaatattgggttctgtgcgggtaatgccggttgcatcattatggaagacagatgtggaggccgttggccggtgcctgctcgtgatgcgctttccctggatgtcatttgatcaattataagcaagtacgtgaagaaacgagggccagacgactgtcgtccagcgattggttatttgtgaacttgtcgtttgtcttcttatttcaactttcccataagccccttcgtgaagtgtcatccccttcaaagtctgtcgactgttacgtatacaaatctatatatcaaataaagacggcggccgtacgtgtgtaaaaaaaaaaaaaaaaccaaaacgctcgagggtcccaattccgccctatagtggagccgtaatacggcgccgcttccctgggcgtc

SEQ ID NO: 60811 - protein, 90 aa, Zea mays; identical to SEQ ID NO: 53771
  misc_feature: Ceres CLONE 1521097

SEQ ID NO: 60812 - DNA, 771 bp, Zea mays
  misc_feature: Ceres CLONE 1521098
  misc_feature: Encodes the peptide sequence at SEQ ID NO. 60813
  misc_feature (79)..(79): n is a, c, t, g, unknown, or other
  misc_feature (228)..(228): n is a, c, t, g, unknown, or other
  misc_feature (252)..(252): n is a, c, t, g, unknown, or other
  misc_feature (254)..(254): n is a, c, t, g, unknown, or other
  misc_feature (260)..(260): n is a, c, t, g, unknown, or other
  misc_feature (304)..(304): n is a, c, t, g, unknown, or other
  misc_feature (309)..(309): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (392)..(392): n is a, c, t, g, unknown, or other
  misc_feature (394)..(394): n is a, c, t, g, unknown, or other
  misc_feature (399)..(399): n is a, c, t, g, unknown, or other
  misc_feature (400)..(400): n is a, c, t, g, unknown, or other
  misc_feature (726)..(726): n is a, c, t, g, unknown, or other
agagctggagctcaccgcggtggcggccgctctagactagtggatttcctgggctgcaggaattcgttctcaccttagngagtaccaccagtaccacaccactccgcgctagctgaggacggtacagcggcacagaggtgcgacgtacgacgacgacgacgcaggcgccacacatggcatcccagctctccgccgccgtgccccggttccacggcctccggggctacnccgcgcccaggtccgcggtggcancnctgccntccgtgagggtgggcaggaataggtcctcgtcgcagggtatccnctgcnactacttcggttccgccaccaacctgatcatggggacaacaactattttgcaccccccccccgggggggggggggggtgnnnncnaaaannaaaaccacaccccgggggggggggggtgtaggatggggggcgcctctacctccgggcctggggagacggatgacccccggccggggatccccccccggcccggccgcgccgggcctgggataaaccactccggccaggatcctttgggggggtgaggggggggcgggcggggcctcaaaagagcgcggcgggtgttccagcgggagagattcggtttaagtgcccttgggcgccgccccgtgttagagaggcgggggctgggtggtctgtcgttggcgcctgaagggcgggtagataggggggggggggaggggtgggggcttgtntgcggggcgggggcgggcgagcggtggaagaagctatccgcatcg

SEQ ID NO: 60813 - protein, 85 aa, Zea mays
  misc_feature: Ceres CLONE 1521098
  misc_feature (19)..(19): Xaa is any aa, unknown, or other
  misc_feature (27)..(27): Xaa is any aa, unknown, or other
  misc_feature (44)..(44): Xaa is any aa, unknown, or other
  misc_feature (46)..(46): Xaa is any aa, unknown, or other
  misc_feature (72)..(72): Xaa is any aa, unknown, or other
  misc_feature (73)..(73): Xaa is any aa, unknown, or other
  misc_feature (74)..(74): Xaa is any aa, unknown, or other
  misc_feature (76)..(76): Xaa is any aa, unknown, or other
MASQLSAAVPRFHGLRGYXAPRSAVAXLPSVRVGRNRSSSQGIXCXYFGSATNLIMGTTTILHPPPGGGGGXXXKXKPHPGGGGV

SEQ ID NO: 60814 - DNA, 695 bp, Zea mays
  misc_feature: Ceres CLONE 1521101
  misc_feature: Encodes the peptide sequence at SEQ ID NO. 60815
aaagctggagctccccgcggtggcggccgctctagaactagtggatccccctgggctgcaggaattcgtctcacccctagaaaaaaaaaaccctacccgactccgccgccgcccgccgctccgcctcagcgcatagcccgccgcgacctcatcgatcaccttcaactttcaatcatggcggacgtcgatgtcgaaccggaggttgccgccggagctcccaagaagaggacgttccgcaagtacagctaccgcggcgtcgacctagatgcgcttctcgacatgtccacggacgacctcgtccagctcttccccgcgcgcgccaggagaaggttccagaggggtctgaagaggaagcccatggcgctcatcaagaagctgcgcaggggcgaaaaagatgctcctgctggtgagaaaccagagccagtcaagacacatctccgtaacatgatcattgtccctgagatgattggaagcattgttggtgtctacaacgggcagaccttcaaccaggttgagatcaagcctgagatgatcgggcactacctttgctgaggtcttcatctcctataagccggtcaagcatggcaggccccgggatcggtggccccccactccttcccgggttaatccttcctgaaatgaagctgtaacccgggctctgtagtcctcccaagagtcagttgggcaaagttcct

SEQ ID NO: 60815 - protein, 125 aa, Zea mays
  misc_feature: Ceres CLONE 1521101
  misc_feature (55)..(124): Pfam Name: Ribosomal_S19 Pfam Description: Ribosomal protein S19
MADVDVEPEVAAGAPKKRTFRKYSYRGVDLDALLDMSTDDLVQLFPARARRRFQRGLKRKPMALIKKLRRGEKDAPAGEKPEPVKTHLRNMIIVPEMIGSIVGVYNGQTFNQVEIKPEMIGHYLC

SEQ ID NO: 60816 - DNA, 672 bp, Zea mays
  misc_feature: Ceres CLONE 1521106
  misc_feature: Encodes the peptide sequence at SEQ ID NO. 60817
  misc_feature (430)..(430): n is a, c, t, g, unknown, or other
  misc_feature (471)..(471): n is a, c, t, g, unknown, or other
  misc_feature (499)..(499): n is a, c, t, g, unknown, or other
  misc_feature (514)..(514): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
ctggagctccccgcggtggcggccgctctagaactagtggatcccccgggctgcaggaattcgtctcacccctagaaaaagccaaccgcgaagcactacactacactacaccacacccacccgacgacgatcacacacgcagaagatcgagttcgttcgatcgtgaccgtgacgcaggaagctataagctagccaagacaggaataataatggcggcgtcgacggtggcgagcctctctgtcccggtgacgacgacgaccttcgcggcggcggcggcagcgggcggcgccgacgtgctgatcgtcgtcccgaggagggcgggcgctgggcgcgtctggttccccctgcgcggcgcgccgcggcggcggcagcgggcggttggtcgccgtgcggtccagcgggccggccacgccgtcggagatctccgacnaggtgtcggagagtcatcagcaggcggaagagacgtgcgcngacgaccagaaaggcaaccccaattgcntcggcggctgggacnaagttgggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 60817 - protein, 105 aa, Zea mays
  misc_feature: Ceres CLONE 1521106
  misc_feature (74)..(74): Xaa is any aa, unknown, or other
  misc_feature (88)..(88): Xaa is any aa, unknown, or other
  misc_feature (97)..(97): Xaa is any aa, unknown, or other
  misc_feature (102)..(102): Xaa is any aa, unknown, or other
MAASTVASLSVPVTTTTFAAAAAAGGADVLIVVPRRAGAGRVWFPLRGAPRRRQRAVGRRAVQRAGHAVGDLRXGVGESSAGGRDVRXRPERQPQLXRRLGXSWG

SEQ ID NO: 60818 - DNA, 689 bp, Zea mays
  misc_feature: Ceres CLONE 1521107
  misc_feature: Encodes the peptide sequence at SEQ ID NO. 60819
  misc_feature (486)..(486): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (651)..(651): n is a, c, t, g, unknown, or other
  misc_feature (653)..(653): n is a, c, t, g, unknown, or other
  misc_feature (654)..(654): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (677)..(677): n is a, c, t, g, unknown, or other
  misc_feature (678)..(678): n is a, c, t, g, unknown, or other
ctggagctccccgcggtggcggccgctctagaactagtggatcccccgggctgcaggaattcgtctcacccctagaaaaaatcgtcacaacgcgtcctcgaataaaaatccagacgaaacccaaaatccccaccgaacgcaacctaaaatctccccatccctcctcgatccagccccgcggagaagagccatggccgattccgcaaccaacgacgcccccctggtcgccagcaaccagcccacggaggaggaggtgacggtggagagggccgcggcgacggaggagcaggaggaggagaggctgcggtacctcgagttcgtgcagcaggcggcggcgcaggcgctggtgctggcggccgcggcgtacgcgtacgccaagcagggcgccggcccgctccgccccggggtcgatcaggtcgagggcaccgtgaagggcgtcgtcggccccgtctacgaccgtttccacgccgtcccgctcgacctccntcagttcatcgaccgcaaggtgaggaggcgggttctccgtatgttgaaaattgtgctgcaaaattaggccgttctatgaaatgaaatttaccgggtgcaggtttccacgggtggaatttttgcccnnnnnnnnnnannnnnnnnnaaaannnnnnnnnnnnnnanannannnnnnnnnnnnnnnnnnnccnncccccccccca

SEQ ID NO: 60819 - protein, 120 aa, Zea mays
  misc_feature: Ceres CLONE 1521107
  misc_feature (29)..(121): Pfam Name: REF Pfam Description: Rubber elongation factor protein (REF)
  misc_feature (99)..(99): Xaa is any aa, unknown, or other
MADSATNDAPLVASNQPTEEEVTVERAAATEEQEEERLRYLEFVQQAAAQALVLAAAAYAYAKQGAGPLRPGVDQVEGTVKGVVGPVYDRFHAVPLDLXQFIDRKVRRRVLRMLKIVLQN

SEQ ID NO: 60820 - DNA, 697 bp, Zea mays
  misc_feature: Ceres CLONE 1521108
  misc_feature: Encodes the peptide sequence at SEQ ID NO. 60821
  misc_feature (520)..(520): n is a, c, t, g, unknown, or other
  misc_feature (529)..(529): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (670)..(670): n is a, c, t, g, unknown, or other
  misc_feature (672)..(672): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (687)..(687): n is a, c, t, g, unknown, or other
  misc_feature (688)..(688): n is a, c, t, g, unknown, or other
  misc_feature (690)..(690): n is a, c, t, g, unknown, or other
  misc_feature (695)..(695): n is a, c, t, g, unknown, or other
aagctggagctccccgcggtggcggccgctctagaactagtggatcccccgggctgcaggaattcgtctcacccctagaaaaacccttctccgccgccacgctagagaggaagagcgcgcggagagcgagagcccgggagaaacagcggccggcggcaaaatggtgcagcggctcacctaccggaagcgccacagctacgccacaaaatccaatcagacccgcgtggtcaagacccctggtgggaggcttgtgtaccagtacaccaagaagcgcgcgagcggaccgaaatgcccggtcaccgggaagaagatccaaggaattccacacctgagacctgctgagtacaagaggtccaggttggcaaggaaccgcaggactgtgaaccgtccatatggtggtgttctgtctggtaccgcagtgagagagaggatcatccgtgcctttttggtcgaggagcagaagatcgtgaaagaggttttgaagatccaaaaaaccaaagataaggcctccaagaactangcgatatangcatcttccacaatggttaagtcccctagaaatttgtttcagcaagaaaattttctctggggtttggggaattttgaatacttacccaaaatatgcgaagatgatatgggtttaaatttttgagcggaannnnnnnnaaananannnnaannnnnnannanaaaanaa

SEQ ID NO: 60821 - protein, 163 aa, Zea mays
  misc_feature: Ceres CLONE 1521108
  misc_feature (5)..(103): Pfam Name: Ribosomal_L34e Pfam Description: Ribosomal protein L34e
  misc_feature (120)..(120): Xaa is any aa, unknown, or other
  misc_feature (123)..(123): Xaa is any aa, unknown, or other
MVQRLTYRKRHSYATKSNQTRVVKTPGGRLVYQYTKKRASGPKCPVTGKKIQGIPHLRPAEYKRSRLARNRRTVNRPYGGVLSGTAVRERIIRAFLVEEQKIVKEVLKIQKTKDKASKNXAIXASSTMVKSPRNLFQQENFLWGLGNFEYLPKICEDDMGLNF

SEQ ID NO: 60822 - DNA, 601 bp, Zea mays
  misc_feature: Ceres CLONE 1521109
  misc_feature: Encodes the peptide sequence at SEQ ID NO. 60823
  misc_feature (41)..(41): n is a, c, t, g, unknown, or other
  misc_feature (69)..(69): n is a, c, t, g, unknown, or other
  misc_feature (198)..(198): n is a, c, t, g, unknown, or other
tccccgcggtggcggccgctctagaactagtggatcccccngggctgcaggaattcgtctcacccctangaaaaaaaccaccaccaccaaccaaccaaccaaccacagttccatataggcagcatcggctacacagctcgcctccgtagcagagtgtgtcgttttgcggagcaggagagagacgacggcggccatggncgacctcctttcaggggacgacccaccaggtgcaccggcttgcaacaggacttgggttactttggggcacaggttcaccgcccgaaaaaccggattttaccaaagggggcctggtttttccgttggcccccccttttggagggggacccctttaaggttttccgaaaaattaaatttcctttttgaggggggggttttttttggggggtctcttttttccaacttttttttaaaagaaaggggggtttttttaaaaaattttttttaaaaaaccctctcccggggtttttccccccaaaaaaaacattttggggggagaaaagatgttttataatttctccccccccctttttttttttcgccccaaaaaaaaaaaatttttttttttttgtcccccacccac

SEQ ID NO: 60823 - protein, 90 aa, Zea mays
  misc_feature: Ceres CLONE 1521109
  misc_feature (2)..(2): Xaa is any aa, unknown, or other
MXDLLSGDDPPGAPACNRTWVTLGHRFTARKTGFYQRGPGFSVGPPFWRGTPLRFSEKLNFLFEGGVFFGGSLFSNFFLKERGVFLKNFF

SEQ ID NO: 60824 - DNA, 677 bp, Zea mays
  misc_feature: Ceres CLONE 1521110
  misc_feature: Encodes the peptide sequence at SEQ ID NO. 60825
  misc_feature (523)..(523): n is a, c, t, g, unknown, or other
  misc_feature (529)..(529): n is a, c, t, g, unknown, or other
  misc_feature (535)..(535): n is a, c, t, g, unknown, or other
  misc_feature (538)..(538): n is a, c, t, g, unknown, or other
  misc_feature (553)..(553): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (571)..(571): n is a, c, t, g, unknown, or other
  misc_feature (592)..(592): n is a, c, t, g, unknown, or other
  misc_feature (596)..(596): n is a, c, t, g, unknown, or other
  misc_feature (618)..(618): n is a, c, t, g, unknown, or other
ctggagctccccgcggtggcggccgctctagaactagtggatctcccgggctgcaggaattcgtctcacccctagaaaaccgtgctttcttagaggtgggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgctgtgatggcngtggcngctacngcngtgggcgcggctacngtggcnnngcgcgctacngtgggtggtgggcgcgctacngcgntggcaaccgtggcggcggctanctgcactccgacgggaaactgaggaaactgagcgtgggggctgcgcggccaagtatctt

SEQ ID NO: 60825 - protein, 165 aa, Zea mays
  misc_feature: Ceres CLONE 1521110
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (115)..(115): Xaa is any aa, unknown, or other
  misc_feature (117)..(117): Xaa is any aa, unknown, or other
  misc_feature (119)..(119): Xaa is any aa, unknown, or other
  misc_feature (120)..(120): Xaa is any aa, unknown, or other
  misc_feature (125)..(125): Xaa is any aa, unknown, or other
  misc_feature (127)..(127): Xaa is any aa, unknown, or other
  misc_feature (131)..(131): Xaa is any aa, unknown, or other
  misc_feature (138)..(138): Xaa is any aa, unknown, or other
  misc_feature (139)..(139): Xaa is any aa, unknown, or other
  misc_feature (146)..(146): Xaa is any aa, unknown, or other
MAASDVEYRCFVGGLAWATDDHSLHNAFSTYGEVLESKIILDRETQRSRGFGFVTFSTEEAMRNAIEGMNGKELDGRNITVNEAQSRGGRGGGGGGYGGGRGGGGYGGGGRCDGXGXYXXGRGYXGXARYXGWWARYXXGNRGGGXLHSDGKLRKLSVGAARPSI

SEQ ID NO: 60826 - DNA, 699 bp, Zea mays
  misc_feature: Ceres CLONE 1521112
  misc_feature: Encodes the peptide sequence at SEQ ID NO. 60827
  misc_feature (526)..(526): n is a, c, t, g, unknown, or other
  misc_feature (574)..(574): n is a, c, t, g, unknown, or other
ctccccgcggtggcggccgctctagaactagtggatcccccgggctgcaggaattcgtctcacccctagaaaaaaccacacgagagaagagaagctagcgttcaacagaggaagaagcgagagagctgacaagaatcgactgccatcaatggctctggcgccggcgcctctccagtgcttcctcacgagcagcagaccggccgtatgcacggcgacgccgcccaataagcgcgcgaggaggccgtcgaggatctcgtgcagggcgtccggcgatgacaaggacaaggtcccgtcgtcgggagggagcgatcttggggtcaagcagctcgggaagctggccatggtcgcgctggccgccggcgtgctggtgctcggccccgtcgacggtgccgtggcggccaagtcccggcgcagggtcggcgggcaggcgtcctggtccgcgcctcggtcgtccggccctcggatcaacaactccaggacaacatctacatcaacccgccggtggcgccgccgctgggccgatacnggtaccgaagccccttctttcggggctacggttaccggtgggccccgnttcagtttcctcccccccccgggccaggttccccttcggggtcggcgggggctttcaaaaaccccctcccttttttgggggcggggcccgttccccgaaacttttcaggggttccccaaagggaa

SEQ ID NO: 60827 - protein, 183 aa, Zea mays
  misc_feature: Ceres CLONE 1521112
MALAPAPLQCFLTSSRPAVCTATPPNKRARRPSRISCRASGDDKDKVPSSGGSDLGVKQLGKLAMVALAAGVLVLGPVDGAVAAKSRRRVGGQASWSAPRSSGPRINNSRTTSTSTRRWRRRWADTGTEAPSFGATVTGGPRFSFLPPPGQVPLRGRRGLSKTPSLFWGRGPFPETFQGFPKG

SEQ ID NO: 60828 - DNA, 670 bp, Zea mays
  misc_feature: Ceres CLONE 1521118
  misc_feature: Encodes the peptide sequence at SEQ ID NO. 60829
  misc_feature (330)..(330): n is a, c, t, g, unknown, or other
  misc_feature (499)..(499): n is a, c, t, g, unknown, or other
  misc_feature (605)..(605): n is a, c, t, g, unknown, or other
  misc_feature (621)..(621): n is a, c, t, g, unknown, or other
acccgcggtggcggccgctctagaactagtggatcccccgggctgcaggaattcgtctcacccctagaaaaaaaaaagaggaaaaaaatgttatcttctacctccttagctgctcttctccatggccgcccccattatcctttccctccgtcgaaggcgcatcttttcctagctctccccaacaaccctacccgtttcctggcctcggcctccgtccgggtcgcctatcctccccggtggcctctccgcgccgccgacggggagcgggacaaccgcgtgcaggagctgagggtgcccgattcttggctgacgcctgcaggagcaacgcangaatctgaatggctgagggagacactgcgcaagtggctcgacgacgagtactgcccggagccggccaacgtggacatcagcagcaccgccgcgcggtcgtatcgcgaatccctgatagcgcggcagtctgacctgggagagatcttgctgaagatggtgggcgacctgnacaagctgtcgtacagggagagcttccacggccccttctcggcggccaacgctgcagtccgtttgatcgctcagaggatggaggagtcactgcctgatgaatgacngtggtgcgcgacctgnagttctatatggcacgacttttgatgaagtcgtaggctatatgtacttt

SEQ ID NO: 60829 - protein, 171 aa, Zea mays
  misc_feature: Ceres CLONE 1521118
  misc_feature (81)..(81): Xaa is any aa, unknown, or other
  misc_feature (138)..(138): Xaa is any aa, unknown, or other
MLSSTSLAALLHGRPHYPFPPSKAHLFLALPNNPTRFLASASVRVAYPPRWPLRAADGERDNRVQELRVPDSWLTPAGATXESEWLRETLRKWLDDEYCPEPANVDISSTAARSYRESLIARQSDLGEILLKMVGDLXKLSYRESFHGPFSAANAAVRLIAQRMEESLPDE

SEQ ID NO: 60830 - DNA, 674 bp, Zea mays
  misc_feature: Ceres CLONE 1521125
  misc_feature: Encodes the peptide sequence at SEQ ID NO. 60831
ctccccgcggtggcggccgctctagaactagtggatcccccgggctgcaggaattcgtctcacccctagaaaaactcgtgtgtctggaaaccctagccgccatatctcacgatccactcgagcaccaagccgagggaaggtgaggagcgatggcgcgcggcgtggtgtcggcgaagggcggcgcggtcgcgggcaagaagaaggggtcggtttccttcacgatcgactgcaccaagccagtggaggacaagatcatggaggtcgcctcgctcgagaagttcctgcaggagcgcatcaaggtcgccggcggcaaggctggcaacctcggcgactccgtcaccatctctcgcgagaagaccaaggtcaccgtcgcctctgacggacccttctccaagaggtacctccaccacttgaccaagaagtacttgaagaagcacaacgtgcgggattggctacgcgtggttgctgccaacaaggaccgaaacgtctatgagctccgctacttcaacattgctgaaaacgagggcgaggaagaagattagattgccctacccttatattttagtattgaactcgttgcattttgatacctgtacccctagttttcccaatgtcccatgttatggtgtggtatggttaatttgaagaatccttatgactgaatctcttgcaaa

SEQ ID NO: 60831 - protein, 130 aa, Zea mays
  misc_feature: Ceres CLONE 1521125
  misc_feature (16)..(130): Pfam Name: Ribosomal_L22e Pfam Description: Ribosomal L22e protein family
MARGVVSAKGGAVAGKKKGSVSFTIDCTKPVEDKIMEVASLEKFLQERIKVAGGKAGNLGDSVTISREKTKVTVASDGPFSKRYLHHLTKKYLKKHNVRDWLRVVAANKDRNVYELRYFNIAENEGEEED

SEQ ID NO: 60832 - DNA, 674 bp, Zea mays
  misc_feature: Ceres CLONE 1521126
  misc_feature: Translation starting site: 147
  misc_feature: SWISSPROT Homolog: EC 2.7.4.6 Nucleoside-diphosphate kinase
ctggagctccccgcggtggcggccgctctagaactagtggatcccccgggctgcaggaattcgtctcacccctagaaaaaaactccgacggcgccgacaaaaccagaccatcaaacaagtgccagcgccctctcgcagtcgccgcaatggagagcaccttcatcatgatcaagcctgacggcgtccagaggggcctcattggtgagatcatcagccgttttgagaagaagggcttctacctcaaggccttgaagcttgtgaacgtggagaggtcgtttgctgagaacactacgccgatctcgcctccaagcccttcttccagggcctcgtggactacatcatctctggccctgtggtggccatggtctgggagggcaagagcgtcgtcacaactggccgcaagatcattggcgccaccaaccccctggcttctgagcccggcaccatccgtggcgacttttgctgtcgacattggcaggaatgtcattcatgaaagtgacagcattgagagtgctaataaggagattgccctgtggttcccccgagggccctgctgattggcagagcacccagcacccctggatctacgaggggtaaacatggaaagtttcccatcaaaaccttgagaagccaaggaaagctgtcacaatttgggctttaaccatgtttttcaa

SEQ ID NO: 60833 - DNA, 649 bp, Zea mays
  misc_feature: Ceres CLONE 1521127
  misc_feature: Encodes the peptide sequence at SEQ ID NO. 60834
  misc_feature (378)..(378): n is a, c, t, g, unknown, or other
  misc_feature (379)..(379): n is a, c, t, g, unknown, or other
  misc_feature (380)..(380): n is a, c, t, g, unknown, or other
  misc_feature (489)..(489): n is a, c, t, g, unknown, or other
  misc_feature (490)..(490): n is a, c, t, g, unknown, or other
ctggagctccccgcggtggcggccgctctagaactagtggatcccccgggctgcaggaattcgtctcacccctagaaaaagctatctaggctagtctacagctagtacacgacccacggcaatcgtcgtcgtggtcgtggcggattggagttgacagttgcgataccactagtactagctcgctcgctcgttctcagaactgatcgctgtgaggagtatgccgtcgctgtggccaacgaggaagaagcgggcgcgaggctcggcggtccggtcgtggtcgcgccgccgcgggagcaagaaatcatcgtcgtcgtcgtcgctgggggcgctgtggcggcggatggtcgggccacgcagggggacccggacccgactcgnnnaccgtgccgggggagaagccgggcctgctctcgcgcgccgcgcgggtgctctcctggcggcggcgcttctactgatcgatgccatccgggcgcgaaccggccggggggnnattaaatcgtccgaatcagaatctgccgtgacttgcgcccgtgaacttggcctcatttttctttctgggccgggtttgttaattgcccccccaacccctgctgttttcccggggcggggtccaaacctgcggggggggcaaaaaaagcgccctcggggg

SEQ ID NO: 60834 - protein, 144 aa, Zea mays
  misc_feature: Ceres CLONE 1521127
  misc_feature (54)..(54): Xaa is any aa, unknown, or other
  misc_feature (55)..(55): Xaa is any aa, unknown, or other
  misc_feature (91)..(91): Xaa is any aa, unknown, or other
MPSLWPTRKKRARGSAVRSWSRRRGSKKSSSSSSLGALWRRMVGPRRGTRTRLXXRAGGEAGPALARRAGALLAAALLLIDAIRARTGRGXIKSSESESAVTCARELGLIFLSGPGLLIAPPTPAVFPGRGPNLRGGQKKRPRG

SEQ ID NO: 60835 - DNA, 680 bp, Zea mays
  misc_feature: Ceres CLONE 1521128
  misc_feature: Encodes the peptide sequence at SEQ ID NO. 60836
  misc_feature (397)..(397): n is a, c, t, g, unknown, or other
  misc_feature (513)..(513): n is a, c, t, g, unknown, or other
  misc_feature (563)..(563): n is a, c, t, g, unknown, or other
aagctggagctccccgcggtggcggccgctctagaactagtggatcccccgggctgcaggaattcgtctcacccctagaaaaacccttcttcggttattcctcgttgcgtgccctcgccgcagacctctgccatggcggaccagctcaccgacgagcagatcgcggagttcaaggaggccttcagcctcttcgataaggatggcgacggctgcatcactaccaaggagcttggaacggtgatgcgctcccttggccagaaccctaccgaggcagagctgcaggacatgatcaacgaggtcgatgcggatggcaatgggaccatcgacttcccggagttcctgaacctgatggcgaggaagatgaaggacacggactcagaggaggagctcaaggagnctcttccgcgtcttcgacaagaccagaacggtttcatctcggctgccgagctccgccatgtcatgaccaaccttggcgagaagctgaccgacgaggaggtcgacgagatgatccgntgaggccgacgtcgacggcgacggccagatcaactacgaagagttcgtcnaggttatgatggccaagtgagggagcgtcccccgtgaaatagtatctatggattgaaagcgattatcaggcacacaagctgtactttgtcatggtccctttgagtacgcatcagtgg

SEQ ID NO: 60836 - protein, 127 aa, Zea mays
  misc_feature: Ceres CLONE 1521128
  misc_feature (12)..(40): Pfam Name: efhand Pfam Description: EF hand
  misc_feature (48)..(76): Pfam Name: efhand Pfam Description: EF hand
  misc_feature: SWISSPROT Homolog: EC 2.7.11.1 Non-specific serine/threonine protein kinase
  misc_feature (89)..(89): Xaa is any aa, unknown, or other
MADQLTDEQIAEFKEAFSLFDKDGDGCITTKELGTVMRSLGQNPTEAELQDMINEVDADGNGTIDFPEFLNLMARKMKDTDSEEELKEXLPRLRQDQNGFISAAELRHVMTNLGEKLTDEEVDEMIR

SEQ ID NO: 60837 - DNA, 669 bp, Zea mays
  misc_feature: Ceres CLONE 1521130
  misc_feature: Encodes the peptide sequence at SEQ ID NO. 60838
ctccccgcggtggcggccgctctagaactagtggatcccccgggctgcaggaattcgtctcacccctagaaaaaagcggcctcaccaagtcaccatcaccacccgcaccacacacgagcacacgcgacgactgacaaggcgaggggagcaatcggcggcgatgggcggcggcggcgcacatggcggcaccacctacaagggctacaccatcccgcacaacaagcgctggcacaccgtcgccggcaagggcctctgcgccgtgatgtggttctgggttttctacagggctaagcaggatggtgctacgctcttgggtttgcgtcatccttgggagggacatgatgaccactctcatggtcatggacacgggcatgaggcatcatcatcgtcatcttcacatcacactccttactggctgcggacgatgtttggcatgttccaacaactaaagtttgagttaataaattctatcaccctgcatgggactcatgttgtttgcaactggtttagcacgaactggtcttgttactattgtgctaatgtatttgattcgaagtttcagttaatatgctgtggaaaaagaaaaaaaaaaaaaaaacgagacgctcgaggtacccaattcgccctatagtgagtcgtattacgcgcgctcactggccgttcgtttac

SEQ ID NO: 60838 - protein, 156 aa, Zea mays
  misc_feature: Ceres CLONE 1521130
MGGGGAHGGTTYKGYTIPHNKRWHTVAGKGLCAVMWFWVFYRAKQDGATLLGLRHPWEGHDDHSHGHGHGHEASSSSSSHHTPYWLRTMFGMFQQLKFELINSITLHGTHVVCNWFSTNWSCYYCANVFDSKFQLICCGKRKKKKKRDARGTQFAL

SEQ ID NO: 60839 - DNA, 691 bp, Zea mays
  misc_feature: Ceres CLONE 1521133
  misc_feature: Encodes the peptide sequence at SEQ ID NO. 60840
  misc_feature (442)..(442): n is a, c, t, g, unknown, or other
  misc_feature (487)..(487): n is a, c, t, g, unknown, or other
ctccccgcggtggcggccgctctagaactagtggatcccccgggctgcaggaattcgtctcacccctagaaaaacaactgttcatgccatcactgccacccagaatactgttgatggaccctcacccaaggactggagaggtggcacggctgccagctttaacatcattcccagcagcaccggtgctgccgaagctgacggcaatgttcttcctgaattgaatggcaagctcactggcatgtccttccgggttcccaccgtggatgtgtcagtagttgacctcactgtcagaatcgagaacggggcctcctatgacgaaattaacacagctattaaggctgcttctgatggcccactcaagggtattatgggctacgtgcaggaggatctggtttccaccgacttcaccggtgacatcaggtcgagcatcttctacagcaangccgggattgccctgaacgaccacttcatcaagctcgtctcttgnaacgacaacgagtggtgctacagcaaccgcgtcgtcgacctgatccgcccacatgtcaacgaccactagagagagatatttctgccctcctatcgcgggtcgtccccaatgctctttggtcgcagaccatctttgctgcttgtctatgctgacaataaatgtcaacggtggccctgaacgctggatccatgctggtttttgacc

SEQ ID NO: 60840 - protein, 105 aa, Zea mays
  misc_feature: Ceres CLONE 1521133
  misc_feature (1)..(89): Pfam Name: Gp_dh_C Pfam Description: Glyceraldehyde 3-phosphate dehydrogenase, C-terminal domain
  misc_feature: SWISSPROT Homolog: EC 1.2.1.12 Glyceraldehyde-3-phosphate dehydrogenase (phosphorylating)
  misc_feature (68)..(68): Xaa is any aa, unknown, or other
  misc_feature (83)..(83): Xaa is any aa, unknown, or other
MSFRVPTVDVSVVDLTVRIENGASYDEINTAIKAASDGPLKGIMGYVQEDLVSTDFTGDIRSSIFYSXAGIALNDHFIKLVSXNDNEWCYSNRVVDLIRPHVNDH

SEQ ID NO: 60841 - DNA, 672 bp, Zea mays
  misc_feature: Ceres CLONE 1521143
  misc_feature: Encodes the peptide sequence at SEQ ID NO. 60842
ctccccgcggtggcggccgctctagaactagtggatcccccgggctgcaggaattcgtctcacccctagaaaaaccctagaaaaactagaaaaaaagccagacagaagacaacccgtcagcccctctcgtttttcatccgccttcgcctccaaccgcgtgcgctccacgcctcctccaggaaagcgagagcttctgcataagaacaacaaatcaaaagcgtgatcagctcggtgccaacaaaacctcaacaaccaagtttcatgtctgatctcgacgtccagcttccatctgcctttgatccgtttgctgaggcaaatgctgaggactctggtgctggtcctggaacgaaggattatgtgcatgtgcgcatccagcagcgcaacggcagaaagagtctgactacagtccagggtctgaagaaggagttcagctataacaagatcctcaaggatctgaagaaggaattctgctgcaatggtactgtagttcaggacccagagctaggccaggtcattcagctccaaggtgaccagcgcaagaatgttgctactttcctagttcaggctgggattgcgaagaaagagaaacatcagattcacgggttctaagggacctgtaaatgcttgtgccctatattgtgtgccctcacatattggggagcttgaagcatc

SEQ ID NO: 60842 - protein, 115 aa, Zea mays
  misc_feature: Ceres CLONE 1521143
  misc_feature (27)..(108): Pfam Name: SUI1 Pfam Description: Translation initiation factor SUI1
MSDLDVQLPSAFDPFAEANAEDSGAGPGTKDYVHVRIQQRNGRKSLTTVQGLKKEFSYNKILKDLKKEFCCNGTVVQDPELGQVIQLQGDQRKNVATFLVQAGIAKKEKHQIHGF

SEQ ID NO: 60843 - DNA, 681 bp, Zea mays
  misc_feature: Ceres CLONE 1521144
  misc_feature: Encodes the peptide sequence at SEQ ID NO. 60844
  misc_feature (359)..(359): n is a, c, t, g, unknown, or other
  misc_feature (471)..(471): n is a, c, t, g, unknown, or other
  misc_feature (600)..(600): n is a, c, t, g, unknown, or other
ggagctccccgcggtggcggccgctctagaactagtggatcccccgggctgcaggaattcgtctcacccctagaaaaaacggagaaaaagaaagaggagctcggacaaggcagcgccatcgttcggtttccttgctgaattcccgatcgctcgcccgctcgaaaagaaagaagctagcttttagcatggcgtctctggcgttcggcagcaccgtagcggcggccgtggcggcgacctcggggaggacgcggccggcgcgccggtccgtgctggtcgtgccgcccgctgccagcaggggcggcccggcgccggccaaggaggagaagggcctcggcgagaccatcttcggcttcatcttncagaaggaccagctggtggagacggacccgctcctcaacaaggtcggcgccgcgcccggcgccgcccctccgcgcaagacgaccgccggcaagaaggctgcccggcgcgacnaacagcgcagcggcgggggggtcaacctcggcgggctcggcgggctcttcgcccagaaagcagctgaacgtggcgttgtttatggattgtcaactcaaagcttgattttgctttggaggggaattggtncgccatattttttgtggactgtgggggtgggaccagggactttgaggccaaagggaaaaaccccactcccgctgcaaaaaa

SEQ ID NO: 60844 - protein, 165 aa, Zea mays
  misc_feature: Ceres CLONE 1521144
  misc_feature (58)..(58): Xaa is any aa, unknown, or other
  misc_feature (96)..(96): Xaa is any aa, unknown, or other
  misc_feature (139)..(139): Xaa is any aa, unknown, or other
MASLAFGSTVAAAVAATSGRTRPARRSVLVVPPAASRGGPAPAKEEKGLGETIFGFIXQKDQLVETDPLLNKVGAAPGAAPPRKTTAGKKAARRDXQRSGGGVNLGGLGGLFAQKAAERGVVYGLSTQSLILLWRGIGXPYFLWTVGVGPGTLRPKGKTPLPLQK

SEQ ID NO: 60845 - DNA, 696 bp, Zea mays
  misc_feature: Ceres CLONE 1521145
  misc_feature: Encodes the peptide sequence at SEQ ID NO. 60846
  misc_feature (310)..(310): n is a, c, t, g, unknown, or other
  misc_feature (394)..(394): n is a, c, t, g, unknown, or other
  misc_feature (396)..(396): n is a, c, t, g, unknown, or other
  misc_feature (574)..(574): n is a, c, t, g, unknown, or other
aacgctggagctccccgcggtggcggccgctctagaactagtggatcccccgggctgcaggaatacgtctcacccctagaaaaaggaaaccgcacggccggcctgcctctagtcgtcgtcgtcgtcgtcgactcgtcgccgtggtgcttgcggcagctccggagtccaggcagcacgctagtcggggggcgcggaaaaggagggatggatcggtcgtatctccccgtggcggcggcggcggccttccccctggtcctcgtgtgctgctccggcctctgccgcggttagcggctcggggggagggagtgcnaagaacttgggtttctcggcctctccctctgggtcaagatgcaaagggtttttttccccccccccggagggggggggggggaantnattccctaatcccccccccccccggtccgaataattaaatcagaacgctcccagtttcgggggagatctagggagtgggccgaggaaaccgcgattttatccgaaaagggttggtcgtcccaaaaaaagaagaccccaacgcccgctgagtgggaccccccgcagcctcgacgctgancggaggctatccgtcgtcgtcccgttattgtgggcggccccctcgggggaaggtggcgcgcggaccaacgtgaacgcgaatcgcctccgtcttccgttgctaaagagcaatattacgtcgcg

SEQ ID NO: 60846 - protein, 95 aa, Zea mays
  misc_feature: Ceres CLONE 1521145
NAGAPRGGGRSRTSGSPGLQEYVSPLEKGNRTAGLPLVVVVVVDSSPWCLRQLRSPGSTLVGGRGKGGMDRSYLPVAAAAAFPLVLVCCSGLCRG

SEQ ID NO: 60847 - DNA, 634 bp, Zea mays
  misc_feature: Ceres CLONE 1521147
  misc_feature: Encodes the peptide sequence at SEQ ID NO. 60848
  misc_feature (253)..(253): n is a, c, t, g, unknown, or other
ggagctccccgcggtggcggccgctctagaactagtggatcccccgggctgcaggaattcgtctcacccctagaaaacacggagagcaaaggcagcacactcagctatccagcaaaagagatcgagaggcaggagtcatggccaccgtcagcgccgccgtggtgaccaccatcgttgcccgcgccgcgatcgccaggcccaatgctctagggctgcctgcgctgagggcgaggagcgagagggtgcggtgcanctacgccaaggacgcggccccagtcagcaccaagggcgcaggcgcgtcgctgctcgccgcagcgggcgcggtgaccgcgtcggcggggcccgcgctggcgctcgtggacgagcgcatgtccacggagggcaccgggctgagcctcgggctcagcaacaacctgctgggggtggatcctcctgggggtctttcggcctcatctgggtccctctacacattctacacctcttacccttcaaaaggaaaaggaaccccgggggccccccgcccctaaatcccccccccttccccgggtaaaggcccccaaaggaaaacaggggggggggggccccccccgggaaaaaatttaaagaagggggttttttttgcccttaaaaaaac

SEQ ID NO: 60848 - protein, 129 aa, Zea mays
  misc_feature: Ceres CLONE 1521147
  misc_feature (1)..(130): Pfam Name: PsbW Pfam Description: Photosystem II reaction centre W protein, PsbW
  misc_feature (39)..(39): Xaa is any aa, unknown, or other
MATVSAAVVTTIVARAAIARPNALGLPALRARSERVRCXYAKDAAPVSTKGAGASLLAAAGAVTASAGPALALVDERMSTEGTGLSLGLSNNLLGVDPPGGLSASSGSLYTFYTSYPSKGKGTPGAPRP

SEQ ID NO: 60849 - DNA, 663 bp, Zea mays
  misc_feature: Ceres CLONE 1521148
  misc_feature: Encodes the peptide sequence at SEQ ID NO. 60850
ggagctccccgcggtggcggccgctctagaactagtggatcccccgggctgcaggaattcgtctcacccctagaaaaactagaaaaagaaccttgaagcgccccgtagtgcagtgcagtgcagcagtgtgctacctcctcagtcctctcactccatcacaaacgctagtcttcctctaaagctcggagcgagtctcagaagcgatggcgtccaagaggctgctgctggcggcgctgtgcgtggtggcggcggcgctgctcgccgtgcggtcggaggcccacggcctggaggacttcgcaagcagcgacgcgacgccggagatgcagaccttcttcaagcccgaggccgcggcgctcccggaggccctggacgcgtcctccatgcccgccccgcacatggccgcgaagccggaggccacgtcgatcccgaccaccaccaccggcaccacggcggcggcggcgggcacctccgccgcggcaagcactactgctgcgtcgccgccgcgcaggtccgtgtccgtggccgccggcgtggcctgcggcgtgcctgccttgccggggtcggcatcccggccgccgtggcgtacttggggcccggcaagcccaacaaggaagggcatctcggctcctccccggaagacgcgcccaggccccgggccgttta

SEQ ID NO: 60850 - protein, 153 aa, Zea mays
  misc_feature: Ceres CLONE 1521148
MASKRLLLAALCVVAAALLAVRSEAHGLEDFASSDATPEMQTFFKPEAAALPEALDASSMPAPHMAAKPEATSIPTTTTGTTAAAAGTSAAASTTAASPPRRSVSVAAGVACGVPALPGSASRPPWRTWGPASPTRKGISAPPRKTRPGPGPF

SEQ ID NO: 60851 - DNA, 890 bp, Zea mays
  misc_feature: Ceres CLONE 1521149-R
  misc_feature: Translation starting site: 246
cagcttggcggactgcttggtggagtttttgcatcttaaagaaagatgagcggatcaacccaccaaacgcgcactgtcatggtaagcatccacgcttgctggctgggcgggcctgggtctagtgagcgtcttcctcctcgcaatgcttggtgtacttggcggcgtacagcagggcgtccgcctcccccgggctgctcggcttcaccttgatcatccacccgtcctcgtacgggctcgtgttgatcatgccgggcgtctctgacagttatggcattgacctcgacgacctcgccggagatcggggagttgacgtctctggtggccttcacgctctccacgttgccgaagggtcctcccgcggcgaccttcgtgcgaggttccggcagctccacaaacacaacctctcccaagtgaccctgagcatggtctgtgatgccaacggtggcgacgtcgcccgtcctcttgacccattcgtgagactgagtgtacgttaccccatcctgaaccgtggaagaagaaccagcaaatacagaaggcagcagctcgagaccccggcgccgccccgagaacttagagcgcattggcctgtttgaggtggcccaaaatccttaagaggcatcactgcagtgcccaaattttttcttgggggggaggagtaaatcccaagtcccccgggggggaatccgctaattttctataatttggccggccacccaccacgggagctttcagcctttttgtttcctttttacctaagggtttaatgtcccaccctttgggccttaaccatggtccataagctgtttccccggttgtggaaaattaaaaatgcggcttcccgattcccaatcccacataaaaattcgggaaccctgtaaggtgtaaaaatg

SEQ ID NO: 60852 - DNA, 874 bp, Zea mays
  misc_feature: Ceres CLONE 1521149-R2
gagcgtctcgtttttttttttttttttgaaggcatctaggattcctgcattgtcggactgcgtggtggagtttttgcaatattttttaaagactgcaactgatcaataccactaaacgcgcactgtcgtggtaagctatctacgcttgctggctgggtgggcctgggtctagtgagcgtgttcttccacagcacatatttgtgggtacttgagggtgtcaaatatggcgatggtttctcacgggatgctcgcgcttccaccgtagatccttggggctaacttctacgagcacgggtagattctggctggcctctttcacactgatggatagacctccatgacctttcttgagatgctggagtacatttcttgggcggccataacactgcatggatatcttcagggtcaccgtctttgcaggttccagaccgagccgctgacgctttggaaatggaccttctcgcgaaatacctgactggtgactatctgatgcaagtggttgctacatcagccgttcttctgaccgactcgggagacttagtgcagtgactgggacacgctatgctgggatagatcaaaccatcgcgaaagcctcagctggaaactccttgccgccatgagagatatgatgcattctctgcttcaggggctcaaatcctgaaaagcagactgctggacaaattctcctttgtgctaaggggaaaactatttcctggggggcatcggggatctcctagattctaaagcggccccccatcgaagggggagcttttggttttttgtttcctaatagagttaaggggtcaaattttgggcgctttggccgtggaccatggggcgattaccctgtttttccgaaagttggaaaattggt

SEQ ID NO: 60853 - DNA, 621 bp, Zea mays
  misc_feature: Ceres CLONE 1521221
atagctggactccccgcggtggcggccgctctagactagtggatcccccgggctgcaggaattcgtctcacccctagaaaaatccccttgaccatgacgtctcgtttctttgcggcggcctcttcatcctcatcctcgtgccccctcgcccggctaatctctcggagcggccttgccggtgccgcagacggtcatggacctgccaatgtgcccttgtgcaaagatccgttgagcccgagcatgtggacacgaacagcactcttgttcgagcaagcctctctatgtggggggctcttttctgtagctggttccacgttttttggccgacacaaggaacacaagagtgacgcagcctcccgacaaacatatgcggctggaatgggagctcctgcctatgtctgtggccagggaacaatgctaaatagaaggaatatactatcttgtcgcctttcccttaataaattcaggcacccaggaatggattatgcacccaatatccttgtctacctactcgactacagcacgggtgacgtcatgcgcctgaatgatgagaatcttgtactcctttcatgcgattgagtatatgtggtacttctgttgccatcaccctatcgacgctat

SEQ ID NO: 60854 - DNA, 842 bp, Zea mays
  misc_feature: Ceres CLONE 1521226
  misc_feature: Encodes the peptide sequence at SEQ ID NO. 60855
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
nnnnnnnnnnnnnnnnnnnnnnnnnnnnnnnnnttttaacccgacctcggaacaagctgggactccccgcggtggcggccgctctagaactagtggatcccccgggctgcaggaattcgtctcacccctagaaaaaagcagcagcatccttaccagcacacagtggagctagctagctagtagaggtcaatcaccaaaatggcgaggcagctcgttgtgcttgctctgcttttcgtgatcgccggtgtggcgcatggcgcggggggaagttgcgggagagcctccgccgacagggtggcgctaaggatggcgccatgcatctcggctgccgacggacccgcatgtccacgcccgaacccaggaacctggcttggtttcggcctgtgggacaccacccaattccggggggcaaaaagagccccccccccaggcctttggcccgttgtgtggggcgcccgggtgccaatgggtgtggggcccaggggaaaccccggccaccgggggggctcttgccccccgcggggaaataaacaataaccccccgaaaaaaagtgtgtagcaggcgtttgttaccccccttccccccccccaaaaaggcccttccgcaaaatatgtggggggccgaaaaaacgcgcccccccccggggggggtttctacataagaggtggcgggcagaattatttatacaacacgttcggtgcgcccttatagtgtggggggagtgagaaaaagaaaaccctccctctatattttataccagaagaacaccgccctggcggggagcgcatagaacaacacccccctcccttttaatataaaagacaaaacgcgctccccctct

SEQ ID NO: 60855 - protein, 112 aa, Zea mays
  misc_feature: Ceres CLONE 1521226
MARQLVVLALLFVIAGVAHGAGGSCGRASADRVALRMAPCISAADGPACPRPNPGTWLGFGLWDTTQFRGAKRAPPPGLWPVVWGARVPMGVGPRGNPGHRGGSCPPRGNKQ

SEQ ID NO: 60856 - DNA, 623 bp, Zea mays
  misc_feature: Ceres CLONE 1521267
  misc_feature: Encodes the peptide sequence at SEQ ID NO. 60857
aaagctggagctccccgcggtggcggccgctctagaactagtggatcccccgggctgcaggaattcgtctcacccctagaaaaaattcactcacccacctagctagtcatcactagtcacgttcgtccaccagagacaacaatggccatggagacgtgcttcagagcgtgggcgctgcacgcccccgctggcagcaaggacaggctcctcgtcggcaacctggtgctgccgtcgaagcgggcgctcgcgccgctgtccgtgggccgcgtcgccacgcgccggccgcggcacgtctgccagtccaagaacgcagtggacgaagaactgggacgggttggtgatggcgtgcgagacgccggtgctggtggagttctgggcgccgtggtgcgggccgtgccggatgatcgcgccggtgatcgacgagctggccaaggactacgccggcaagatcacgtgctgcaaggtgaacacggacgacagccccaacgtggcgtctacctacggcatccgcagcatccccaccgtgctcatcttcaagggcggcgagaagaaggagagcgtcatcggcgccgtcccgaagtccacgctcaccaccctcatcgacaagtacatcggtagttcat

SEQ ID NO: 60857 - protein, 94 aa, Zea mays
  misc_feature: Ceres CLONE 1521267
  misc_feature (4)..(90): Pfam Name: Thioredoxin Pfam Description: Thioredoxin
  misc_feature: SWISSPROT Homolog: EC 1.8.1.8 Protein-disulfide reductase
MACETPVLVEFWAPWCGPCRMIAPVIDELAKDYAGKITCCKVNTDDSPNVASTYGIRSIPTVLIFKGGEKKESVIGAVPKSTLTTLIDKYIGSS

SEQ ID NO: 60858 - DNA, 686 bp, Zea mays
  misc_feature: Ceres CLONE 1521270
  misc_feature: Encodes the peptide sequence at SEQ ID NO. 60859
  misc_feature (635)..(635): n is a, c, t, g, unknown, or other
  misc_feature (686)..(686): n is a, c, t, g, unknown, or other
atagctggagctccccgcggtggcggccgctctagaactagtggatcccccgggctgcaggaattcgtctcacccctagaaaaaaaaccaatcagatagagagagcatagtcgatcatgaagggtggcaagaaggaagtggccggtgcgatggtggccatactgctggttctgcagctcatggcagctccaccgacggccatggccgcccgctcgccgcacggagccgtgccggatggctccctcgccacgacgcccaaggtgacgatgctgtcggccacgctgtgctacacgggggagacatgcaaatacattggctgcctcactcctgcttgctcctgcaactatagtgatcgtctatgctacatcatatttactcctgttgcttgaggccattccgcgaagccacaactcttacaatatgcatgcgccggccgacgacgacgcgcgctgcctctcgtgagcttctgttcaagtgatgcatgtttcaaggcatccatggatgctttacgtatatgcgtattaattagccgtgtcagggaaccggacagaaggggggggttgttttatatttacgtcttcctggtgatcaaataaagggggaaatatttggttggatgtgttgcaaaaaaaaanacaagcctttcactataatcacaaaaaagctaaaacccacacacggaaccn

SEQ ID NO: 60859 - protein, 90 aa, Zea mays; identical to SEQ ID NO: 58696
  misc_feature: Ceres CLONE 1521270

SEQ ID NO: 60860 - DNA, 646 bp, Zea mays
  misc_feature: Ceres CLONE 1521281
  misc_feature: Encodes the peptide sequence at SEQ ID NO. 60861
aaaactggagctccccgcggtggcggccgctctagaactagtggatcccccgggctgcaggaattcgtctcacccctagaaaaaactgcggcttcaggactcgacctcttgcgccgccgccatgaccttcaagcgccgcaacggcggccgcaacaagcatggccgcggtcacgtcaagtacatccggtgctcaaactgcgccaagtgctgccccaaggacaaggcgatcaagaggtttcaggtgaggaacatcgtggaacaggcggccatcagggacgtccaggaagcatgcgtctatgatggctacgtcctcccgaagctgtacgccaaggtgcaccactgcgtctcgtgcgcgatccacgctcacatcgtccgcgtccgatcccgtgagaagcgcagggaccgcaagccgccggagcgcttcaggcgcagggaggataggcctgctggtggacaaggaggcccccgccctggtcctggtgctgctgctacagctccatcttcaagcaccgggttggctgctcgccccatagggctttaaactttttttcaacccggtttaaaactttcttcccccctacttttcgaattttcccccgtgggggtggggaaaaccctatatttaaaattctcttttttttcaaaa

SEQ ID NO: 60861 - protein, 139 aa, Zea mays
  misc_feature: Ceres CLONE 1521281
  misc_feature (1)..(117): Pfam Name: Ribosomal_S26e Pfam Description: Ribosomal protein S26e
MTFKRRNGGRNKHGRGHVKYIRCSNCAKCCPKDKAIKRFQVRNIVEQAAIRDVQEACVYDGYVLPKLYAKVHHCVSCAIHAHIVRVRSREKRRDRKPPERFRRREDRPAGGQGGPRPGPGAAATAPSSSTGLAARPIGL

SEQ ID NO: 60862 - DNA, 658 bp, Zea mays
  misc_feature: Ceres CLONE 1521291
  misc_feature: Encodes the peptide sequence at SEQ ID NO. 60863
  misc_feature (535)..(535): n is a, c, t, g, unknown, or other
  misc_feature (658)..(658): n is a, c, t, g, unknown, or other
ggagctccccgcggtggcggccgctctagaactagtggatcccccgggctgcaggaattcgtctcacccctagaaaaacttgctcgctgcgccgccgcctccgacatcgtcccttcgtccccacgagcaaccgataatccgccggcgttgagatgttggtttatcaggatctcctatctggcgacgagctcctgtcggattcattcacctacaaggagctcgagaacggcgtcctgtgggaggtcgagggaaagtgggtcacccaaggtcctgttgatgtggacattggtgccaatccatccgccgagggtggtgaggacgaaagcgttgatgacacagctgtgaaggtggttgatattgttgacacattccgtctacgggagcaacctccttttgacaagaaatcatttgtgtcttacatcaaaaaatacatcaagaatctcactgctgtgttggagccagagaaagcggatgagttcaaaaagggtgtcgagggtgcaaccaagtttctccttagcaagctgaaggacctccnattttttgttggtgagtccatgaaggatgatgcgtctgtggtattcgcctattaccagggagggggccactaatcccgacattcctcttatttctctcaggggccttaaggaaatcaagtgcn

SEQ ID NO: 60863 - protein, 151 aa, Zea mays
  misc_feature: Ceres CLONE 1521291
  misc_feature (1)..(152): Pfam Name: TCTP Pfam Description: Translationally controlled tumour protein
  misc_feature (128)..(128): Xaa is any aa, unknown, or other
MLVYQDLLSGDELLSDSFTYKELENGVLWEVEGKWVTQGPVDVDIGANPSAEGGEDESVDDTAVKVVDIVDTFRLREQPPFDKKSFVSYIKKYIKNLTAVLEPEKADEFKKGVEGATKFLLSKLKDLXFFVGESMKDDASVVFAYYQGGGH

SEQ ID NO: 60864 - DNA, 630 bp, Zea mays
  misc_feature: Ceres CLONE 1521302
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (69)..(69): n is a, c, t, g, unknown, or other
  misc_feature (122)..(122): n is a, c, t, g, unknown, or other
  misc_feature (133)..(133): n is a, c, t, g, unknown, or other
  misc_feature (134)..(134): n is a, c, t, g, unknown, or other
  misc_feature (149)..(149): n is a, c, t, g, unknown, or other
  misc_feature (150)..(150): n is a, c, t, g, unknown, or other
  misc_feature (361)..(361): n is a, c, t, g, unknown, or other
  misc_feature (362)..(362): n is a, c, t, g, unknown, or other
nnnnnnnnnnnnnnnnnnnnnnnnnnnnnnnnnnnnnnnnnnnnnnnnnnnnnnnnnnnnnggggaaanttcaaactggagctccccgcggtggcggccgctctagaactagtggatccccncgggctgcagnngaattcgtctcaccnncctagaaaaaaccccggcagtcacacctcgaaagcaacagcaagtcagcaacctacctagctagagctatcactatatcagtatcaggtacctaggacctagcagcagccacacccacacccgtacgttcggcatgggctagggtggggtccggtccgtccaggcttctggggccgccccgctccccctcgggggggcccggggcccccgnnccggggggggggggtgggttcccggggggggcccccctcccccccccaaaaaaaaaaagggggggtaaaaaaaaattaaaaaacgcccccaacccccccccaaaaggggaagagggggtttaaacccccggggggaagggggggccctaaaaaaaaatgggggagaccacataatttttctgcgaaaaaaatggggggggggggagaaaacaaaaaaaattcccccccccccccccccccacggggggggtttattttctctccccca

SEQ ID NO: 60865 - DNA, 614 bp, Zea mays
  misc_feature: Ceres CLONE 1521304
  misc_feature: Encodes the peptide sequence at SEQ ID NO. 60866
  misc_feature (476)..(476): n is a, c, t, g, unknown, or other
ggagctccccgcggtggcggccgctctagaactagtggatcccccgggctgcaggaattcgtctcacccctagaaaaatccaccatcacacacagcaatccacacaagcacttcgacgtcacacgggcgctgcacacagacacaccaagcgtcggcaccaatggcttactaccaggaggtggactactgctcggaggaggtgaggtcggtggccccggccggcttcggccgccacggcggcggcgtccagcagcacgtcgtcaaggagaagttcgaggaggtcgacacggtcgcacgcgccggcgccaaccaccaccaccaccatgggtcaccacgggcggccacgggctttcttgggtgcccccaaaaaaacccgggggtgcagggagaggggaattccaccccctgtggtcagtggcccaggagggtccccccctatcagttcccgtgtggagaaaccctttctcctcccattnaagaaggttaaaataaaaaaaaaccccgcgggggggggaggtgtccaccccccccccctcctctacccccccccacactcaacccccctctataaattatgtattgtcgtcctaaaaaaattgttctacggggggcca

SEQ ID NO: 60866 - protein, 108 aa, Zea mays
  misc_feature: Ceres CLONE 1521304
  misc_feature (106)..(106): Xaa is any aa, unknown, or other
MAYYQEVDYCSEEVRSVAPAGFGRHGGGVQQHVVKEKFEEVDTVARAGANHHHHHGSPRAATGFLGCPQKNPGVQGEGNSTPCGQWPRRVPPYQFPCGETLSPPIXEG

SEQ ID NO: 60867 - DNA, 524 bp, Zea mays
  misc_feature: Ceres CLONE 1521327
  misc_feature (188)..(188): n is a, c, t, g, unknown, or other
  misc_feature (277)..(277): n is a, c, t, g, unknown, or other
  misc_feature (283)..(283): n is a, c, t, g, unknown, or other
aaagctggagctccccgcggtggcggccgctctagaactagtggatcccccgggctgcaggaattcgtctcacccctagaaaaaataaatcccagccacccactgtgtgcaccgatcagtcaaccagcgtgaacaaacaggagacgcatccagcctccagcagagggctccagagatccagcaagatngaaggagggcacggcgaactgtgtggacatcctcatcgccatcatcctgcccccactcggcgtcttcctcaagttcggatgcaaggtcngagttnctggctctgccctcttgctcaccttcctcgcctatcttccggggatcatctacgcgatctacgccatcaccaaggactagcgcggttccagttgggtgcgagctgcaggctcctccctctcttctcagctgtgaagctactactactagtctactacggattgatgaacctggtcgctccgtcgtctccttcaatcgctccctgggtattttgggccgggggaccttggtatttaccgaat

SEQ ID NO: 60868 - DNA, 721 bp, Zea mays
  misc_feature: Ceres CLONE 1521333
  misc_feature: Encodes the peptide sequence at SEQ ID NO. 60869
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (27)..(27): n is a, c, t, g, unknown, or other
  misc_feature (46)..(46): n is a, c, t, g, unknown, or other
  misc_feature (47)..(47): n is a, c, t, g, unknown, or other
  misc_feature (50)..(50): n is a, c, t, g, unknown, or other
  misc_feature (51)..(51): n is a, c, t, g, unknown, or other
ttttttnnnnnntttnnnnnttttctnttttttccttttttgtctnntanntcatagctggactccccgcggtggcggccgctctagaactagtggatcccccgggctgcaggaattcgtctcacccctagaaaaatcatccagtgctctctcctcttgcgattcgctcgctcgatcctagcttcccttccaagaagcgcagcgcccatggccatggccacgcaagcctccgccgccacgcgccacctgctggccgccgcctgggcgccggcggcgaagccgcggcagctgagctcgcagctcgcgctgccgtcgtcgtcctcccgcgggccggccccgctccgcgcgtccaccgaggaggcggtggaggcgcccaaggggttcgtggccccgcagctggaccccagcacgccgtccccgatcttcggcggcagcacgggcgggctgctccgcaaggcgcaggtggaggagttctacgtcatcacgtggacgtcccccaaggagcaggtgttcgagatgcccaccggcggcgccgccatcatgcgggaggcccccaacctcttgaagctggcgcgcaaggagcattgcctggcgctcggcaccaggttgcgctccaagtacaagatcccctaccagtttctaccgcgtcttccccaaacggcggaggtggcagtaacccccacccccaaggaagggcgtcctacccggggagaaaggtcaa

SEQ ID NO: 60869 - protein, 171 aa, Zea mays
  misc_feature: Ceres CLONE 1521333
  misc_feature (62)..(171): Pfam Name: PsaD Pfam Description: PsaD
MAMATQASAATRHLLAAAWAPAAKPRQLSSQLALPSSSSRGPAPLRASTEEAVEAPKGFVAPQLDPSTPSPIFGGSTGGLLRKAQVEEFYVITWTSPKEQVFEMPTGGAAIMREAPNLLKLARKEHCLALGTRLRSKYKIPYQFLPRLPQTAEVAVTPTPKEGRPTRGERS

SEQ ID NO: 60870 - DNA, 659 bp, Zea mays
  misc_feature: Ceres CLONE 1521342
  misc_feature: Encodes the peptide sequence at SEQ ID NO. 60871
  misc_feature (659)..(659): n is a, c, t, g, unknown, or other
aagctggagctccccgcggtggcggccgctctagaactagtggatcccccgggctgcaggaattcgtctcacccctagaaaaaagatgctacaacaacgcctacttcgcgcgggtgggcggcatcagcctggtggagatgaactacctggaggtggacttcctgttcggcatcgccttcgacctcaacgtcacgcccgccgccttcgcatcctactgcgccgtgctccagagcgagatggcctacctggacgacgcgcccgcgcccgcgcccgtcgtcgaggcgcccccaaggctgcactactgctacggcgccgccggcacgtctgaccgccacgacgaccccgccgcggtcgcagcagccgccgcctgccaccgtcacagcagccagccgcagctcactgtctgatcgaccggccgtgcgtgcccgaccggtcgatgcagccgtttcttttcttttcttggttgtccctggcgggcgcgctggtggtgtcgactcgtcttcttccttggtgatggtctctgtcttgtcttggtacatatgtgttggtcgttcgttgctagtgagctctcggggtacgtagttctgattggatcttgggtggggtcaagattcttgggaaatttttgttttcaccattgttcgacggatcatgcatgn

SEQ ID NO: 60871 - protein, 134 aa, Zea mays
  misc_feature: Ceres CLONE 1521342
AGAPRGGGRSRTSGSPGLQEFVSPLEKRCYNNAYFARVGGISLVEMNYLEVDFLFGIAFDLNVTPAAFASYCAVLQSEMAYLDDAPAPAPVVEAPPRLHYCYGAAGTSDRHDDPAAVAAAAACHRHSSQPQLTV

SEQ ID NO: 60872 - DNA, 639 bp, Zea mays
  misc_feature: Ceres CLONE 1521348
  misc_feature: Encodes the peptide sequence at SEQ ID NO. 60873
ctccccgcggtggcggccgctctagaactagtggatcccccgggctgcaggaattcgtctcacccctagaaaaactccactccctcccccccgcctccactaccccactcccaggcgccgcacaggtacgtcgccggcggcgatgacgacgcgcttcaagaagaaccgcaagaagcgcggccacgtgtccgccgggcacggccgcatcggcaagcacaggaagcatcccggaggtcgcggtaacgccggtggcatgcaccaccaccgcatcctcttcgacaagtaccatcccggctacttcggtaaggtcggcatgcgctacttccacaagctccgcaacaagttctactgccccgcggtcaacatcgagcgcctctggtcgatggtgcccgccgaaaaggcggcggaagccggcggcgacaaggccccgcagatcgacgtcacgcagttcggctacttcaagggtgctcgggaagggggtgctgccgcccaagcccatcgtcgtcaaggcccagctcatcttcaagggccgccgagaagaaaatcaaggcccgccggcgggccccgtccgtgctcacccgccaagttttcagtcctttattccccctctttggttttgagaacctatatcctgaaact

SEQ ID NO: 60873 - protein, 165 aa, Zea mays
  misc_feature: Ceres CLONE 1521348
MTTRFKKNRKKRGHVSAGHGRIGKHRKHPGGRGNAGGMHHHRILFDKYHPGYFGKVGMRYFHKLRNKFYCPAVNIERLWSMVPAEKAAEAGGDKAPQIDVTQFGYFKGAREGGAAAQAHRRQGPAHLQGPPRRKSRPAGGPRPCSPAKFSVLYSPSLVLRTYILK

SEQ ID NO: 60874 - DNA, 611 bp, Zea mays
  misc_feature: Ceres CLONE 1521368
  misc_feature: Encodes the peptide sequence at SEQ ID NO. 60875
  misc_feature (21)..(21): n is a, c, t, g, unknown, or other
  misc_feature (32)..(32): n is a, c, t, g, unknown, or other
  misc_feature (45)..(45): n is a, c, t, g, unknown, or other
  misc_feature (46)..(46): n is a, c, t, g, unknown, or other
  misc_feature (73)..(73): n is a, c, t, g, unknown, or other
  misc_feature (74)..(74): n is a, c, t, g, unknown, or other
  misc_feature (120)..(120): n is a, c, t, g, unknown, or other
tcacccgccggtggcggccgnctctagaactnagtggatcccccnngggctgcaggaattcgtctcacccctnngaaaaaaaaaaaaaaaaaaaaaaaaaaaaaaaaaaaaaaaagaatnaacccctagcagccacccggttctccctcgctccaaatctcccttcgcagccggccagggaccccttcacagcgcgggagatggctgatcaggaggccccagttgcagttgaggcaccaaccccagttcttggagagccaatggacttgatgactgcgctgcacctggtgatgaagaagtcaagtgctcatgatggacttgtgaagggtcttcccgaaggctgcaaagggccattgaaaaaaatggctgctcaattttgcgttcttggtgaaaaatgtaaccacccaaataatccaaggctgggaaaggccctcttggctaaaaaaaaatgttcccccttgtcaacggttcccggccggataaaactctttgcaaaaggggcctgggagttttttaaaaacaatctcctccccccaaaaaacctgtgggccccccctttttttaaacaaagagagttttgttaggggcggtcacgcccgcccccccttctg

SEQ ID NO: 60875 - protein, 127 aa, Zea mays
  misc_feature: Ceres CLONE 1521368
MADQEAPVAVEAPTPVLGEPMDLMTALHLVMKKSSAHDGLVKGLPEGCKGPLKKMAAQFCVLGEKCNHPNNPRLGKALLAKKKCSPLSTVPGRIKLFAKGAWEFFKNNLLPPKNLWAPPFFKQREFC

SEQ ID NO: 60876 - DNA, 757 bp, Zea mays
  misc_feature: Ceres CLONE 1521387
  misc_feature: Encodes the peptide sequence at SEQ ID NO. 60877
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
nnnnnnnnnnnnnnnnnnnnnnnnnnnncccccccccccnnntnnnnnnnacaaagctggactccccgcggtggcggccgctctagaactagtggatcccccgggctgcaggaattcgtctcacccctagaaaaaaaccgagacaccgcgtgcgaaccaagcagaccccagcagaagaagcgaagtcgtcgccggagcaggaggaagagcgaggagcaacatgtcgtggcaggcgtacgtcgatgaccacctgctgtgcgacatcgaaggccagcacctcagcgccgccgccatcgtcggccacgacggcagcgtctgggcacagtccgagaacttccccgagttaaagcctgaggaggttgctgggatgataaaggacttcgatgaacctggaactcttgcaccaactggtctttttgttggaggtacgaagtaccatggtgatccaaggtgaacctggagttgtcatcccaggaaagaaggggcactggaggcattactatcaagaaaactggcattgtccttgattatcggtatctatgatgagccaatgactcctagggcaatgcaatatgggggggggagaaggctcggcgaattacctgatccaaccaggggcttcctaaaggggggtggtttgggttttgaggaaatccactcccatccccgaaaagggggggggggtgcctccatggggatcccctttcccctccaaattttggggggggggaataaaccccccaatttgcgttacagg

SEQ ID NO: 60877 - protein, 77 aa, Zea mays
  misc_feature: Ceres CLONE 1521387
  misc_feature (2)..(75): Pfam Name: Profilin Pfam Description: Profilin
MSWQAYVDDHLLCDIEGQHLSAAAIVGHDGSVWAQSENFPELKPEEVAGMIKDFDEPGTLAPTGLFVGGTKYHGDPR

SEQ ID NO: 60878 - DNA, 625 bp, Zea mays
  misc_feature: Ceres CLONE 1521407
aaagctggagctccccgcggtggcggccgctctataactagtggatcccccgggctgcaggaattcgtctcacccctagaaaaaacccggcagtcacacctcgaaagcaacagcaagtcagcaacctacctagctagagctatcactatatcagtatcaagtacctagacctagcagcagccacacccacaccggacgtcggcatggctaggtggtcgtcgtaagctctggtcgccgtcctcgtggtcctggccgcggcggtggcgtgcatagcggcgcgacccgtccccgcacagcagcagcatgcgggagaggacgtgaagcgaccggacacgctgcacgaggggacggtgctgatcccggggatggggcgctacgagatcgagcagccactacatcccggacatcggcgggctggaccacaggatccccgccgccacccacggccagttcctccccggcgccgacgacaccagggtgcccaaccccaggttcgagggccccaacaccttcatgcccggagcggccactacatgaacacgtacccgcgctggcgaaggtgggtctcggtcgatctgatcgtcacgcgccgacgcccgcactgaacgaagtatactactaggtg

SEQ ID NO: 60879 - DNA, 749 bp, Zea mays
  misc_feature: Ceres CLONE 1521457
  misc_feature: Encodes the peptide sequence at SEQ ID NO. 60880
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (34)..(34): n is a, c, t, g, unknown, or other
  misc_feature (43)..(43): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
nnnnnnnnnnnnnnnnnnnnnnnnnnnnnggggnggggggggntnnnnnnnccaaactggagctccccgcggtggcggccgctctagaactagtggatcccccgggctgcaggaattcgtctcacccctagaaaaagagcctgacccttacgccttcgctcgcgccgccgccgccgccgccgctacgccccgcacctcgcttcatttcgtgtcgccaagatgacgaagcgcactaagaaggcaggaattgttggcaaatatggaaccaggtatggtgctagcttgcgtaagcaaatcaagaagatggaggtatctcagcattccaagtacttttgcgagttctgtgggaagtttgctgtgaagaggaaagcagttggaatttgggggtgcaaggactgtgggaaggtgaaggctggtggtgcttacaccatgaacactgctagtgcggtcaccgtcaggagcacgatccgccgcctgagggagcagactgaagcatgatatagctctttatattattggggtttcctgaagttgctcttgtcaggcatgttggtgggggccttatctagtggaaatgtgggaatcacctgtctgggctgggtttgccaaagacaatgccccctctaaatttgggtttatggcccctagggacccaaaaaaaaaaaaaaaaaaaaccaagaccccctccgagggtacccccaatttcgccccttaataggtggggccggcaattaaccgccggcgcctcc

SEQ ID NO: 60880 - protein, 92 aa, Zea mays; identical to SEQ ID NO: 7812
  misc_feature: Ceres CLONE 1521457
  misc_feature (2)..(91): Pfam Name: Ribosomal_L37ae Pfam Description: Ribosomal L37ae protein family

SEQ ID NO: 60881 - DNA, 517 bp, Zea mays
  misc_feature: Ceres CLONE 1521751
ctggagctccaccgcggtggcggccgctctagaactagtggatcccccgggctgcaggaattcgtctcacccctagaaaaaactttgttatgaccgacctatggatcattttttttttcgagaacaaaatgacttgtctaatttttcttggcgttggctttgttatgaccgacctatggatcatttttttttcgagaacaaatgacttggcgaaatgttcaactttaaaaaaaaaaaaaaacgagacgctcgaggtacccaattcgccctatagtgagtcgtattacgcgcgctcacttgggccgtcgtttttcaaacgtccgtgactgggaaaaacccctgggcgttacccaactttaatcccccttgaagcaaattcccccctttcccccggtttgggggttaataaccaaaaaggcccccacccatatccccctttccaaaaattggccccacccgaatggggaaatggaaaattgaaaccctttaaattttttttaaaaattccccggaaaat

SEQ ID NO: 60882 - DNA, 819 bp, Zea mays
  misc_feature: Ceres CLONE 1521755
  misc_feature: Encodes the peptide sequence at SEQ ID NO. 60883
  misc_feature (1)..(1): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (376)..(376): n is a, c, t, g, unknown, or other
naatttttttgggtggtggaacttacccccccccccccctccnnnnnnnnnnnttatnnnnnnaaacgtggggctccccgcggtggcggccgctctagactagtggatcccccgggctgcaggaattcgtctcacccctagaaaaaaacgcgcacctccctttccccaactcgatctcgcacctaggggttcgtctcgccgctctcgtcctccgcgaagatgccgaagaacaagggtaagggaggcaagaaccggaagcgaggaaagaacgaggctgacgacgacaagcgcgagctcggcttccaggaagacgggcaggagtacgcgcaggtgtaccggatgctcggttaagggcagaagaaaagccatctgccgnctatggcactcgaccgcctccgccctaccccggggtgggatggcgctgttatcccccccccctcccagggggggggggggggggtgtctgtctttctgacatccccaaaacccccccccccccccacccccacacgaaacgttgtgatcctcctcacgcgttgtggggagggactgctagtcggctcgcttttgtgttttcctgggggcgccccgggctgatagcgctcgcgcggaacacaccgcccatcccgccccgaccagtcggggcacgcgcatgtcgcgccgtgttggccccccctcgtccgttgcggtaccgacggaggcggcgggccgattggcgggcgtcccgctgtttccaggcggtagcctacggcgtgcggcgcgcgcgacacccgcaccacaccaagcacccccgcggccctgcgtgtcgtttggcaccga

SEQ ID NO: 60883 - protein, 43 aa, Zea mays
  misc_feature: Ceres CLONE 1521755
MPKNKGKGGKNRKRGKNEADDDKRELGFQEDGQEYAQVYRMLG

SEQ ID NO: 60884 - DNA, 636 bp, Zea mays
  misc_feature: Ceres CLONE 1521759
  misc_feature: Encodes the peptide sequence at SEQ ID NO. 60885
aagctggagctccccgcggtggcggccgctctagaactagtggatcccccgggctgcaggaattcgtctcacccctagaaaaaacatcgggaaccgccgccgacgccgcaggaggagacgcatcgaggttagcacgcgaagaagcgaccatgagggccaagtggaagaagaagcgcatgaggaggctcaagaggaagcgcagaaagatgaggcagagatccaagtaggcagatcgagatggattgtggacctgatgacatgcgtgggtacatacatttcttcggatgcgttggtgtgcctgtggagagatgtcaacctgccatggtgtcacggtccgccatcagttgaacgtcttgcctgccccccactaaaggagtgggggggggggtctagttgtatttaaatccaccccttgccactaagataaatcagacattcgttttgtgaacccattatgatggacctttatttgctgataatatctacctaccctatttgagctgaaaaaaaataacaacaacccaaacacttccctctctctgccccggcccctcccctctccttctgttgtatattatatctgtgtcccgcccggggcccccctctccccccctatacgggaggcccggtcatcgg

SEQ ID NO: 60885 - protein, 49 aa, Zea mays
  misc_feature: Ceres CLONE 1521759
MTCVGTYISSDALVCLWRDVNLPWCHGPPSVERLACPPLKEWGGGSSCI

SEQ ID NO: 60886 - DNA, 768 bp, Zea mays
  misc_feature: Ceres CLONE 1521761
  misc_feature: Encodes the peptide sequence at SEQ ID NO. 60887
  misc_feature (41)..(41): n is a, c, t, g, unknown, or other
  misc_feature (46)..(46): n is a, c, t, g, unknown, or other
  misc_feature (47)..(47): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (434)..(434): n is a, c, t, g, unknown, or other
  misc_feature (768)..(768): n is a, c, t, g, unknown, or other
aaattatactttccctccggaaatgatatttttttggggtnttttnngagcaatnnnnnaaaaataccgctcgccgcgcaaaagcgagaaaatctagaataatggatcccccgggctgcaggagttcgtctcacccctagaaaaaatcaggcatccaagcttaaagcaagcagatctaagctccaggcagcgtcgcgacagagtgagtgagtagcacgacaacaacaatggctgtccctgaaggccgcgaagcccagcggagttgcggcgcagggcaaggagccggcgcccaagctcagcgagacggcgacgaagccgtcagccgcgaagagcggcggcgttaagaaggctaaaaaaaaacccccggaaaccaaacggaaggtgaagagcagcaaaccggcggggggggccaaaaagcgaccccccccccccanaggagggggggggagcttcccatgcatgcaataaatgaaccccccgcccgggtaatggaatcaaaaacgcccccctcctggacgcctcccacccgccggcggcaaagggggggccactcccaccggcgacaatacagcggatggggggctgcggaaaagaaaacggtgggcaagcggtgcccgggccacacgctaaatatacacaccggctgatgggacggaggtaatcgcgggatcgcgcccccccacacccatcacggggcgataatacaaagaccacgaatccacaactaggagcctccacgccatcgcgccgcgcgactccggactcggn

SEQ ID NO: 60887 - protein, 63 aa, Zea mays
  misc_feature: Ceres CLONE 1521761
MHAINEPPARVMESKTPPSWTPPTRRRQRGGHSHRRQYSGWGAAEKKTVGKRCPGHTLNIHTG

SEQ ID NO: 60888 - DNA, 795 bp, Zea mays
  misc_feature: Ceres CLONE 1521762
  misc_feature (1)..(1): n is a, c, t, g, unknown, or other
  misc_feature (63)..(63): n is a, c, t, g, unknown, or other
ntttttgattgtataaacaacgatgaaaaaattccaaaaagagacgcgaggaagcgcccaacnctaatctggaactcctccgcggtggcggccgctctagaactagtggatcccccgggctgcaggaattcgtctcacccctagaaaaataatgagttcaggttgtggtcggtggccatttctttttttgtaatatgccccacatttgtcacaaatgacacgagattcggtggatctgttcggcagtaaaatcagaagcagagtatgtgttatggactgtagttttgtcctggaaatggattttaagacaggagaataattggctgttgtaatatgtaaagcactggaacgagcaattttgacaactgctttggaagtggtgggcaatttccaaaagattattggcctaattattcaaggagtttgtttccaaaaaaaaaaaaaaaaaaaacgaagacgcttccaggttaccccaaattttctcccttaaaacccaagccgttattttaccccccgccttcactggggccccgtcttttttttccaaccgttccggggaacggggggaaaaaacccctgggggggtttaccccaaaattttatttcgccctttggcaaggaaacatttcccccctttttccgcccaggctgggggggtaaattatccggaaaaaagggaccccccaacacgatattcgtcccctttcgcccaaaaaattgtggcgcacaaccctggaatatgggggcaaaatgggaaaattttgttaaggccctctcaaataattttttggggca

SEQ ID NO: 60889 - DNA, 689 bp, Zea mays
  misc_feature: Ceres CLONE 1521767
  misc_feature (366)..(366): n is a, c, t, g, unknown, or other
  misc_feature (368)..(368): n is a, c, t, g, unknown, or other
  misc_feature (369)..(369): n is a, c, t, g, unknown, or other
  misc_feature (370)..(370): n is a, c, t, g, unknown, or other
  misc_feature (371)..(371): n is a, c, t, g, unknown, or other
  misc_feature (372)..(372): n is a, c, t, g, unknown, or other
  misc_feature (374)..(374): n is a, c, t, g, unknown, or other
  misc_feature (376)..(376): n is a, c, t, g, unknown, or other
  misc_feature (377)..(377): n is a, c, t, g, unknown, or other
  misc_feature (379)..(379): n is a, c, t, g, unknown, or other
  misc_feature (380)..(380): n is a, c, t, g, unknown, or other
  misc_feature (381)..(381): n is a, c, t, g, unknown, or other
  misc_feature (382)..(382): n is a, c, t, g, unknown, or other
  misc_feature (383)..(383): n is a, c, t, g, unknown, or other
  misc_feature (384)..(384): n is a, c, t, g, unknown, or other
  misc_feature (385)..(385): n is a, c, t, g, unknown, or other
  misc_feature (386)..(386): n is a, c, t, g, unknown, or other
  misc_feature (387)..(387): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (392)..(392): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
ccaagctggagctcaccgcggtggcggccgctctagaactagtggatcccccgggctgcaggaattcgtctcacccctagaaaaaaaataaacaattccattcgcctaccattctccatggctggctggtgctatagtatccgtcgtgcagagacggacgccggccgattttgctacagtgcaatctaccaatggttcccgacttcccgttaaaacgcgcattgctcacatcaagatctctcaatgttcgttcggttgctttgatgcgcacgtaggactgtaggagtatagtgctactcctgtgtatgtcccccgtttttcttttttcttttggtggtaaaaggagctctgacatgagagcagacncnnnnnanannannnnnnnnntnnnnnnnnnnccccccccctattttcaccccccaccactataacctccccaattttaatctattatttatccaatcctctccctatcccccccccccccctatccgaaacttattataaaccgcgggcccctgggagggcccctttttatccccccaaagaggggaaaaccccccccccccccccttttgccttctctattttatacaatccttcccccataacaacaaccccgggcgacaccccaaaaaaaaaaaccccacttatcaaaataccccccttcctcccaccaaagttgcgcg

SEQ ID NO: 60890 - DNA, 688 bp, Zea mays
  misc_feature: Ceres CLONE 1521772
  misc_feature: Encodes the peptide sequence at SEQ ID NO. 60891
ggagctccccgcggtggcggccgctctagaactagtggatcccccgggctgcaggaattcctctcacccctagaaaaaaatcccatcctgatctctcctcccttcttcagtgcagcagcaggccagcagcacgccacccgccccactcctgcctccgatccgctgcttactcgccacccggagatggccaccgccgccgccttctccgtctcctcgccggcggcctccgccgtcgccgcgcgatccaaggtgtttggaggaggagttaaccaggcgagaactagaactggctgccgcgtcggcatcacgcggaagaactttggccgtgtcatgatggcccttgcagtggatgtttctcgttttgaaggagtgccaatggctcctccagacccaattcttggggtttctgaggcctttaaagcagataaaagcgagctgaagctcaatcttggtgttggtgcctataggacagaaaagctgccgccatacgtgctccatgtagtcaagaaaggctgaaaatccttatgttgggaaaaaaaaaaaaaaaaaccgagacgccccgaggtaccccaattcccccccatagggggaggcgtatttacccccgcgcctcactggccccgcccctttttaccaaacctcccctgaacttggggaaaaaacccccggggccgtgttaccccaaaac

SEQ ID NO: 60891 - protein, 110 aa, Zea mays
  misc_feature: Ceres CLONE 1521772
  misc_feature: SWISSPROT Homolog: EC 2.6.1.1 Aspartate transaminase
MATAAAFSVSSPAASAVAARSKVFGGGVNQARTRTGCRVGITRKNFGRVMMALAVDVSRFEGVPMAPPDPILGVSEAFKADKSELKLNLGVGAYRTEKLPPYVLHVVKKG

SEQ ID NO: 60892 - DNA, 729 bp, Zea mays
  misc_feature: Ceres CLONE 1521773
  misc_feature (14)..(14): n is a, c, t, g, unknown, or other
  misc_feature (19)..(19): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
gcccccgccgctcnccccnccccccttttttttgagagaaatatttttgggttttcgcttnnnnnacaaattggaactccccgcggtggcggccgctctagaactagtggatcccccgggctgcaggaattcgtctcacccctagaaaaaaaaggcccaagccaacacctcctaagcctagcgttaccataagatattagaccctcttggtctcttctagcgcttcgagttaggggaggattccgaagttaatgggaatcggatttgtatttgataaaaagcatatgcctcgacaatttgtgccctcttgcttggtcactaccgggaaattggggaagtaaatctatggtgggtacaactcctatccgtccctgggggtcagtgagaattgttattcgtcagcgggcgtttaccataaccgttaaatatgggagagagaaaaacaagtggggcggaatattataaacttcggcggtaacactgggcgagcttaccattgttaattcaggtttgtgataacgccccctcccgcctctgggtggaagactatgccaccatacatgatcggctgatgccgaaaacaagaaatacacgcccccaaggagaggactgggtggaggtgtaggctccggggaaaacggccggcgggacctccctcctcctcaccccggctcacatcttggtggggtccacaccgggatgtcggcagagtccgctcgggggggggtg

SEQ ID NO: 60893 - DNA, 545 bp, Zea mays
  misc_feature: Ceres CLONE 1521783
ctccccgcggtggcggccgctctagaactagtggatcccccgggctgcaggaattcgtctcacccctagaaaaataggcgccctgaccccaaccgtgccctgatgtaaggttaatccgaattctgaagtcatgggtgcgcttccagtcgcagcgtctttagctaacaagctcgcatacatataggcaacttgagtgagctatgtagtacggatatggttgtgtggcaaactgccaatgactattgacatccttgcatatattgacatgtgacaaggatcaacctgcaaaactggtgccctgctactcgcagaccttattaccttaaataacacaggtggtgtgtttttcaattatgtgaaaaccttggccacgtcctcagcgtcccctttcgtgcttccaattctgatctactgctagggacgaaactgaggattgttgtatcaataaactacagtttgagtacttacaaatatgaaaaaaccgtgatcggtaaaaaaaaaaaaaaacgaaacgctcgaggtacccaattcgcctatagtgagcg

SEQ ID NO: 60894 - DNA, 672 bp, Zea mays
  misc_feature: Ceres CLONE 1521785
  misc_feature: Encodes the peptide sequence at SEQ ID NO. 60895
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (537)..(537): n is a, c, t, g, unknown, or other
  misc_feature (538)..(538): n is a, c, t, g, unknown, or other
aaagctggagctccccgcggtggcggccgctctagaactagtggatcccccgggctgcaggaattcccctaaccccgggaaaaaacactgcgactcacagcaggcgaggcgaatgataggccaggcggcgcggcgggcaagtatgtttgacgatcaagacctgggcttctttgccaattttttgggcatcttcatctttgtcttggttattgcgtaccacttcgtgatggcagacccgaagtacgaaggaaactgatgtcctctagtgcaaagatcctattatctgcaggccgaaatagggctatactgttagctaatgctagtgagatcgcttgacactttgagtgcatatcatggaaagctggacatgcagttcctggcattttggttttgcccatgttttaatctgctgaattagtaaatcctggagaattcaaaagcgttttcaagtactgcagttggtggttgtttctgggcctagtgtatgcatgccagaatcttatgaataaaattcttttgtttttttgccannnnaannaaaaaaaaaaaaaacaccacaacataacaatacaaacaaccaaaaacaccgggaaaaaaaaaaaaaaaaacccggggcccgtccgggggccccccaaattcccccctaaagggggggcgctattatcccccccc

SEQ ID NO: 60895 - protein, 37 aa, Zea mays
  misc_feature: Ceres CLONE 1521785
MFDDQDLGFFANFLGIFIFVLVIAYHFVMADPKYEGN

SEQ ID NO: 60896 - DNA, 783 bp, Zea mays
  misc_feature: Ceres CLONE 1521796
  misc_feature: SWISSPROT Homolog: EC 4.2.1.3 Aconitate hydratase
  misc_feature (783)..(783): n is a, c, t, g, unknown, or other
ggtttttgagtaaaatattatccacaacattaattatttttggtgctttcccccacccccccccggtcatagctgggactccccgcggtggcggccgctctagaactagtggatcccccgggctgcaggaattcgtctcaccccagaaaaaaagaagtgaacaagtttttgaacggagaagttggacccaagaccattcatgttcctactggggagaagctttctgtttttgatgcggccatgagatacaaatctgagggccatgctactataatccctcgctggtgctgagtatggaagcggcagttctcgtgattgggctgctaaaggtccgatgctcctgggagttaaagctggtattggccaaaagctttgaacgtatccacagaaagaaccttggggggggaatggggaatcatttcctctggtggctccaaagctgggtgaaggatgcctgatttcgctttgggcctccactgggaaattcccccccctcaccaaaaaaaaaaaaaaaaaaaccaagaccgcttcggagggttcccaccatttcccgcccctttttaggtggagttcggtatttaacccccccggctctccctggggcgcctgcggttttttacaaaacgcgcccgggaaccgtgggaaaaaaacccctggggggtttttcccccactctttatatccgcccttggtaaagcaatatccccccccttttttccccaagttggtggggttatattaacctaaaataaagcccccgcacaccggatttcccctcttttn

SEQ ID NO: 60897 - DNA, 650 bp, Zea mays
  misc_feature: Ceres CLONE 1521797
  misc_feature (340)..(340): n is a, c, t, g, unknown, or other
cagagctggagctccccgcggtggcggccgctctagaactagtggatcccccgggctgcaggaattcgtctcacccctagaaaaactgaagacggaaaaggattcctctcccccacctgacgcctcgccgctacgcccgcatttcccaatccatcctcgtcgccaggtgctcatctcgcgtcgacatttacccggtccgatccccggcacgaaaaataaagaagctagtgggtacagacacaagacaatattatattgggactcaattagtttgatgtttggcaaagatcatgcaaccggtgaagtcgcaaagaccctagctgatggcgcgagagacatngagtaaggaagaggtgatgcgcgcaagtacgattccttgttggcacttctggtgatccttaggaagagatggctgctgaagcaactgaaaaagtgaaccgagttgtggtttggtgaaatgaactactgtttgaagtgttgcccaagtgaaaaaattgttgggtctggttgaacctaaaaaattaattttgggtcttaaaataaaagggttggggccccctttgggcccctttcccctaaataaataaaaccacaaaaactacaaactctttgcctctagggggttaccccccaaattttttccccccccc

SEQ ID NO: 60898 - DNA, 629 bp, Zea mays
  misc_feature: Ceres CLONE 1521798
  misc_feature: SWISSPROT Homolog: EC 3.2.1.23 Beta-galactosidase
  misc_feature (629)..(629): n is a, c, t, g, unknown, or other
aagctggagctccccgcggtggcggccgctctagaactagtggatcccccgggctgcaggaattcgtctcacccctagaaaaaggttatttgaaatcaacccagaaggtaaagtgcctatcgtgaagctcgaggaaaaatggattggtgattctgatgttataacacaagcattagaggagaaataccctgaaccacccttggcaactccaccagaaaaagcttcagtgtatgtgatatttccagtgccctaattaataactcctgttttgcacttatgtaagggtgttcagcactcatgtttcaaatgttgagtcatccacacatattttgtgctaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttn

SEQ ID NO: 60899 - DNA, 642 bp, Zea mays
  misc_feature: Ceres CLONE 1521800
  misc_feature: Encodes the peptide sequence at SEQ ID NO. 60900
tggagctccccgcggtggcggccgctctagaactagtggatcccccgggctgcaggaattcgtctcacccctagaaaaaaccctcgaggaaggcgaccggagatggcggcgtcgtcggcggtggagaagctcaaggtcctctgggactcgcaggtcaacgacgaggagcagtgggcgctcaattataagctgctgaaggctgctggtctgtttgcgggatccatcttcctgatgcggaacttcggtgatctgatggccatttagtaggcttatcagcgttgtttacttggatcctatgagtgttgttttgatgttccaataattcctgctatgaatatgaaagctattttgctccgaagaggactagatctgtgccgatagtgcttgatcttttagactttgtagccatagagattagaccctttaatattcggcatgtaccgtgaatattttggaacgatggtatcagtctgcaccccctcataaaaaaaagaaaaaaaaaaaaaaaacgagacgctcgaggtaccccaattcgccctatagggaggcgtattacgcgcgctcactggcccgcctttttacaacttcttgactgggaaaaaccctggcgtttacccaactttaatcgccttgcagaacatc

SEQ ID NO: 60900 - protein, 53 aa, Zea mays; identical to SEQ ID NO: 49007
  misc_feature: Ceres CLONE 1521800

SEQ ID NO: 60901 - DNA, 758 bp, Zea mays
  misc_feature: Ceres CLONE 1521810
  misc_feature: Translation starting site: 228
  misc_feature (20)..(20): n is a, c, t, g, unknown, or other
  misc_feature (24)..(24): n is a, c, t, g, unknown, or other
  misc_feature (37)..(37): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (67)..(67): n is a, c, t, g, unknown, or other
  misc_feature (364)..(364): n is a, c, t, g, unknown, or other
tgaatttatttggggggggnggcnagcccccgactcnccccnnnggggggannnnnnaaaaaactgnagctccccgcggtggcggccgctctagaactagtggatcccccgggctgcaggaattcgtctcacccctagaaaaatcaggcatccaagaagctcaaagcaagcagatctaagctccgggcagcgtcgcgacagagtgagtgagtagcacgacaacaacaatggcttccctgaaggccgcgaagcccagcggagttgcggcgcagggcaaggagccggcgcccaagctcagcgagacggcgacgaagccgtcagccgcgaagagcggcggcgttaagaaggctgagcaaaagccccnggaaaccaaaaggaaggtgaaaagcagcaaacaggggggcggcggcgcaattttgccccccccccacggggggggaggggggggggggagtttccctggcatgaagtgaatcccccccccccgcaaaagaatccgggggggcgggccatttccggggaaatcatcccgggcggactgcccgccgtggtgcggttacctctaatgggggggggccacggcagcgaggggatacttacggcgggggtggcataatgcggggcaaaaacaaagcggggggaaaacacggggggaaacaaacagtgggggggcacatgcatgggggaggcatgaaaaattgatcggtttggcgggggcgacaggggggggccagaaacacggcgcatgcagctgcggg

SEQ ID NO: 60902 - DNA, 727 bp, Zea mays
  misc_feature: Ceres CLONE 1521823
  misc_feature: Encodes the peptide sequence at SEQ ID NO. 60903
  misc_feature (39)..(39): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (60)..(60): n is a, c, t, g, unknown, or other
aatgcgggggggggggacaacagtccaatggacgggcangtggccttttttttttnnntntaataactggagctccccgcggtggcggccgctctagaactagtggatcccccgggctgcaggaattcgtctcacccctagaaaaactagaaaaaatccaagaagctcaaagcaagcagatctaagctccaggcagcgtcgcgacagagtgagtgagtagcacgacaacaacaatggcttccctgaaggccgcgaagcccagcggagttgcggcgcagggcaaggagccggcgcccaagctcagcgagacggcgacgaagccgtcagccgcgaagagcggcggcgttaagaaggctgagcagaagcccccgggaaaccaaaaggaaggtgaagagcagcaaacaggcggcggcggccaaaaagtgacgtacagaacgcgtggagtgaaatggagcttccatgcgtgggtgaacccatgccgtggtataaaacgagggcgtcctttcttggatcttccgtgggacagggaagtgtgggacccctcatgggggatggaggccagaacgaggccggcgggtaaaaacctttgtggcggaatggaaaaaagaaaaaccgggggggccaaagggggccgaattacgccccagtagggggggggggggtaaacagggggccaccaaagggggggacaaatattaaagcgggggcgggggcgagaaaaaaaacg

SEQ ID NO: 60903 - protein, 138 aa, Zea mays
  misc_feature: Ceres CLONE 1521823
MASLKAAKPSGVAAQGKEPAPKLSETATKPSAAKSGGVKKAEQKPPGNQKEGEEQQTGGGGQKVTYRTRGVKWSFHAWVNPCRGIKRGRPFLDLPWDREVWDPSWGMEARTRPAGKNLCGGMEKRKTGGAKGGRITPQ

SEQ ID NO: 60904 - DNA, 623 bp, Zea mays
  misc_feature: Ceres CLONE 1521828
  misc_feature: Encodes the peptide sequence at SEQ ID NO. 60905
  misc_feature (498)..(498): n is a, c, t, g, unknown, or other
  misc_feature (507)..(507): n is a, c, t, g, unknown, or other
aagctggagctccccgcggtggcggccgctctagaactagtggatcccccgggctgcaggaattcgtctcacccctagaaaaaataaagaagacgctcccgaatccgtctccgcctcctgtcgctcgctctccctgtctcccgcacgccgacccgcagccgccgccgttcgccatgggtttcctcgacgcgctctaccgtgtggtgatgcgccgcaacgccgtctacgttaccttcgtcgtcgccggcgctttcgcgggcgagcgggcggtggactacggcgttcacaagatctgggagatgaacaacctcggggaaaaggtacgaagacatatcggttttggggcagaggccagctgaagaatgataaattttggtcaccagttttgcttccggttgaccgtttccttttggcacagtaataaacgatgtaaacttacgctgctcctatgacctcctttctcattcgtttactctgaaaaatgcttttggtgggggnaaaaaaaanaacaaaaaataataaaaaaaaaggaaaaaaaaaaaaaatacccgagacgcctcgaggtaccccattccccccctaaaagggaatgcgtatttacccgccgctcccctgggccgtct

SEQ ID NO: 60905 - protein, 61 aa, Zea mays
  misc_feature: Ceres CLONE 1521828
  misc_feature (4)..(59): Pfam Name: UCR_UQCRX_QCR9 Pfam Description: Ubiquinol-cytochrome C reductase, UQCRX/QCR9 like
MGFLDALYRVVMRRNAVYVTFVVAGAFAGERAVDYGVHKIWEMNNLGEKVRRHIGFGAEAS

SEQ ID NO: 60906 - DNA, 449 bp, Zea mays
  misc_feature: Ceres CLONE 1521897
  misc_feature (223)..(223): n is a, c, t, g, unknown, or other
  misc_feature (327)..(327): n is a, c, t, g, unknown, or other
tggagctccccgcggtggcggccgctctagaactagtggatcccccgggctgcaggaattcgtctcacccctagaaaaaatcgatcctgtcctgtccagcaagggagacctggactggaggaggaggacctacctacccggcctccagctctctcgtctcttcctcctcctctcgagctcgatcgatcccatgttgaagagtcagctccgggctactatcggncttcgcgggcgcggcgagtctaacccttgacggggccaagtaaaccccaaatttccggggtaaaaaattcctcccccccggggtgggaaaaatttggggccccncccggggcccaagggaaattcccccgttcttcaaaagaaaaggggttttttccccccttgtggggggggtttttgggggggaaaaccccgaaaaaaaaaaattcttttgtttttccaaaaaa

SEQ ID NO: 60907 - DNA, 752 bp, Zea mays
  misc_feature: Ceres CLONE 1521903
  misc_feature: Encodes the peptide sequence at SEQ ID NO. 60908
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
ctttccttagtgtttattatattacaccgctccnnnnnnnnnnnnnnnnccatagctggagctccccgcggtggcggccgctctagactagtggatcccccgggctgcaggaattcgtctcacccctagaaaaagtgctttcttagaggtgggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgccgaaccccctcgagggcatgaacggtacagagctgggacggccgcaacatctccgtttacgaggccccattcctccggcggccgttgaggccgcggtggtggggtacggtggctggccttgaaaggcggcggccaccgtcggtggccggcccccttgcatggccagcgagcggcctacgcgcgggggtccggctggttaatggtggtgcgccgggcgcgctacgtttgcttgtttacctcgccggtctcaccgcctatgggaacacatcttggccgcgcgcgttttacggcgattttccctatcactgggagcccgggccggattatttttt

SEQ ID NO: 60908 - protein, 102 aa, Zea mays
  misc_feature: Ceres CLONE 1521903
  misc_feature (10)..(80): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAASDVEYRCFVGGLAWATDDHSLHNAFSTYGEVLESKIILDRETQRSRGFGFVTFSTEEAMPNPLEGMNGTELGRPQHLRLRGPIPPAAVEAAVVGYGGWP

SEQ ID NO: 60909 - DNA, 637 bp, Zea mays
  misc_feature: Ceres CLONE 1521906
  misc_feature: Encodes the peptide sequence at SEQ ID NO. 60910
tggagctccccgcggtggcggccgctctagaactagtggatcccccgggctgcaggaattcgtctcacccctagaaaaaacctccatccagctcgagccagcccgtcgcctgcgcgcatctctctacacttctactgcttcatactctcgtagagagatccccgcggcccaataaaaacccgactcgctagctgcactacacactcgcagatggccggcctcaggatgaagttcgtcgccgtcgccgccatggccgccgcgctcgtggcgtccgccgcagccgccgaggcccccgccccggcccccgcctccgacgccgcggccgccgtgcccctcgccgcggcctccctcgccgccgccgccttcggctacctcttctgctagatccgcgctggacgcgtggtttctgcttgatttgtgattcgtctggcgcgagtggagtccgtgtcttgcgcgtgttctgtttaaattgtttccgccgggcttttgttcttttttttttggaaaccctggggcaaaaaaaaaaaggtttcccccgggggggaccacgcctctcaaaacccccttttgtgtgggggggaaaaaattggccccgcccccttttttgggggtaacaaaaaaaaaaaatttttttttg

SEQ ID NO: 60910 - protein, 57 aa, Zea mays; identical to SEQ ID NO: 43282
  misc_feature: Ceres CLONE 1521906

SEQ ID NO: 60911 - DNA, 668 bp, Zea mays
  misc_feature: Ceres CLONE 1521908
  misc_feature: Encodes the peptide sequence at SEQ ID NO. 60912
atagctggagctccccgcggtggcggccgctctagaactagtggatcccccgggctgcaggaattcgtctcacccctagaaaaattttggctctggtcgtcacaaagttgtttgtgaatcacgccggcgacaagggggcgaccaggtacgcggaccgggtggcgactaccgcgggagcagatctcacggaatggcggcgaatgctctctcgagccccgtgccggtggagtggtacccgacactagccgtcgtcatggtatccgtatgcctcatgttcaccgcctccttctccttttatgaagccacttcatcccggaggagccgttgcctgtcaaaggatatcgcaacagcagttgttgtcttctgttttctcgggctgtggggcggtggtcgtgcttcttgcaagtggtgcttatccctgatgactgactatggggcctgtgtgcttgtgctctgcatcccaagttctagacttggttatgacagatcctcaaagctgttgtcctagcgaatatagagccatttgaacttattctagaacgatgggtggggaaccaccgatttataccaacgtttaccctccaaggctcctttccattatccccagccttaatccctggttcccttttcggaaaaaaactacccctacacgggacccttctgggtac

SEQ ID NO: 60912 - protein, 105 aa, Zea mays
  misc_feature: Ceres CLONE 1521908
MAANALSSPVPVEWYPTLAVVMVSVCLMFTASFSFYEATSSRRSRCLSKDIATAVVVFCFLGLWGGGRASCKWCLSLMTDYGACVLVLCIPSSRLGYDRSSKLLS

SEQ ID NO: 60913 - DNA, 782 bp, Zea mays
  misc_feature: Ceres CLONE 1521916
  misc_feature: Encodes the peptide sequence at SEQ ID NO. 60914
aagctggagctccccgcggtggcggccgctctagaactagtggatcccccgggctgcaggaattcgtctcacccctagaaaaagcacttgcccgcaccccacccgacccacaccctgcacgcagcagcaacgagtctccctgggaggagcgagcgagagagcggtatggccggtggcagcatggtgttcgagccccacgcgggcacggtggcgggcggcgacgtcgtgttctgcgcggccatcgtgtgcctgtcgctcctgtccatgatcatcttcgcggcttccggctcctctggcgctggggacggggaggaacggttgaagttctcgccggcacgcccgatccaacggggcctgttttcttttccccccccccccccggggggtagcagggggtccccccccacataaccttcttttcccccacccctctatctccccccagcatacgtcccctgcctccgggggacggggcgccgtctcccacgctgcaccccccgctatgggactcttcccgggatcgcgcccgcggccgccctcctttccccgcctgaatcccgcgccttctgctagccttttaatctttcctttctccgtactgccctcggctcccacactactcgcgccacattagcagttttccccttctccctctccatagttcgcccctatgtccccgccgtcctccacaccgtccttcgcgttggaccttgtgtcccttgtcacgccttgtgccccgccaatcgcggcggcatgacgccccctgtctttattttttattg

SEQ ID NO: 60914 - protein, 81 aa, Zea mays
  misc_feature: Ceres CLONE 1521916
MAGGSMVFEPHAGTVAGGDVVFCAAIVCLSLLSMIIFAASGSSGAGDGEERLKFSPARPIQRGLFSFPPPPPGGSRGSPPT

SEQ ID NO: 60915 - DNA, 664 bp, Zea mays
  misc_feature: Ceres CLONE 1521917
  misc_feature (402)..(402): n is a, c, t, g, unknown, or other
  misc_feature (664)..(664): n is a, c, t, g, unknown, or other
aaagctggagctccccgcggtggcggccgctctagaactagtggatcccccgggctgcaggaattcgtctcacccctagaaaaagtgtattcgaaccatagctgtcctaccgtcctcccttcccagcacccaatggaccacgtggggctgctctgcccgttaggcagcggcaacctgcggctgcaaagcgacctcgccgttctggccacaacccatggcgcgcatgtgcagtacgccgtcgggcgcgctaaagctggcgctgctggtggtgtgtcgtgccctggcctcttcgttattcatgacccggtatgacatactcttctcgttcggttgatactggcccgtgtcctcgatttgcattgttctccccccccaggggggggggagggaggtttgaacccntgacaaatcattacttaccttctgtggatggacatcttggtcgcttttgggaaaggaatgttgcttggcttttggaaacgaaatccgactgcccttgtgcttgggtaaagtttatgcggactggttgtcgggctgggcccgcccacagttcccctcccacattgccttgcacaaaataacccgcttaatcgccccacccccacttaggtcccggtaaaaaaacacctccctcctgtccagtgtatgccaatctcggtttttn

SEQ ID NO: 60916 - DNA, 660 bp, Zea mays
  misc_feature: Ceres CLONE 1521919
  misc_feature: Encodes the peptide sequence at SEQ ID NO. 60917
tggagctccccgcggtggcggccgctctagaactagtggatcccccgggctgcaggaattcgtctcacccctagaaaaacctaaaactagaaaaagttggagcgcgatctagaggtgagcagcgtgcccaccgtcaaggactcgcaggccatctgcgacctcgtctactcgctcttcgtctccgaggaggtggacaaggtggagctgctctactccaagttcgtgtcgctggtgcgctccgaccccatcatccagacgctgctccccatgtcgcccaagggcgagatctgcgacgtcaacggcgtctgcgtggacgccaccgaggacgagctcttccgcctcaccaccaaggaggggaagctcaccgtggagcgcgagaaggtgaagatcgagacgcagcccttctcccccgtggtgcagttcgagcaggaccccgtgcagatcctggacgcgctgctcccgctctaccctcacagccagatcctccgtgccctgcaagagtcgctcggcagcgagctcgccgccccgatgagcgccatgagcagcgccaccgacaacgccattgagttcggaagaacctttcctcgcctaaaccaaaggggccaggcaaaataacggggaaaaccctcaaatctccccgggcccacccctccttgggga

SEQ ID NO: 60917 - protein, 115 aa, Zea mays
  misc_feature: Ceres CLONE 1521919
  misc_feature: SWISSPROT Homolog: EC 3.6.3.14 H(+)-transporting two-sector ATPase
MSPKGEICDVNGVCVDATEDELFRLTTKEGKLTVEREKVKIETQPFSPVVQFEQDPVQILDALLPLYPHSQILRALQESLGSELAAPMSAMSSATDNAIEFGRTFPRLNQRGQAK

SEQ ID NO: 60918 - DNA, 632 bp, Zea mays
  misc_feature: Ceres CLONE 1521921
  misc_feature: Encodes the peptide sequence at SEQ ID NO. 60919
  misc_feature (632)..(632): n is a, c, t, g, unknown, or other
aaagctggagctccccgcggtggcggccgctctagaactagtggatcccccgggctgcaggaattcgtctcacccctagaaacagtctcggcctctcctcccggcttcctcacacggtactccagccgctagccctcactcaaccagacaaccagtacaccaccgccaccaagcccgggccgaataactctgccgggcaaccgccgcccttcgccggcaaagaacgcccaccagatccaccccggcctgctatggagtccgcggtgaacccgaaggcgtacccactggctgatgcgcaactgacgatgggtatcctcgatatcatccagcaggccgccaactacaagcaactcaagaagggagcgaacgaagcgacgaaaaccctgaatagggggatatcggagttcgatgtgatggcggcggacacagagcctctcaagatcctgctccacctccccttgttagccgaggataagaacgtcccatatgtatttgttccatcgaaacaagctcttgaccgtgcttgtggtgtgacaagacccgtcattgcttgctcagtgaccaacaatgagggtagccagctgatacaacagatacagggtctcaaggactctattgagaaacttctcatn

SEQ ID NO: 60919 - protein, 126 aa, Zea mays
  misc_feature: Ceres CLONE 1521921
  misc_feature (19)..(113): Pfam Name: Ribosomal_L7Ae Pfam Description: Ribosomal protein L7Ae/L30e/S12e/Gadd45 family
MESAVNPKAYPLADAQLTMGILDIIQQAANYKQLKKGANEATKTLNRGISEFDVMAADTEPLKILLHLPLLAEDKNVPYVFVPSKQALDRACGVTRPVIACSVTNNEGSQLIQQIQGLKDSIEKLL

SEQ ID NO: 60920 - DNA, 651 bp, Zea mays
  misc_feature: Ceres CLONE 1521925
  misc_feature: Encodes the peptide sequence at SEQ ID NO. 60921
ctggagctccccgcggtggcggccgctctagaactagtggatcccccgggctgcaggaattcgtctcacccctagaaaaagagtcacggatagcagaggcagcacactcagctatcctgtaaaggagatcgagacccacgagtcatggccaccgtcagcgccgccgtggtgaccaccatctttgcccgcgccgcgatcaccaggcccaatgctctacggttgcctgcgctgatggcgagaaccgatagggtgcggtgcacctaccccaaggacgcggccccagtcagcaccaatggcgcacgcgcgtcactgctcaccgcaccatgagcggtgaccgcgaccgcgggatccacgttggcgctcgcggacaagatcatgaccacggacggcaccgggctgaacctcgtgctcattaacaacctggtggggtggatcctcatggcggtcttcgacatcatctggaccctctacaccatctacacctctgacctcgactaagacgaggagtccagtgggctctctctctagatccaccctctcctgttaatgatctgaatgtaaacatggtggcggtcctctgtgtatatttagaactggctatgtgcatctcagatccatcctctcctgttaataatgtgaggacactacgaa

SEQ ID NO: 60921 - protein, 40 aa, Zea mays
  misc_feature: Ceres CLONE 1521925
MTTDGTGLNLVLINNLVGWILMAVFDIIWTLYTIYTSDLD

SEQ ID NO: 60922 - DNA, 637 bp, Zea mays
  misc_feature: Ceres CLONE 1521928
  misc_feature: Encodes the peptide sequence at SEQ ID NO. 60923
aaagctggagctccccgcggtggcggccgctctagaactagtggatcccccgggctgcaggaattcgtctcacccctagaaaaaaaaaaggtgagaagaaagaagccgtgtccgcgtgattttctgggtgaacttttcccggcctccgctccggccagatcggcgcgggagtttgtcatggcgtctaagcgcatcctcaaggagctgaaggacctgcagaaagacccccccacatcatgcagtgcaggtcctgctggtgaggacatgtttcattggcaagcaacaattatgggaccacctgacagtccctatgctggcggtgttttcttagtgaacattcatttcccgccagattaccccttcaaacctccaaaggtttctttcaagacaaaggtcttccatcctaatatcaacagcaatggaagtatatgccttgacattctcaaagagcagtggagccctgctctgacaatttctaaggtcctgctctccatctgctccctgctgaccgaccccaacccggacgaccctcttgtcccggagattgcccacatgtacaagacggaccggccgaagtacgagtcgacggcccgcagctggacgcagaagtacgcgatgggctgacgaacgctttcct

SEQ ID NO: 60923 - protein, 148 aa, Zea mays
  misc_feature: Ceres CLONE 1521928
  misc_feature (5)..(142): Pfam Name: UQ_con Pfam Description: Ubiquitin-conjugating enzyme
  misc_feature: SWISSPROT Homolog: EC 6.3.2.19 Ubiquitin--protein ligase
MASKRILKELKDLQKDPPTSCSAGPAGEDMFHWQATIMGPPDSPYAGGVFLVNIHFPPDYPFKPPKVSFKTKVFHPNINSNGSICLDILKEQWSPALTISKVLLSICSLLTDPNPDDPLVPEIAHMYKTDRPKYESTARSWTQKYAMG

SEQ ID NO: 60924 - DNA, 658 bp, Zea mays
  misc_feature: Ceres CLONE 1521929
  misc_feature: Encodes the peptide sequence at SEQ ID NO. 60925
aaagctggagctccccgcggtggcggccgctctagaactagtggatcccccgggctgcaggaattcgtctcacccctagaaaaagccctggtgttctagccaaagcttgcagtggtgtgagggattcatgtgtattgaaagccaaagctcctctcccactgacaccaagttggcactgtccagagctgtgtgcgctgtcttcctgtgtttgtgatgaccacaaccaccaagttcaccccaccatacccagaacattctagggagttgctggcctatatgaagcttgttccgtaatcatctcagaactcctaccagaaggagtgaagattccagctgaagtggtgactgaagaggaatctactctagtggctgctgatcaagtggaggagccatctaactggggttaatacagggatcgagtacctcttcactgcaataaggtgatgaggagtactctacgtgttcctgtggctggacggcgtctctagttctgaaggaagattatctagtcttgagtataagctttggagggttcctaccttcctgctaatgtaataagttatgcactttgagtatattaggacttgtaacagatgtaactcttcctatgtaataaacttcaattgtagaaatgaaaagcatgtattataaaaaaaaa

SEQ ID NO: 60925 - protein, 32 aa, Zea mays
  misc_feature: Ceres CLONE 1521929
KAGAPRGGGRSRTSGSPGLQEFVSPLEKALVF

SEQ ID NO: 60926 - DNA, 645 bp, Zea mays
  misc_feature: Ceres CLONE 1521930
  misc_feature: Translation starting site: 559
aagctggagctccccgcggtggcggccgctctataactagtggatcccccgggctgcaggaattcgtctcacccctagaaaaagaaccggtcaacgactcaacctgagaagctagctagagctagctagctccgggcgcccgcagcatggccactaacagccaccgcattattgcgcccggcctcctgctggtcgcggtcactacgctagtcgtcgacgtacgcgcagctcgcggcgccggctgccgacctgcccctactgcccgacgccgacggcctccccctccgccaccgcccccgcccccggtggtgaacccgccgccgtcgaccacgccgtgccctccgcctacctactcgccgtccacgccgacggacaagtgccccgtggacaccctgaagactgctggcgtgcgtggacgcgctcaacggtctcacgaacgccgtgcctggggaccaaccccagcgacacctgctgcccgcttctgtccggcgtggccgacctaaacgccgcactctgcctctgcacaccatcaagagccaagcgctcatcgtcagcctcatgctccccgtcaccatctccgtgcttcgaccacatagtgccggcaaggacgtgaccctccagatttcaagtgcccggataataact

SEQ ID NO: 60927 - DNA, 826 bp, Zea mays
  misc_feature: Ceres CLONE 1521931
  misc_feature (11)..(11): n is a, c, t, g, unknown, or other
  misc_feature (12)..(12): n is a, c, t, g, unknown, or other
  misc_feature (27)..(27): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
gtttctttttnntttttttaaaacagnatccccccgtacccnnnnttttcnnnnnacacaactggaactccccgcggtggcggccgctctagaactagtggatcccccgggctgcaggaattcgtctcacccctagaaaaaacagcagacagcaccaccggataaggcaggcaaccgctgcccgctcacgtctggcgtctgggagcctccgattctgagagcagcaccaacgcgctcatcctcgccttcgtgcttccgctctccctcttcgtcggcacgctcgtcaccgccgcccgcgtcgccgacgacctcgacgaccgcttcctgagggaggtacgacgtgtacaacgcagcgcgcgcgctgcttctgttactgctaccaaccaacgtactacatgtatatacagggtaaactccatgcagcatggagataaacccactcgatactgggaataagaaccaggctgtcctaacaaatttatggtgccctggttgagggaagaactaccaatgggtgcaggaagcgaagaagcgggggtccaaactcgcccccgtttggtccgcttcgtcccggaagtaagtaaaggagcccccctccccgctatgcccccgccccgccccttcctaccggaacgacggcgcccgccgacaacaccacaaccgtcccccctcttttttccgtttggcggggttggccctacctggtttctccccccggcttcgcagggcgtcacaacgcgggagatgccggcccatcccatctaaaaatgtaggaaaattttatattatttttggtcgcaaggggtcggatgctccaaataaaaag

SEQ ID NO: 60928 - DNA, 651 bp, Zea mays
  misc_feature: Ceres CLONE 1521935
aaagctggagctccccgcggtggcggccgctctagaactagtggatcccccgggctgcaggaattcgtctcacccctagaaaaaatctcagcagtgacgaactcgaagcttgcgttcttgtagtagaggtcggcagcaagtggtggtatagcgagaggtcgagaagatgaagagcagcactctgttggcgatcctagttctccaggcccttctggtctctgcagcacgtggccaaaggacctgctaggccaacgacgaacaagcaatgctggtgcggcaagtgcaccagctggtcgggcgtgtggacctgctgacgacctcctcacgcaagtgcaccgccacctgctagaactgcgtccccgtgtccacggactagggggccatatagtacaggtgccgcgacttcctccccgaaaactgcggctgctagatccactagagactcatccaattccaccatggtcgcgcgccacagcggcacaggcgatggatccttccatgttcctcctgtcgtccgccttgctacaagcaggcatccacaccaataagctagctcttgatgctgttttgtatgtttgattcggtgtcccttcccagtccagatggactacatataatctcaagcgctaaacagacaataaaaacgagtcc

SEQ ID NO: 60929 - DNA, 662 bp, Zea mays
  misc_feature: Ceres CLONE 1521936
  misc_feature: Encodes the peptide sequence at SEQ ID NO. 60930
  misc_feature (393)..(393): n is a, c, t, g, unknown, or other
aaagctggagctccccgcggtggcggccgctctagaactagtggatcccccgggctgcaggaattcgtctcacccctagaaaaatgcacctgcaaattgccgcaaaaccattctgccgccgcgcatcgatctctcttattgcttggccatcatcgtcaactagatggcaagggtgtcgtccgtggagtcgatctcggcctctgtcgtcactggctccgccgtgcgctcggcggcgtacgggcggcggcagaagcccgtgggcggcctcgctggccgctgcaacgccgtgctgaaggagcacaagacgaggctgtacatcctcggcaggtgcgtctccatgctcctgtgctggcacgaccatgcatgacgccgcggggcgcggggctgaggccnatcgatggggccggccgggatcaatcggactgccccggtcgccgccgtttcgaccactgtgcgtcgtcagtgtagggtggcttttattttggagtggaacttcctcagctgcctggttaattggattttgaaccattgataattaccccccccaggcaaataaaacctattgggggaaccgggaaacttccaaggggtaaagaatttttttccttttattaatacccggcgtggtaaaaaaaaaaaaaacccaacccctcccgggcccc

SEQ ID NO: 60930 - protein, 67 aa, Zea mays
  misc_feature: Ceres CLONE 1521936
  misc_feature (44)..(62): Pfam Name: DVL Pfam Description: DVL family
MARVSSVESISASVVTGSAVRSAAYGRRQKPVGGLAGRCNAVLKEHKTRLYILGRCVSMLLCWHDHA

SEQ ID NO: 60931 - DNA, 635 bp, Zea mays
  misc_feature: Ceres CLONE 1521938
  misc_feature: Encodes the peptide sequence at SEQ ID NO. 60932
  misc_feature (635)..(635): n is a, c, t, g, unknown, or other
aagctggagctccccgcggtggcggccgctctagaactagtggatcccccgggctgcaggaattcgtctcacccctagaaaaaatcctccaccacaccacacgcgccgcaaagcagagcacgggggcctgagagcagagcgccatcagccatcctttgcctgcccaagcagcaagcagcagcagcaacggcggctggcccgatggctctgtctctctccggcacctccgcccgcttcgccctcgcgtcgctggtcccccgggccagggcctacgcggcgtcggcggcgtccggggccatgaggcgcgcggcggagggcgcggccgcgggcgaggccaaggaggccgggcgcgccgccgccgccgctgccgagggctcgtgggtgcccgaccccgtcacgggccactaccgccccgccaactgggccgccgccgtcgaccccgccgacctccgcgccgctcacctcgcccgcacctacgcccgggcctgagcggccccggctcccttcaccctgctccgcctcgtctcgtatgacatacgcgcaccgtacgtaccagggtgagacgaggtgaggggtcggggttcgtgtggcgaacggcgtgttgagccacgcgcgcgtgcgcccgccctctgtgn

SEQ ID NO: 60932 - protein, 95 aa, Zea mays; identical to SEQ ID NO: 58232
  misc_feature: Ceres CLONE 1521938
  misc_feature (1)..(89): Pfam Name: LEA_3 Pfam Description: Late embryogenesis abundant protein

SEQ ID NO: 60933 - DNA, 674 bp, Zea mays
  misc_feature: Ceres CLONE 1521939
  misc_feature: Encodes the peptide sequence at SEQ ID NO. 60934
aagctggagctccccgcggtggcggccgctctagaactagtggatcccccgggctgcaggaattcgtctcacccctagaaaaagccgaattaagttcgtgcacgtacgcacgcaccgggacaccagcaacccccaacagcgccactgtccagtgcgcgcgtcaagcttgcttagctagccgccatggcctccctcgccgccgtctccgtgaagcccgtggccatcaagggtctcgccggcagctccatctccggaaggaagctcgccgtcgccaggccgtcggcccgctccatccgcaggccccgcgcagccgccgtggtggccaagtacggcgacaagagcgtctactttgacctcgacgacatcggcaacaccaccggacagtgggacctctacggctctgacgcgccctccccctacaacccgctacagagcaagttcttcgagacgttcgcggctccgttcaccaagagaggtctgctgctcaagttcctgctgctgggcggcggcttcctttctgggctacgtcaacggcgtcggcgttcaccgggaattcctggccgaatcaagaaagggacctccagggaaccgccctcaaaccgggccccgcgccggtaaaagatctaaagactcagccttcctcccatttttgcccgggccccaaataatccttt

SEQ ID NO: 60934 - protein, 144 aa, Zea mays
  misc_feature: Ceres CLONE 1521939
  misc_feature (5)..(143): Pfam Name: PSI_PsaH Pfam Description: Photosystem I reaction centre subunit VI
MASLAAVSVKPVAIKGLAGSSISGRKLAVARPSARSIRRPRAAAVVAKYGDKSVYFDLDDIGNTTGQWDLYGSDAPSPYNPLQSKFFETFAAPFTKRGLLLKFLLLGGGFLSGLRQRRRRSPGIPGRIKKGTSREPPSNRAPRR

SEQ ID NO: 60935 - DNA, 658 bp, Zea mays
  misc_feature: Ceres CLONE 1521945
  misc_feature: Encodes the peptide sequence at SEQ ID NO. 60936
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (545)..(545): n is a, c, t, g, unknown, or other
  misc_feature (552)..(552): n is a, c, t, g, unknown, or other
  misc_feature (561)..(561): n is a, c, t, g, unknown, or other
  misc_feature (562)..(562): n is a, c, t, g, unknown, or other
  misc_feature (600)..(600): n is a, c, t, g, unknown, or other
  misc_feature (603)..(603): n is a, c, t, g, unknown, or other
aagctggagctccccgcggtggcggccgctctagaactagtggatcccccgggctgcaggaattcgtctcacccctagaaaaaatgtgcccatctccctaccgtcgccgtgagttgagagtgagagagaagccctaccgtcgctatggttcttcgccggctatgtggctggttcccatggtgcaaaaacaagtgcctattgggcgcggtgaagcttcgtctcccaccgatttggcaagcattgcctcggggttggagtaatttctcgttgaggtttctcctccgacgtagacccacggtcctccatggaagctccctccattgtcctccaacggcggtcaagagcaggtaccgtcaagatgaggagcatgaaggatgttgcgatatgttcgtgagaggtctaggccatcgtctcccagtcaactatggttgctggatcgttgtcttcgtatgatgtaattatttaactattttgtacagaactccattatatagtaaagatgtgacattcgtttcnnnnnnnnnnnnnnnnnnnnnnaaaaatanaaagagnaaaaaaaannaaaaaaaaaaaaaaaaaggaccgccgtggggcgggtgnggngggggtgcgggtgcgcctcttccgttcccaatgggcggaccccgaaaactgcctg

SEQ ID NO: 60936 - protein, 102 aa, Zea mays
  misc_feature: Ceres CLONE 1521945
MVLRRLCGWFPWCKNKCLLGAVKLRLPPIWQALPRGWSNFSLRFLLRRRPTVLHGSSLHCPPTAVKSRYRQDEEHEGCCDMFVRGLGHRLPVNYGCWIVVFV

SEQ ID NO: 60937 - DNA, 688 bp, Zea mays
  misc_feature: Ceres CLONE 1521947
  misc_feature: Encodes the peptide sequence at SEQ ID NO. 60938
  misc_feature (403)..(403): n is a, c, t, g, unknown, or other
  misc_feature (405)..(405): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (688)..(688): n is a, c, t, g, unknown, or other
aaagctggagctccccgcggtggcggccgctctagaactagtggatcccccgggctgcaggaattcgtctcacccctagaaaaatttttttcgcccgccgcccccagtcccgatccgaagctgtgcctcgtaccatttcgatccaatggcgccgacgtcgaagctgtcgacgggcatcaagcgcgcttcgcggtcgcacgcgtaccatcgccgtgggctgtgggccatcaaggccaagaacggcggcgccttccccaaggccgacaaggccgccgccgccgtggaacccaagttctaccctgccgacgacgtcaagccccgcgttcccagcacccgcaagcctaagcctaccaagctcatgtccccccccccccctggggggggggggggccccccccaaagncncttcatnnnaaagatagtggggtttcctcagcagttcaggccgggcggctccttatctcagggccctttccaaatcaggcagaaccaatcccccctggtgatccacacccaccgcctttgccccctccatccaaagtcgaccttctccccgggggttgaaggccccccaatgttggacgcaacattctcttcccccgggggaagaaacccacaagtgggacaaacaacccgccgcggcggactttttttgggcgacccaaaccggcccgcgtcgctctgttcn

SEQ ID NO: 60938 - protein, 181 aa, Zea mays
  misc_feature: Ceres CLONE 1521947
  misc_feature (1)..(49): Pfam Name: Ribosomal_L6e_N Pfam Description: Ribosomal protein L6, N-terminal domain
  misc_feature (86)..(86): Xaa is any aa, unknown, or other
  misc_feature (87)..(87): Xaa is any aa, unknown, or other
  misc_feature (89)..(89): Xaa is any aa, unknown, or other
  misc_feature (90)..(90): Xaa is any aa, unknown, or other
MAPTSKLSTGIKRASRSHAYHRRGLWAIKAKNGGAFPKADKAAAAVEPKFYPADDVKPRVPSTRKPKPTKLMSPPPPGGGGGPPQXXFXXKIVGFPQQFRPGGSLSQGPFQIRQNQSPLVIHTHRLCPLHPKSTFSPGVEGPPMLDATFSSPGGRNPQVGQTTRRGGLFLGDPNRPASLCS

SEQ ID NO: 60939 - DNA, 656 bp, Zea mays
  misc_feature: Ceres CLONE 1521949
  misc_feature: Translation starting site: 220
  misc_feature (389)..(389): n is a, c, t, g, unknown, or other
aagctggagctccccgcggtggcggccgctctagaactagtggatcccccgggctgcaggaattcgtctcacccctagaaaaagtacagcagcaagcaaagcaagcaagagatagacaagcagctccagtccaaccgagcacaaacaaaacaaccgcagcaagaggagaggagaggaggatcaccggtcgcgaccaaattctcccagagacggtcggaaatgaggagccaagcgctgttcttcctcacgatcgcccttctcaccgtgctcgcgcgatccagcaacaggcaccaccaccaccaccactcccacgttcaaagcagagggcagggacagcatcagggagggaggaggaggagggaggggagctggcgagccggggaaggcgncccgggcggcggcgccggcgcgcgcgtggccgtgctgcgacagctgcggcggctgcaccaggtcggagccgcggcggtgccgatgcctggacgcggcgccccgcgggtgccacccggcctgccgggactgcgtcaagtccagcctcagcgccgacccgccggtgtaccagtgcatggaccgcgtccccgacttctgcctgcgccgctgcaacgcgcccgccgccgccgccgcgcgttgaccacgcggtcgacccggcgactggtttc

SEQ ID NO: 60940 - DNA, 682 bp, Zea mays
  misc_feature: Ceres CLONE 1521951
  misc_feature: Encodes the peptide sequence at SEQ ID NO. 60941
aaagctggagctccccgcggtggcggccgctctagaactagtggatcccccgggctgcaggaattcgtctcacccctagaaaaaagcacatgtgcatctcagcagcactagcagtgacaaactcaaagcttgccttcttgttaacaccctaaaactaaaactagagtcgtcggcggcaacaagcggtacgtacgtagaggatgaagagcaggagcagcactctgttggtgatcctagttctccaggcccttctgctctctgcggctgtggccaaaggacctgcatggccgaagaagcagtgctggtgcggccagtgcaccaactggtcgggcgtgtggacctgctacgacctcctcaccaagtgcgccgccacctgcaagaactgcgtccccgtgtccacgggcaagggagccaccaattacaagctgccgcgacttcctccccgaaaactgcgggtgcaagatccactaaactcatccaattccacccatggccacagcaaccgagagaacccttcttccataggcatgattctccatccgaccgaccaccctagcttttgcttcccggccggcgcctgatcaagccaagactggccgctcggtggtcttttgcagggccttgaatagggtggaacccttttcccccctcgaaagatggcaacaaagaaatcaaaaggtcc

SEQ ID NO: 60941 - protein, 126 aa, Zea mays
  misc_feature: Ceres CLONE 1521951
MKSRSSTLLVILVLQALLLSAAVAKGPAWPKKQCWCGQCTNWSGVWTCYDLLTKCAATCKNCVPVSTGKGATNYKLPRLPPRKLRVQDPLNSSNSTHGHSNRENPSSIGMILHPTDHPSFCFPAGA

SEQ ID NO: 60942 - DNA, 739 bp, Zea mays
  misc_feature: Ceres CLONE 1521953
  misc_feature: Encodes the peptide sequence at SEQ ID NO. 60943
acagctggagctccccgcggtggcggccgctctagaactagtggatcccccgggctgcaggaattcgtctcacccctagaaaaagcataccgaccttccttgcattttctcaataccttgaacaactaagcaagtccaatgtctcatgcccagccccttcgtttacaggcccagtggaaacacgtcgatattcaggataaccaagccaatgctatgaaggaaccaggaaccagtggtgggtatggctccccaatgaaagatgacaagaacaaggatgtggatacaatagcttcgaacttcatgaagcttaagcacagggcttgggccctcccagaagaagcaaacccttgtaccaaacttctttttttaaccccccccccccggggggggggggggggagtaccttttactcctcccttttccttttatatacgcctaaaaggtcccacatccaaatttccccgacgccgcccggcacccccgtacaccctttatttttactccacccccctttggcgccccatgtacggggcctcaaaaacatagctgtttccttcccctccaatattggtccacctccctacccgaaatacgcgactttctaacaactcacgcgtctccgagtccctcctccccttttcgaccccccacgagaccccccacaacaccgccttgcgtccccctatcctatccccccctctctcccctgtcgtttcccaacatttcactcttctccccg

SEQ ID NO: 60943 - protein, 135 aa, Zea mays
  misc_feature: Ceres CLONE 1521953
MSHAQPLRLQAQWKHVDIQDNQANAMKEPGTSGGYGSPMKDDKNKDVDTIASNFMKLKHRAWALPEEANPCTKLLFLTPPPRGGGGGVPFTPPFSFYIRLKGPTSKFPRRRPAPPYTLYFYSTPLWRPMYGASKT

SEQ ID NO: 60944 - DNA, 688 bp, Zea mays
  misc_feature: Ceres CLONE 1521954
  misc_feature: Encodes the peptide sequence at SEQ ID NO. 60945
aaactggagctccccgcggtggcggccgctctagaactagtggatcccccgggctgcaggaattcgtctcacccctagaaaaaactactgcggcttcaggactcgacctcttgcgccgccgccatgaccttcaagcgccgcaacggcggccgcaacaagcatggccgcggtcacgtcaagtacatccgatgctcaaactgcgccaagtgctgccccaaggacaaggcgatcaagaggtttcaggtgaggaatatcgtggaacaggctgccatcagggacgtccaggaagcatgcgtctatgatggctacgtcctcccgaagctgtacgccaaggtgcaccactgcgtctcgtgcgcgatccacgctcacatcgtccgcgtccgatcccgtgagaagcgcagggaccgcaagccgcccggagcgcttcaggcgcaggaaggataggcctgctggtggacaaggaggcccccgccctggtcctggtgctgctgctacagctccagctccagcaatggggggctgctcgcccataggctttagctttttcgagccgtgttaagccttctgcccacctcagttttcggaagtgttcccccaatggggggggttaaacctggctttatttaaagtttactttttttgtccaaaagccccggaaacattttccaaaaaaattttgagctttccg

SEQ ID NO: 60945 - protein, 106 aa, Zea mays
  misc_feature: Ceres CLONE 1521954
  misc_feature (1)..(107): Pfam Name: Ribosomal_S26e Pfam Description: Ribosomal protein S26e
MTFKRRNGGRNKHGRGHVKYIRCSNCAKCCPKDKAIKRFQVRNIVEQAAIRDVQEACVYDGYVLPKLYAKVHHCVSCAIHAHIVRVRSREKRRDRKPPGALQAQEG

SEQ ID NO: 60946 - DNA, 631 bp, Zea mays
  misc_feature: Ceres CLONE 1521956
  misc_feature: Encodes the peptide sequence at SEQ ID NO. 60947
  misc_feature (631)..(631): n is a, c, t, g, unknown, or other
ctagaactagtggatcccccgggctgcaggaattcgtctcacccctagaaaaactctcgcgccgccgcggaacacaacaccgcaccacactacccagcggaatccgcccacccgcacccgcacccggagcagaggagatatgtcgcaggggaagggaggagcggcgaggaaggaggaggtggtcaccagggagtacaccatcaacctccacaagcgcctccacggctgcacattcaagaagaaggcacccaacgccatcaaggagatcaggaagtttgcgcagaaggccatgggcaccacggacattaggatcgatgtgaagctcaacaagcacatctggagcagcgggatcaggagcgtgccgcggagggttcgtgtgaggatcgcccgcaagaggaacgactaggaggatgccaaggaggagctctactcccttgtcaccgtcgcagagatccccgccgagggcttgaaagggctggggactaaggtcgttgacgaaacccattaagctgtcgcggtacctaccatctttagagagttcctaggttggattttggcaccaccaaaaccttttgttattcaccaaagttgtctattttcccgcacaggaactggcctggggccaggtttn

SEQ ID NO: 60947 - protein, 88 aa, Zea mays
  misc_feature: Ceres CLONE 1521956
  misc_feature (10)..(88): Pfam Name: Ribosomal_L31e Pfam Description: Ribosomal protein L31e
MSQGKGGAARKEEVVTREYTINLHKRLHGCTFKKKAPNAIKEIRKFAQKAMGTTDIRIDVKLNKHIWSSGIRSVPRRVRVRIARKRND

SEQ ID NO: 60948 - DNA, 661 bp, Zea mays
  misc_feature: Ceres CLONE 1521958
  misc_feature: Encodes the peptide sequence at SEQ ID NO. 60949
  misc_feature (605)..(605): n is a, c, t, g, unknown, or other
  misc_feature (646)..(646): n is a, c, t, g, unknown, or other
aaagctggagctccccgcggtggcggccgctctagaactagtggatcccccgggctgcaggaattcgtctcacccctagaaaaagttagggccttagggcaaagcatagcaacggcggctgcgcagcaagcagttcagctcagcacctcgccggacgccggctcacccatccggccatcccctgccggccgactctccctggtccccagcgcagcaagcagttcaccggagccggcgcagcaagtagtcagcagtcatcaatgcaaaatcaaccacaaaaggttctagttcaagagagagtgagtttgttccacataaaaatacttgtttggtggatgaggaggaggatgaggttgatcttgatgagttgtatgcaacaacaagcaatgacaagaaggtgtcagagttagatttgtatatgagcgaggacctagtgaaggtcaatgacaatgaagcaacatttgatatcctatcatggtggaaagggcaagtcacaaattttcctattctttctacccttgctcgtgatgtgttgtctatgcaagtgtctactgttgcttcagagtctgcatttagttcgggtggacgcattgttgatgcatccngttcaagactcaaaccagaatttattgaggcattgggttgntgtaaagaatggaaa

SEQ ID NO: 60949 - protein, 81 aa, Zea mays
  misc_feature: Ceres CLONE 1521958
  misc_feature (1)..(81): Pfam Name: hATC Pfam Description: hAT family dimerisation domain
  misc_feature (63)..(63): Xaa is any aa, unknown, or other
  misc_feature (76)..(76): Xaa is any aa, unknown, or other
MSEDLVKVNDNEATFDILSWWKGQVTNFPILSTLARDVLSMQVSTVASESAFSSGGRIVDASXSRLKPEFIEALGXCKEWK

SEQ ID NO: 60950 - DNA, 685 bp, Zea mays
  misc_feature: Ceres CLONE 1521959
  misc_feature: Encodes the peptide sequence at SEQ ID NO. 60951
aaagctggagctccccgcggtggcggccgctctagaactagtggatcccccgggctgcaggaattcgtctcacccctagaaaaatgttctcctgcctccgctccgccgccgcaacaaccatttccttctctagccgccgcctccgatcccctcgccgaggctacagaaccggttcctcctggcgcgaatggcggcggtgaggagcctgcttctgaggcacctccgcttggcggcggccccgtcaacaactcccgtgagacccacggcatccctgcctgaagctctgcgagggcagcatcggatgccttcggaagatgcaaaggtctctttcctgcacaagagcgaggtcactgcacgcatcatgcaagtcgtcaagagcttccggaaatcagtgacccgctctaggtagaaacattgctgtcacactctccctaccgttggctagctggcacaagaggcgtttgatgagatcaaaccgacaatcgaatggaatccatgcaatagcttctctcatagaaacaaatgttgtatctacaccatagacagacctgatttgtctgcatctattagcagggtgacaataatgttctcctttgttaacccagggaggcaaaaatcggcccaataagggccccccaaatccccctaaaaatggcttaaacctgccttggtccggggaggccca

SEQ ID NO: 60951 - protein, 73 aa, Zea mays
  misc_feature: Ceres CLONE 1521959
MAAVRSLLLRHLRLAAAPSTTPVRPTASLPEALRGQHRMPSEDAKVSFLHKSEVTARIMQVVKSFRKSVTRSR

SEQ ID NO: 60952 - DNA, 692 bp, Zea mays
  misc_feature: Ceres CLONE 1521960
  misc_feature: Encodes the peptide sequence at SEQ ID NO. 60953
aaagctggagctccccgcggtggcggccgctctagaactagtggatcccccgggctgcaggaattcgtctcacccctagaaaaacgccagccagcccattaaccctcgttcctgtcgcgcagccacgacctccacttcacatctcccccggcggcggcgcggtcagttgaacaatggcggactccaaggccacctcggcggtcaccctccgcacccgcaagttcatgaccaaccgcctcctggcccgcaagcaattcgtgcttgaggtgatccaccccggccgcgccaacgtctccaaggcggagttgaaggagaggcttgccaaggcgtacgaggtgaatgacccaaacaccatctttgtcttcaagttccgcacccacttcggaggaggaaagtccactggtttcggcctcatctacaacaacctctaggttgccaagaagttcgagccgaaataccgcctcatcacgaatgggcttgcctccaaggttcagaaatccccccagccaaatgaaaaagcgaaaaaccaaggcccaagaaaatcccccggggccaacaaaacccaaaactggcgaaccccaagaaaaaagccaaacgttccgaaaccaattcggaatacctggttcttgggctcttgggggggcttaaccttttaaaggtcacccaattactggtctctgtttcaccccttt

SEQ ID NO: 60953 - protein, 85 aa, Zea mays
  misc_feature: Ceres CLONE 1521960
  misc_feature (28)..(85): Pfam Name: Ribosomal_S24e Pfam Description: Ribosomal protein S24e
MADSKATSAVTLRTRKFMTNRLLARKQFVLEVIHPGRANVSKAELKERLAKAYEVNDPNTIFVFKFRTHFGGGKSTGFGLIYNNL

SEQ ID NO: 60954 - DNA, 663 bp, Zea mays
  misc_feature: Ceres CLONE 1521962
  misc_feature: Encodes the peptide sequence at SEQ ID NO. 60955
aaagctggagctccccgcggtggcggccgctctagaactagtggatcccccgggctgcaggaattcgtctcacccctagaaaaatgaagctctcacattcagctcaacctgaaaacaagccagtgaaggggcttgaatttttttcggaaagcgccatggaacagaaagtagctgactccaaaccaattgcggtgacagtcgacgctgagaagcctgagaaaaccgctgctgtaatgggcaccacagtgcacaggtctatcacgttctcatatcggaaggcaggccttgctttgtgatcaaatcctctccgcttgagatgcacgtggccttcctggttgcttttctttattggcaacaaccttcctggttgctttgtctgatggtcagagaacatggaagaataacctgcaactggagtgacagaatttcttttccccgcagtagacaggtgtgcgttatttggtctgatttgaaactatcttcagtcagctatcaattgatctcctcggatttcgattcattttatgtttcgacttgctgccttgtatactgcaaaggcattggtaagaatacataaaacacgaatgttttttttgtcgaaaaaaaaaaaaaaacaagacgcttcaaggagccaattccgccctatagtgaggcgtattacgc

SEQ ID NO: 60955 - protein, 70 aa, Zea mays
  misc_feature: Ceres CLONE 1521962
MKLSHSAQPENKPVKGLEFFSESAMEQKVADSKPIAVTVDAEKPEKTAAVMGTTVHRSITFSYRKAGLAL

SEQ ID NO: 60956 - DNA, 691 bp, Zea mays
  misc_feature: Ceres CLONE 1521964
  misc_feature: Encodes the peptide sequence at SEQ ID NO. 60957
  misc_feature (691)..(691): n is a, c, t, g, unknown, or other
ccccgcggtggcggccgctctagaactagtggatcccccgggctgcaggaattcgtctcacccctagaaaaaagaaactctcacctccagctcagcctgacacacaagccggcgacggggcttgaatttttttcagaaagcgccatggaacaaaacgtagctgactgcaacccaattgcggtgacagtcaaccctgacaagcctgagaaacccgctgctgtgatgggcatcacagtgaacaggtctatcacgatctcatatcggaaggccggcattgctttgtgatctaatccggaccgtttgaaatggacgtcgcctacctgagcgcgtctctattttcgcaacaacctttcctggttgcgttgttctgaaggccagaaaacgggtaaaaaaaaacctgggactggaagttgactaaatttcctttaccccttttgacgacggaggggggttattgtgcccctcatttggcacctcatcttcagggccccaatccaaatgtttctcccgcgggtttccctccgacccgagggagatacacattcccacctcgatttttcaagtaaaagtttttcccggaaagttcaccctaactaatctgaagggcttttttttgcctccaaagaagaacagcgggaaatcttggcccggccgtagggggacccaaaatctccctcccaaaaaacaaggn

SEQ ID NO: 60957 - protein, 94 aa, Zea mays
  misc_feature: Ceres CLONE 1521964
PRGGGRSRTSGSPGLQEFVSPLEKRNSHLQLSLTHKPATGLEFFSESAMEQNVADCNPIAVTVNPDKPEKPAAVMGITVNRSITISYRKAGIAL

SEQ ID NO: 60958 - DNA, 674 bp, Zea mays
  misc_feature: Ceres CLONE 1521966
  misc_feature: Encodes the peptide sequence at SEQ ID NO. 60959
aagctggagctccccgcggtggcggccgctctagaactagtggatcccccgggctgcaggaattcgtctcacccctagaaaaaacccacagtcctacgagcagtcgcacgcaagtgtcaagagacgaaacggtcgacatggctcgcacgcaatctgccgtagcggtcgccgtggtggccgcggtgctgctgctggcagcggcggcgacgacctcggaggccgccatcacctgcgggcaggtgagctccgccatcgcgccctgcctctcctacgcccgcggcacggggtccggcccctccgcgtcctgctgtagcggcgtcaggaacctcaagagcgccgccagcaccgccgccgacaggcgcgccgcctgcaactgcctcaagagcgccgccaggggcgtcagcggcctcaacccccgcaacgccgccagcatctcctccaagtgcggggtcagcatcccctacaccatcagcacctccaccgactgctccggggtgaactaaaacccataacatgccgcaaccacggccgcccgaattcgatcccaccaaccattcttgccgtcgcctgctggcccggaacattggccgtccgcattgatgattttctttcttccttcccggtggtaggaatgatgggttaaccttgttcactcctacctgttttacccaaaa

SEQ ID NO: 60959 - protein, 121 aa, Zea mays
  misc_feature: Ceres CLONE 1521966
  misc_feature (32)..(117): Pfam Name: Tryp_alpha_amyl Pfam Description: Protease inhibitor/seed storage/LTP family
MARTQSAVAVAVVAAVLLLAAAATTSEAAITCGQVSSAIAPCLSYARGTGSGPSASCCSGVRNLKSAASTAADRRAACNCLKSAARGVSGLNPRNAASISSKCGVSIPYTISTSTDCSGVN

SEQ ID NO: 60960 - DNA, 642 bp, Zea mays
  misc_feature: Ceres CLONE 1521967
  misc_feature: Encodes the peptide sequence at SEQ ID NO. 60961
aagctggagctccccgcggtggcggccgctctagaactagtggatcccccgggctgcaggaattcgtctcacccctagaaaaaggcattctggcctgttcttaattattgccaggacaggagaaacaaacaaagatgaggcctcagctgatactcgtcggcactctggctgttctcgccatcctcgcagctctcggcgaaggctcgtcgtcctggccgtgctgcaacaactgcggtgcttgcaacaggaagcagccgccggagtgccagtgcaatgacgtgtcggtcaacgggtgccatccggagtgcatgaactgcgtcaaggtcggtgcaggaattcgtcccggcatgggccccggccccgtcgtcacctaccgctgtgatgacgttctcacaaacttctgccagaacagctgcccggaggcgtagttgctgggtggtggtgtcttcttctgacgccatgcgacgccaccagtttgcttctctccagcttcgtcgggacagaatagataaataattaatgtcgccggccgctcttgtcggtgcttgctcttgttcgccgtccgagaagaattgttaaataaataaataaattccccaaaaaaaaaaaaaaacgagacgctcgaggtccccattcgcccta

SEQ ID NO: 60961 - protein, 97 aa, Zea mays
  misc_feature: Ceres CLONE 1521967
MRPQLILVGTLAVLAILAALGEGSSSWPCCNNCGACNRKQPPECQCNDVSVNGCHPECMNCVKVGAGIRPGMGPGPVVTYRCDDVLTNFCQNSCPEA

SEQ ID NO: 60962 - DNA, 604 bp, Zea mays
  misc_feature: Ceres CLONE 1521968
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
aaagctggagctccaccgcggtggcggccgctctagaactagtggatcccccgggctgcaggaattcgtctcacccctagaaaaaagcaagccgacagaacgacaggcaggcacgcgagtgcaaccgccagagcgatcagcgatgggctccttcttctcgaccttagtgacgccccctccggccgcggacgacccgaactgcgccgtggtggtcgcacactcctaggccacctacccacgcagcaaaagggccgggcccattaagaacaactaattggggggccttaaaatggggggaatccccacatttcaccccttttttctggggggggggggcctctcccccttttataggggaaagccttttttgaaaaaggggctccccccgtggacaannnnaaaaaccccttttccccaagtttgcgggtttttttcccaaaaaattctcgggcccttttggagggggggggattcctctcaaattttttttttcccccagagtggtaaaacaagaaaacccccccttttttgtgggtttccacaccggggaaaatttttggaagaaaaaaaaaacggggggttttttttagggacaccaccctct

SEQ ID NO: 60963 - DNA, 820 bp, Zea mays
  misc_feature: Ceres CLONE 1521970
  misc_feature: Encodes the peptide sequence at SEQ ID NO. 60964
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (49)..(49): n is a, c, t, g, unknown, or other
cctttctattttccttcctttttttttctttaggnnnnnnnnggtgggntgataaaagctggtactccccgcggtggcggccgctctagaactagtggatcccccgggctgcaggaattcgtctcacccctagaaaaaaagcaaccacttctgctctgcatcccgcctgggcctctgtatttgcttggctgctgctcccttctcccacagaccaactcgatcccgcgccatggatcgcgccgaccccgcgcggggccgccttgccgtgctctcctcccacctccgtggtgcaggggccgaggaggcggcgggtctggagaggtcgcctgtatccgcgccggcgcccgggtcccgcgccggcgcgcttgccgtgccggaagggaagaaccggtaagcggctacaaggttcaaggtttccgaaacaacggcactcgtgggttggcctcccaactttcaagaaaggcaacccgatcattttacccccccgatttgaacccgttcccggtagagtaagctccccatgcactacgcccccctgaaaccccccccgggggttctttacggcttttcccagtaccttcttattccaaggcccccttttcttattttgttccacttcgcatggtgccgccggcctatgcgtcccccgcccagcggaatacagtccttgtggtaccaattgggcaccatcttgtaaacctcttttttcttttttccccgcaacccaaggcaccccttcagtagaactttcaactaatacctctcctcggccttctctcatggttgtccctcacctcgccctccctcatcgatcacctcg

SEQ ID NO: 60964 - protein, 54 aa, Zea mays
  misc_feature: Ceres CLONE 1521970
MDRADPARGRLAVLSSHLRGAGAEEAAGLERSPVSAPAPGSRAGALAVPEGKNR

SEQ ID NO: 60965 - DNA, 663 bp, Zea mays
  misc_feature: Ceres CLONE 1521971
  misc_feature: Encodes the peptide sequence at SEQ ID NO. 60966
aaagctggagctccccgcggtggcggccgctctagaactagtggatcccccgggctgcaggaattcgtctcacccctagaaaaatcctttcggaggaggcggaccaggtaagcagcagcgggaaccctagcaccgccgcatccgcagccatgggtatcgacctcgttgccggtgggaggaacaagaagaccaagcgcacagcgccgaagtccgacgatgtgtatctcaagctccttgtcaagctctaccgtttcttgggcaggaggaccaagagcaacttcaatgctgtcattctcaagaggctcttcatgagcaaaaccaatcgcccaccaatctccatgcgccgccttgtcaagttcatggaaggaaaggagaagaacattgctgtgattgttggcacagtcacagatgacaagaggatccaagaggttccagcaatgaaggttactgccctgaggttcaccgagacggcaagggccaggattgtcaatgctggtggggagtgcctcacatttgaccagcttgctctccgtgctgcacttggcgagaacacagtcctcttgaggggccccaataatgcccgtgaggcggtgacgcacttcagcaaggctcctggagtggcgcacagcatcaccaagccatatgtgcactccagggtaagga

SEQ ID NO: 60966 - protein, 171 aa, Zea mays
  misc_feature: Ceres CLONE 1521971
  misc_feature (12)..(171): Pfam Name: Ribosomal_L18e Pfam Description: Eukaryotic ribosomal protein L18
MGIDLVAGGRNKKTKRTAPKSDDVYLKLLVKLYRFLGRRTKSNFNAVILKRLFMSKTNRPPISMRRLVKFMEGKEKNIAVIVGTVTDDKRIQEVPAMKVTALRFTETARARIVNAGGECLTFDQLALRAALGENTVLLRGPNNAREAVTHFSKAPGVAHSITKPYVHSRVR

SEQ ID NO: 60967 - DNA, 660 bp, Zea mays
  misc_feature: Ceres CLONE 1521976
  misc_feature: Encodes the peptide sequence at SEQ ID NO. 60968
aaagctggagctccccgcggtggcggccgctctagaactagtggatcccccgggctgcaggaattcgtctcacccctagaaaaacaccaattacatcatacgcccgccctgaggtggcagtaaaatcccagtcatactttttcacccattcagtaaaagcaatggcagttacacaaacggctaaggggatcacttccaagcagattctgattggtactattggtgaccaggttttggcacttgataagcgctatcttgatccacgccgttcagtgaacccgacacaacaagaaaaagaggagggcattataccattaacagattctttgcctataatacctcagtcctttgtgacgcactctcaccaagtggaggccctgcgagggatcgtttctattcctgcgaagctggagtccacgactcttgttttcacgtacggcgtcgatctattctacacccagcttgccccgtcaaggacctacgattcccctcacgacgaattcagctacgcgctgcttctaatcacgatcgcagtcctggttgctgccatcatcgtcacatggaatttggtccgagaagaaaggagttgggggacaagtggaggtggagcgaagtctccaagttgtgacgcggaagaataattcgggccccagtcagcta

SEQ ID NO: 60968 - protein, 159 aa, Zea mays
  misc_feature: Ceres CLONE 1521976
  misc_feature (1)..(143): Pfam Name: DUF1620 Pfam Description: Protein of unknown function (DUF1620)
MAVTQTAKGITSKQILIGTIGDQVLALDKRYLDPRRSVNPTQQEKEEGIIPLTDSLPIIPQSFVTHSHQVEALRGIVSIPAKLESTTLVFTYGVDLFYTQLAPSRTYDSPHDEFSYALLLITIAVLVAAIIVTWNLVREERSWGTSGGGAKSPSCDAEE

SEQ ID NO: 60969 - DNA, 681 bp, Zea mays
  misc_feature: Ceres CLONE 1521978
  misc_feature: Encodes the peptide sequence at SEQ ID NO. 60970
aagctggagctccccgcggtggcggccgctctagaactagtggatcccccgggctgcaggaattcgtctcacccctagaaaaacttccactgcaggttcctaacccccacccacctcgcccaaattgcaaccttccccgagtgctccaggtcccgtggccggcccccagatcctctccaatcccaatccaagtatcgaacggatcccataggtggcgctcgagcgagcgagtgcggccggaaccgagcgaagatgggcatctcgagcatgccggcgcccgaggacagcctgctggggttcgtgctgtacaacacggcggcgtcggtggcgatcctggcggggctggtgcgcgccgcgctgctgttcctgggcctggcggcggcggaggacgaggagccgcggcagcaggcggaggccgtgacggtcacggccgtggggcccagcctcgcggaccggttccggagcaggttccggccgtcgcgctacgggcggcgtcggggccgggactgccgcgtgtgcttggtgcggttcgagacggaatcgggggtgcagcggctccccctgcggcacctttttccacgcgcctgcctcgaagacctggatcggactacgaaccacgccacctgccccgttgtggcggctaacggccttcctggccccccggccgttttcctgccccaa

SEQ ID NO: 60970 - protein, 143 aa, Zea mays
  misc_feature: Ceres CLONE 1521978
MGISSMPAPEDSLLGFVLYNTAASVAILAGLVRAALLFLGLAAAEDEEPRQQAEAVTVTAVGPSLADRFRSRFRPSRYGRRRGRDCRVCLVRFETESGVQRLPLRHLFPRACLEDLDRTTNHATCPVVAANGLPGPPAVFLPQ

SEQ ID NO: 60971 - DNA, 702 bp, Zea mays
  misc_feature: Ceres CLONE 1521979
  misc_feature: Encodes the peptide sequence at SEQ ID NO. 60972
  misc_feature (386)..(386): n is a, c, t, g, unknown, or other
  misc_feature (393)..(393): n is a, c, t, g, unknown, or other
  misc_feature (397)..(397): n is a, c, t, g, unknown, or other
  misc_feature (404)..(404): n is a, c, t, g, unknown, or other
  misc_feature (407)..(407): n is a, c, t, g, unknown, or other
  misc_feature (408)..(408): n is a, c, t, g, unknown, or other
  misc_feature (419)..(419): n is a, c, t, g, unknown, or other
aagctggagctccccgcggtggcggccgctctagaactagtggatcccccgggctgcaggaattcgtctcacccctagaaaaagcgcaaacatcgaatcgtctcactcgtgtctgccctgctcatactgcttgccctcgccgtatcgtccacccgcaacgcacaggaggattccatggccaacaacaccgggacgttggtgggcggcatccaggacgtgccggggagcgagaacgaccttcacctccaggagctcgcccgcttcgccgtcgatgagcacaacaagattgccaatgctcttctggggttcgagaagcttgtgaatgccaagacacaagtggttgctggcaccatgtattatctttctccccccccccaggggaaganagggggnaaanctctacnaannttaattatttntataaaccattgaaaaaaataccagggacctgccgggaatgcggaccctgttgaaaagggggctcatccccctaaggatgtctcccttctcccagggggaaacccttaaacctcaaaccaaaaattccagataaagggacccagcctccccctctgcatatttcaaaagactacccaccctattaagggctgggttttggttgtcccctgatctccaggggaaattccccccgggattacatttcccctcccccctttaaataaaaggggtccttataccccc

SEQ ID NO: 60972 - protein, 85 aa, Zea mays
  misc_feature: Ceres CLONE 1521979
  misc_feature (10)..(86): Pfam Name: Cystatin Pfam Description: Cystatin domain
  misc_feature (71)..(71): Xaa is any aa, unknown, or other
  misc_feature (75)..(75): Xaa is any aa, unknown, or other
  misc_feature (77)..(77): Xaa is any aa, unknown, or other
  misc_feature (78)..(78): Xaa is any aa, unknown, or other
  misc_feature (82)..(82): Xaa is any aa, unknown, or other
MANNTGTLVGGIQDVPGSENDLHLQELARFAVDEHNKIANALLGFEKLVNAKTQVVAGTMYYLSPPPQGKXGGKXLXXLIIXINH

SEQ ID NO: 60973 - DNA, 652 bp, Zea mays
  misc_feature: Ceres CLONE 1521981
  misc_feature: Encodes the peptide sequence at SEQ ID NO. 60974
aaagctggagctccccgcggtggcggccgctctagaactagtggatcccccgggctgcaggaattcgtctcacccctagaaaaaagggacaaattgctccgtttcgccgcgtagccgagaggaagcaggcggcggcgagaatccagtagaacgcgagcagacggcggcgatggcatggcgggcgagcctgtctcggagtgtaaaggagatacgcgtcctcttctgccagtcctcccccgctagcgcccccgcccgggagttcgtgaagaagaactatggtgacatcaaggcccgcaacccctccctccccttccttgtccgcgagtgctccggtgtccagccccagctctgggcgcgctacgatatgggtgtggagagatgcgtgaacttggatggtctgacggaagcacagattgataagaagctggaggaacttgcaatggccggggagtctcttaaaaccaaatagttttggaactcgtatcatgtccttgtttaatgttccaaaataatagatactcctaccatattgggtggacaatttgctactctttccattatcctgtagtttgggcgtggttaccaaagccttcccattagcctcaacctaaaatgtgtaaataaattcccaattgcttttaccatgcctatg

SEQ ID NO: 60974 - protein, 99 aa, Zea mays
  misc_feature: Ceres CLONE 1521981
  misc_feature (20)..(93): Pfam Name: L51_S25_CI-B8 Pfam Description: Mitochondrial ribosomal protein L51 / S25 / CI-B8 domain
MAWRASLSRSVKEIRVLFCQSSPASAPAREFVKKNYGDIKARNPSLPFLVRECSGVQPQLWARYDMGVERCVNLDGLTEAQIDKKLEELAMAGESLKTK

SEQ ID NO: 60975 - DNA, 766 bp, Zea mays
  misc_feature: Ceres CLONE 1521984
  misc_feature: Encodes the peptide sequence at SEQ ID NO. 60976
  misc_feature (1)..(1): n is a, c, t, g, unknown, or other
  misc_feature (36)..(36): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (766)..(766): n is a, c, t, g, unknown, or other
ncctttctttttcatctcttttcgtcttttgttccncatgnnnngcgccnnnnttcaaagctgggactcaccgcggtggcggccgctctagaactagtggatcccccgggctgcaggaattcgtctcacccctagaaaaacttggccgctatctgtttgttgtgttagggtttcgtctcgtgtgtagggcgtttggagctcgcaaatcctttcctctctcgcgttatgaggttgggtagccgtcatcatgagccgttcggggcagcctccggatctcacgagagtacatggaccataagcttcagattaagatgaatgccgaccgtgttgttatcggcgcacttcgtgggttcgaccagttcatgattctggtggtggacaactctgtggaggtcaatggaaatgacaaaacacatattggaatggtgggtttcaggggcaaacagcgttgttatgatcgagggcactgccacccgttggcaagtcccccgggaatccttggtcctctaggagcttctgcttcgtgaaaaactggatgttataaaattttcagtggggacccctggttgtttttttgactcaattgcttttttggccccctcaaccataatttttcgggagggtgggaaatgtcttattcccctttttttttttatggggtattgtttttggtaaccttttagcaatttccctcgggggctcctttaaaaattttccatgtgatttttaatgccccatggccttctcctctgtaggattccttttn

SEQ ID NO: 60976 - protein, 79 aa, Zea mays
  misc_feature: Ceres CLONE 1521984
MDHKLQIKMNADRVVIGALRGFDQFMILVVDNSVEVNGNDKTHIGMVGFRGKQRCYDRGHCHPLASPPGILGPLGASAS

SEQ ID NO: 60977 - DNA, 707 bp, Zea mays
  misc_feature: Ceres CLONE 1521986
  misc_feature: Encodes the peptide sequence at SEQ ID NO. 60978
aaagctggagctccccgcggtggcggccgctctagaactagtggatcccccgggctgcaggaattcgtctcacccctagaaaaaaaccgcgaagcactacactacactacaccacacccacccgacgacgatcacacacgcagaagatcgagttcgttcgatcgtgaccgtgacgcaggaagctataagctagccaagacaggaataataatggcggcgtcgacggtggcgagcctctctgtcccggtgacgacgacgaccttcgcggcggcgggcggcggcgacgtgctgatcgtcgtcccgaggagggcgggcgccaagcgcgtcgtctggttccccgcggcggcgcgccgcggcggcgggccggccgctcgccgggcggggggggggggcgggccacgccgccggagatctccgaccaggtgtgcggagagcatcaaggcccgcggaggagaccttgcgcggacgaacataaagggcgacgcccaagaggcccggcggtggtgggaacgagggggaaagaatttcatgcccccggggcaggcccggcccggtagcggcctcaagaggagaccaagcggcaaggagccgcgctttgggaaagggcggggaagggtacaccccgggacccccgggggggggggccggtgtcgttcgagaaagttgtgtgtggtctgtgggagctgttagtgggcgccctccccccc

SEQ ID NO: 60978 - protein, 159 aa, Zea mays
  misc_feature: Ceres CLONE 1521986
MAASTVASLSVPVTTTTFAAAGGGDVLIVVPRRAGAKRVVWFPAAARRGGGPAARRAGGGGGPRRRRSPTRCAESIKARGGDLARTNIKGDAQEARRWWERGGKNFMPPGQARPGSGLKRRPSGKEPRFGKGRGRVHPGTPGGGGRCRSRKLCVVCGSC

SEQ ID NO: 60979 - DNA, 860 bp, Zea mays
  misc_feature: Ceres CLONE 1521992
  misc_feature: Encodes the peptide sequence at SEQ ID NO. 60980
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (47)..(47): n is a, c, t, g, unknown, or other
cacccagcctttataacacatacccccgcgggttccnnnncgccaanacccaaactggagctccccgcggtggcggccgctctagaatagtggatcccccgggctgcaggaattcgtctcacccctagaaaaagcagcccaccatctaccagcgactcagcgagcgagagcagcacacactgcacgcagctagctaggagcagcagcagtggcggcgatggcggcctccatgatctcctcgtcagctctggcggaggcgccttaaggcctgccgctcctcgggccgccgcgcctcctcctttcccggtcgtccgctccgaggcgaagatccccatctattaccccccaccgccatggggggaggcctgaaaattcctacgccaaagcctatcgggagaaagggccaagggggcaagggtgtgttacaacatccgccccccgaactccggggggggaccgcccccactgtatataaaccccggttcaccgagacggccatgactgcgcctcgccccctcttggtggaatacacagcgcccggcggggggaaccccaataggggcctttcctgacaccttggttgtctggaaacatccctaatcacggtaaaccctatcctggcgcgctatgtcccccactctgttagacacccaccccacgaacccaaatggccgcgacaattcgcgcccccactagccccccgctaaccgcccgcggcgcctgaattgggccgcccccctgtgaggcgcccaaacccaaggggacggtcactcacccaacacactgatcgcgccacccgagcggcgaggtgcgttattccgcgcgggccgggtgccccccacgtgttttcccccgcgacg

SEQ ID NO: 60980 - protein, 72 aa, Zea mays
  misc_feature: Ceres CLONE 1521992
MGGGLKIPTPKPIGRKGQGGKGVLQHPPPELRGGTAPTVYKPRFTETAMTAPRPLLVEYTAPGGGNPNRGLS

SEQ ID NO: 60981 - DNA, 638 bp, Zea mays
  misc_feature: Ceres CLONE 1521993
  misc_feature: Encodes the peptide sequence at SEQ ID NO. 60982
  misc_feature (638)..(638): n is a, c, t, g, unknown, or other
ccccgcggtggcggccgctctagaactagtggatcccccgggctgcaggaattcgtctcacccctagaaaaaattcctgtcggcaaggtgaacgcgagagccgaccgtctcagtgtgcgcgcgaagaagagaaggaggaggaggaggaggaagaagtagaagaatgtatccggccaagcccaccgtcgccaccgccagcgagccggtaaccgggatggcggcgccgccggtgaccggcatcccgatcagcagccccggccccgccgtcgcggccagccagtggtcctcgggcctctgcgcctgcttcgacgactgcggcctctgctgcatgacgtgctggtgcccgtgcgtgacgttcgggcggatcgcggaggtcgtggaccgcagcgcgacgtcgtgcgcggacgcgggggccatctacacgctgctggcctgcttcacggggttccagtgccactggatctactcctgcacgtaccgctccaagatgcccccccagctggggctccccgacatcggctgctgagactgctgcgtccaactcctgctgcgaacccgtgcggcgctctgcccagcattacagggagcttcaggggcacgccggcctttgaacccccccccttcggtttggggaactn

SEQ ID NO: 60982 - protein, 120 aa, Zea mays
  misc_feature: Ceres CLONE 1521993
  misc_feature (40)..(121): Pfam Name: PLAC8 Pfam Description: PLAC8 family
MYPAKPTVATASEPVTGMAAPPVTGIPISSPGPAVAASQWSSGLCACFDDCGLCCMTCWCPCVTFGRIAEVVDRSATSCADAGAIYTLLACFTGFQCHWIYSCTYRSKMPPQLGLPDIGC

SEQ ID NO: 60983 - DNA, 662 bp, Zea mays
  misc_feature: Ceres CLONE 1521994
  misc_feature: Encodes the peptide sequence at SEQ ID NO. 60984
atagctggagctccccgcggtggcggccgctctagaactagtggatcccccgggctgcaggaattcgtctcacccctagaaaaagtctcgctccaaaccaaagccatcggaggagcaactggacgaccatggcctcgccgctgctcaagtcacactctcagctcgccgccgccgccgccctgcactccgtgaggagagccgaccgctgccctgcgacactacacctgggcaagttccatgaccacgggctcaggtccggccgttctaagagatccggttcagcgagggtgggcgccttcccgtcgctggacgtggtgccgctgatggtgacgatggtggagcacgtggacatgtcgcgggactacgtcgtgaccaagtccatctggcatctcagcgacgtagccctcaagagcgtctataccttctacgcccatgtcaccgtctggggagtctgcttcttcgcgtccatgaaggatcccttctacgacagcgagacgtacaggagccagggtggcgacggaaccgtgcactggtactacgacaggccagaagaacctggaggcttctgccagggaagagctgctgccggaagaactgctccaaggaaattgaccaaagggttgggggccctcagaaccctggaggaaccgagcaatggagga

SEQ ID NO: 60984 - protein, 178 aa, Zea mays
  misc_feature: Ceres CLONE 1521994
MASPLLKSHSQLAAAAALHSVRRADRCPATLHLGKFHDHGLRSGRSKRSGSARVGAFPSLDVVPLMVTMVEHVDMSRDYVVTKSIWHLSDVALKSVYTFYAHVTVWGVCFFASMKDPFYDSETYRSQGGDGTVHWYYDRPEEPGGFCQGRAAAGRTAPRKLTKGLGALRTLEEPSNGG

SEQ ID NO: 60985 - DNA, 854 bp, Zea mays
  misc_feature: Ceres CLONE 1522001
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
cccccctctgtctttttcctctccannnnnnnnnnngggaccnnnnncaataaatgaactccccgcggtggcggccgctctagaactagtggatcccccgggctgcaggaattcgtctcacccctagaaaaatccactctcagcatcaccagctaagaacaggtcttcgtctcaataatggaaggcaaaacagggcagctcaggtgctgtttcgtcgccatcgtgctcgtcctgggtcttgtccttgagcagtcccagcaggctgaagctagaggcaaatggtgctgcgaaaccgccaccggaaaataccattttaatcgctgcgttgactcgtgttgggtcgacaatattgggttctgtgccagtaatgcccggttgcatcattatggaggacagatgtgcaggttttttttgcccccccccccccccggggggggggggggtgcactaaaatttaattttccaccaatttaccaggcccccctcgttgcacatccaaaaaaaacgtaggggcccctgaacggccccggtcccgcccctactccaatatgccgccacatcttgtggaaaaacttcgcgccctccgttggtccgcctcccctccactttcacccccccctcccatatacacacccccccctttacccaggtgacccccccagtgctcccccccccccctcccccaataactccttccccacacctgcttctctccccccccacatctccccccctatccactattacgcccccttctctactttagcatttgtcccccctgcagccggcggtgtttatcctcttcacgcgcttcatgacctctatccgcgccccttctttatcccgcccccccg

SEQ ID NO: 60986 - DNA, 674 bp, Zea mays
  misc_feature: Ceres CLONE 1522003
  misc_feature: Encodes the peptide sequence at SEQ ID NO. 60987
aaagctggagctccccgcggtggcggccgctctagaactagtggatcccccgggctgcaggaattcgtctcacccctagaaaaagtctgcccacatccgagcgcgaccctggccccggcccgtctcgcctgaccgccgccacgccgacggctgaccagcacgcgggcccagcaccccccgacctcgtcctcaccggctcaccctgaccgccgccgcccaccactcacctcgcctccccaacttctgccagctcgcatcccgccgcaagaaacgcccgtgccgccgctgccctagcccctaggccagcgcccaggtcccctcttcttctcgcccttcgccagcgacgagcccccaataggtctgaaggatgagaaaggggctgcatcctcagatgcaatggatctcatatgtgacgcagagtggtaggctgatcaatatcatgatgaccaaggtgaaccatacaggcaaagtgtaccacatgagggccaagcgacagatggttcaaagcctcggccagatcgcaaagttcaaacgtcgattcaagcaggaaagccgtgaaaaacaaggaccaatagttggggaccgaactatggccccctggaaccttaagtcgggttctgtttgactgccccgttttttccgcctaagggacattaattttttttttaaaatcg

SEQ ID NO: 60987 - protein, 85 aa, Zea mays
  misc_feature: Ceres CLONE 1522003
MRKGLHPQMQWISYVTQSGRLINIMMTKVNHTGKVYHMRAKRQMVQSLGQIAKFKRRFKQESREKQGPIVGDRTMAPWNLKSGSV

SEQ ID NO: 60988 - DNA, 631 bp, Zea mays
  misc_feature: Ceres CLONE 1522004
  misc_feature: Encodes the peptide sequence at SEQ ID NO. 60989
  misc_feature (363)..(363): n is a, c, t, g, unknown, or other
acccgcggtggcggccgctctagaactagtggatcccccgggctgcaggaattcgtctcacccctagaaaaaataccgaccttgcattttctcaataccttgagcacctaagcaagtccaatgtctcatgcccagccccttcgtttacaggcccagtggaaacacgtcgatattcaggataaccaagccaatgctatgaaggaaccaggaaccagtggtgggtatggctccccaatgaaagatgacaagaacaaggatgtggatacaatagcttcgaacttcatcaagcttaagcacagggcttgggcactccagaagagcacaaccatgtaccaaccttccactttaaggtgttgctagttncataagtcaatactatatacttatgcttgtctctatatagtctataggtcctagttcaaataacagatgctgcttgcagccttggatattttgtggagtgaacacattggtgatagcatatggataagaaagtaatgtaattatctggagatgttgtattatgtggcaatattattttgcacatgatgcatggagtactttcatgtatgatacctgaaggctttgcaattgaaaaaaaaaaaaaaaaaccaaaaaaaaaaaaaaaaaa

SEQ ID NO: 60989 - protein, 79 aa, Zea mays
  misc_feature: Ceres CLONE 1522004
MSHAQPLRLQAQWKHVDIQDNQANAMKEPGTSGGYGSPMKDDKNKDVDTIASNFIKLKHRAWALQKSTTMYQPSTLRCC

SEQ ID NO: 60990 - DNA, 569 bp, Zea mays
  misc_feature: Ceres CLONE 1522008
  misc_feature: Encodes the peptide sequence at SEQ ID NO. 60991
  misc_feature (490)..(490): n is a, c, t, g, unknown, or other
ctccccgcggtggcggccgctctagaactagtggatcccccgggctgcaggaattcgtctcacccctagaaaaagccccacctgccctcgtctcgtgccactttctcagtcccctctagccgccgcctaccgctcgcgctctcctcgcgttcgggaaggtcgtttcgccatggtctcggagacggagacgttcgccttccatgcggagatcaaccagctgctctcgctcatcatcaacaccttctactccaatgaggagatcttcctcagggagctcatatccgactcctccgatgccttggacaagatcaggtttgagagtttgacggacaagatcaagctggatgcacatcctgagctgttcatcgacattgtgcccgacaaggcaaagaacacgctgagtatcatcgaccgcggcattggtatgaccggtctgaccttgtagacatcttggtaccattgctcggtcaggcgcgaatgattcatggangcagttgctgctcgtgctgatgtgtcatgattggtcagtttggtgtccgtttctactctgcctacctgatgcagagggg

SEQ ID NO: 60991 - protein, 91 aa, Zea mays
  misc_feature: Ceres CLONE 1522008
MVSETETFAFHAEINQLLSLIINTFYSNEEIFLRELISDSSDALDKIRFESLTDKIKLDAHPELFIDIVPDKAKNTLSIIDRGIGMTGLTL

SEQ ID NO: 60992 - DNA, 617 bp, Zea mays
  misc_feature: Ceres CLONE 1522015
  misc_feature: Encodes the peptide sequence at SEQ ID NO. 60993
  misc_feature (409)..(409): n is a, c, t, g, unknown, or other
  misc_feature (445)..(445): n is a, c, t, g, unknown, or other
ggagctccccgcggtggcggccgctctagaactagtggatcccccgggctgcaggaattcgtctcacccctagaaaaaatttcgactttcgagcgcagaaacgagagggccggagcagccgcagtcccggcgatcccgccgccggtcgccctcatacttcctcgtcactgccttcgtttctctttccaacaatcaagatgagccgtggcggtagcgcgggtggtggtcaaagttctctgggttacctctttggaagcggtgagccccccaaaccagcagtggcaccagctgtaagtgctccacctgctgctgcaggtgctccacctgctgagaaaccacctgctgcaaagcctgatggcaccagtcagattgctgctggggttaccagccaaaccaataactaccacangggcgacggtcagaacaccggaaacttccttacggnacgtcctttcgaccagggtcccagctggttcctggcgggggctctttcccgggggaaccctggtttgggggggaaagtgaggcggctttacaaaagattataacccccccccctggggccccccaaaggttttttttttaaaaaacaagaaaaaaacccttttttttttttt

SEQ ID NO: 60993 - protein, 116 aa, Zea mays
  misc_feature: Ceres CLONE 1522015
  misc_feature (71)..(71): Xaa is any aa, unknown, or other
  misc_feature (83)..(83): Xaa is any aa, unknown, or other
MSRGGSAGGGQSSLGYLFGSGEPPKPAVAPAVSAPPAAAGAPPAEKPPAAKPDGTSQIAAGVTSQTNNYHXGDGQNTGNFLTXRPFDQGPSWFLAGALSRGNPGLGGKVRRLYKRL

SEQ ID NO: 60994 - DNA, 681 bp, Zea mays
  misc_feature: Ceres CLONE 1522016
  misc_feature: Encodes the peptide sequence at SEQ ID NO. 60995
tccccgcggtggcggccgctctagaactagtggatcccccgggctgcaggaattcgtctcacccctagaaaaaagcctccgcccatacacacacagccccatcccgccgccgcaggcgagaaccagcgccaccttaggttagggcggccgccgccggagaagtgcgcggttgccaagatgcagatcttcgtgaagaccctgacggggaagaccatcgcgctggaggtggagtcctcggacaccatcgacaacgtgaaggccaagatccaggacaaggagggcatcccgccggaccagcatggcctcatcttcgccggcaaggatctcgaggatggtggcaccctcgccgactacaacatccagaaggagtcgaggctgcacctggtgctccgcctcaggggaggcgccaagaagcgcaagaacaagacgtacacctagcccaagaagatcaagcacaagcacaagaaggtgaagctcgccgtgctccagttctacaagggtgacgacgccaccggtaaggtcacccgcctccgcaaggagtgctccaacgccgaagtgtgtcccggagggtcttactggcctatccctttccgacgggcactacagcggttaagtgtgggcctcacctacggtctactaccccgaaggcgttaggagggcccccttcgtttccttccggag

SEQ ID NO: 60995 - protein, 86 aa, Zea mays
  misc_feature: Ceres CLONE 1522016
  misc_feature (6)..(74): Pfam Name: ubiquitin Pfam Description: Ubiquitin family
MQIFVKTLTGKTIALEVESSDTIDNVKAKIQDKEGIPPDQHGLIFAGKDLEDGGTLADYNIQKESRLHLVLRLRGGAKKRKNKTYT

SEQ ID NO: 60996 - DNA, 614 bp, Zea mays
  misc_feature: Ceres CLONE 1522019
  misc_feature: Encodes the peptide sequence at SEQ ID NO. 60997
  misc_feature (473)..(473): n is a, c, t, g, unknown, or other
  misc_feature (484)..(484): n is a, c, t, g, unknown, or other
ctccccgcggtggcggccgctctagaactagtggatcccccgggctgcaggaattcgtctcacccctagaaaaacagatagtagtgtttcctcagtggactagtgtgaagctgtgcttagcgtagcgcggaagggaggaaggacaaggcaaggcaactgatggcggcagccgcccgccgcggaggtcggcgagaagcgggccaggctgctgctcgacggtgacagcatggtggcgctcggtcccgaggccgtcgacttcgccgggttctacagcggcggcggtgcgttcggcgatgttgccgtggatgctgccgctgggtcccgcggaggcgggttctcgtttgcgttcggcgtggacgcggggtactgaatgacgagcaggcgccgccattgtcagcagcttggcccgcttatgctgctgtcgagcttcctgccaatgccattgcgctgagcggcggcagccgtcacatggnacatggcaggngatggatgaaatgggatggtaagttctatccctgctactggataaagaaggtgtgtctgatgcctgcttttcgtggatctatatggggcggggagcgacacctgggcgtcgagatctaaaaataggggga

SEQ ID NO: 60997 - protein, 47 aa, Zea mays
  misc_feature: Ceres CLONE 1522019
MVALGPEAVDFAGFYSGGGAFGDVAVDAAAGSRGGGFSFAFGVDAGY

SEQ ID NO: 60998 - DNA, 645 bp, Zea mays
  misc_feature: Ceres CLONE 1522024
  misc_feature: Encodes the peptide sequence at SEQ ID NO. 60999
tccccgcggtggcggccgctctagaactagtggatcccccgggctgcaggaattcgtctcacccctagaaaaatgcactgcctgccaccacagaataatggagcggcagactcgattcgtcctgctcgtcttcgccatcggggctctcctcgccagctccgccgccgcggacttgtcggcggctgctggttccctgcacgcgctgccgctgcggcgcgtggaggacgacgacgcaagcagcttcgtggaggaggcggcgtacccgccgaggagggcgctgtacgggggcgggtccatcagctacgggacgctcaccgcgaacaaggccgtctgctacggctcgtgcgccgctcgtgggcaggcgtatacccgcggctgcctggccatctacgggtgccgaggtggccgttaattaaccagaagcagcgcgtagctagcagtcgatgtcagctcgctcggcctgttaattacatgtctgtttcttgtgctgcatctcgtttttcttctaatccccttctcttgtttcaacaagccaatatcggatccatatatatgttgtcgctcccaggttctgcattgtatttttccacataataaatattggattttctatacacggaactcatgcttttataatgggtcagg

SEQ ID NO: 60999 - protein, 104 aa, Zea mays
  misc_feature: Ceres CLONE 1522024
  misc_feature (42)..(102): Pfam Name: RALF Pfam Description: Rapid ALkalinization Factor (RALF)
MERQTRFVLLVFAIGALLASSAAADLSAAAGSLHALPLRRVEDDDASSFVEEAAYPPRRALYGGGSISYGTLTANKAVCYGSCAARGQAYTRGCLAIYGCRGGR

SEQ ID NO: 61000 - DNA, 658 bp, Zea mays
  misc_feature: Ceres CLONE 1522027
  misc_feature: Translation starting site: 386
  misc_feature: Pfam Name: DUF1639 Pfam Description: Protein of unknown function (DUF1639)
  misc_feature (527)..(527): n is a, c, t, g, unknown, or other
  misc_feature (552)..(552): n is a, c, t, g, unknown, or other
  misc_feature (553)..(553): n is a, c, t, g, unknown, or other
tccccgcggtggcggccgctctagaactagtggatcccccgggctgcaggaattcgtctcacccctagaaaaatttcttctccattcttttcaggaccgtcgaggatcgatcaggcgggcagaagcggtcgtcgccggacaaggcgcacaggtccaccatggacgccgtctaccaccaagagtcaccgttgacgagcaacggtgccgccaccgccggcgagaagctgggcgtggagcggttcgagctgccgctgatctactttcgcttcctcgcggaaggagaaggaggacgatttccttgcgatgaagggcaccaagctgccccagcggcccaagaaaagggccaagaacgtggacaagaccctccaatttgtcttcccggggaatgtggttgtccgatttgacgaggggacggtacgaggtgcgggagaagaaatgcgtgaagaagaagcgaagagggctgaaggggatggagagcatggacagcgactcggagtaataaggtggagcgcgcgcacctctggggngggggggggggggcccagaaaaaanncccccccctccccccggggggggggggggggggggcccctctggggggccaagagggggggggcccgcggcttctcctctgaaccccccgccccccttggaaacc

SEQ ID NO: 61001 - DNA, 574 bp, Zea mays
  misc_feature: Ceres CLONE 1522028
  misc_feature: Encodes the peptide sequence at SEQ ID NO. 61002
  misc_feature (387)..(387): n is a, c, t, g, unknown, or other
  misc_feature (493)..(493): n is a, c, t, g, unknown, or other
tccccgcggtggcggccgctctagaactagtggatcccccgggctgcaggaattcgtctcacccctagaaaaaaggccaccaccacaccacaccacaccacaccaccggcggcggcggcgacccagtcgagaacacgaaggcgatggcgacagcgctgaaccgcgggctccgtctcctcgccgccggcgccgaggcgtccaagccagcttctcgtggattccatgccaccggcgtgaagagaatgggagggcatggccatgatgagccatactacatccatgccaagcacatgtataacttgcacaggatgaagcatcagggtttgaaggtgacactctccgtgctgggagcggttggcatcggtgttggagtccctgtgtatgcantcatattccagcagaagaagactgcctctggctgagatgatgcctctcgctgcctgcatatggagacttattttgagcgacttttttttgaagttaaaagctgggnactcatcctatcctggggtgttgcctgatactggcattttcttaccataagtgggaacctcgttttctggggggttggggt

SEQ ID NO: 61002 - protein, 92 aa, Zea mays; identical to SEQ ID NO: 53148
  misc_feature: Ceres CLONE 1522028
  misc_feature (82)..(82): Xaa is any aa, unknown, or other

SEQ ID NO: 61003 - DNA, 663 bp, Zea mays
  misc_feature: Ceres CLONE 1522029
  misc_feature: Encodes the peptide sequence at SEQ ID NO. 61004
tccccgcggtggcggccgctctagaactagtggatcccccgggctgcaggaattcgtctcacccctagaaaaacctcgaaaccctagcgccggcgcctccacttcgttttcctcactctctcctccagctcagggtccggcggcgaagggaaggcaagatgtacaccgcgaggaagaagatccagaaggagaagggtcttgagccctccgagttcgaggactccgttgcccaggctttctttgatctggagaacgggaaccaggagctcaagagcgacctcaaggacctgtacatcaacaatgctatccagatggatgttaccgggagtaggaaggctgttgtcattcacgtcccataccgcctgcgcaaggccttcaggaagatccatgtcagactcgtcagggagctggagaagaattcagcggcaaggatgtggtaattgttgctacacggaggattgtgaggcccccaagaagggttcagctgttctgcgccctcgcaccaggactctgactgctgttcacgatggcatcttgggaggatgttgtctacccagctgagattgtgggggaagcgtgtcagaatacccgtctggatggttcaaagattatcaaagattttctttggacccaaaggagaggaacacactgaatacaagctgg

SEQ ID NO: 61004 - protein, 93 aa, Zea mays
  misc_feature: Ceres CLONE 1522029
MYTARKKIQKEKGLEPSEFEDSVAQAFFDLENGNQELKSDLKDLYINNAIQMDVTGSRKAVVIHVPYRLRKAFRKIHVRLVRELEKNSAARMW

SEQ ID NO: 61005 - DNA, 678 bp, Zea mays
  misc_feature: Ceres CLONE 1522033
  misc_feature: Encodes the peptide sequence at SEQ ID NO. 61006
  misc_feature (488)..(488): n is a, c, t, g, unknown, or other
  misc_feature (544)..(544): n is a, c, t, g, unknown, or other
  misc_feature (545)..(545): n is a, c, t, g, unknown, or other
  misc_feature (553)..(553): n is a, c, t, g, unknown, or other
  misc_feature (558)..(558): n is a, c, t, g, unknown, or other
  misc_feature (585)..(585): n is a, c, t, g, unknown, or other
ctccccgcggtggcggccgctctagaactagtggatcccccgggctgcaggaattcgtctcacccctagaaaaagcctgccatcatctgccaggagaatggtctggtgccaattgttgagcctgagatccttgttgatggccctcatgacattgatcgctgcgcttacgtcactgagaccgtccttgctgcctgctacaaggcgctcaacgagcaccatgtcctcctggagggtaccctcctgaagcccaacatggtgactccaggctccgactccaagaaggtgactcctgaggtgattgctgagtacaccgtccgtaccctccagaggaccgtccctgctgctgtgcctgctgttgtcttcctctctggtggacagagcgaggaggaggccacccgcaacctcaatgccatgaacaagctcagcacccagaagccgtggtccctgtctttctccttcggccgtgccctccaggcgagcaccctcanggcctgggctggcaaggtggagaaccttggagaaggctagagctgccttccctcgnncagtgcanggccnactctgaagctaccctcggcacctacnaagggtgatgctgcccgccacaccgaaaagctccacgtcaaggatacaagtactgaagtgcttttcctttgggggccggttttggactcctgc

SEQ ID NO: 61006 - protein, 91 aa, Zea mays
  misc_feature: Ceres CLONE 1522033
  misc_feature (1)..(92): Pfam Name: Glycolytic Pfam Description: Fructose-bisphosphate aldolase class-I
  misc_feature: SWISSPROT Homolog: EC 4.1.2.13 Fructose-bisphosphate aldolase
  misc_feature (79)..(79): Xaa is any aa, unknown, or other
MVTPGSDSKKVTPEVIAEYTVRTLQRTVPAAVPAVVFLSGGQSEEEATRNLNAMNKLSTQKPWSLSFSFGRALQASTLXAWAGKVENLGEG

SEQ ID NO: 61007 - DNA, 521 bp, Zea mays
  misc_feature: Ceres CLONE 1522035
  misc_feature: Encodes the peptide sequence at SEQ ID NO. 61008
  misc_feature (118)..(118): n is a, c, t, g, unknown, or other
  misc_feature (182)..(182): n is a, c, t, g, unknown, or other
  misc_feature (189)..(189): n is a, c, t, g, unknown, or other
  misc_feature (193)..(193): n is a, c, t, g, unknown, or other
  misc_feature (195)..(195): n is a, c, t, g, unknown, or other
  misc_feature (196)..(196): n is a, c, t, g, unknown, or other
  misc_feature (236)..(236): n is a, c, t, g, unknown, or other
ggcggccgctctgaatagtggatcccccgggctgcggaattcgtctcacccctagaaaaaagataagcgttccagatcgtactggaccaatctgccaccacactttgatcacacacanggaagttgagatcagaaaaatgcaggctgccgctactgcccgcggggtctcgggcgtgctgccngcaaggncagncnngcgcgagaacagggtggtggcccgtgtcccgccacaggangaccgtccgtgtaacttgcgtcgtcgcgaccgagccggccaaattgactaagctcaagctctcggggttccgatggagccctgcacctgcttgtgggcaaccggaaaggggccttttttcggaagcaaacccccccttggggggggggggaaaaaaaatttgttttggtggaaaagaaaattttttcttaaaaaaaaaaaaaagtgttccccgggaggggggtgaaaaacttttgggggaattttttgggggggcctcaaaaaaaaggggtttccccaggggggg

SEQ ID NO: 61008 - protein, 49 aa, Zea mays
  misc_feature: Ceres CLONE 1522035
  misc_feature (18)..(18): Xaa is any aa, unknown, or other
  misc_feature (19)..(19): Xaa is any aa, unknown, or other
  misc_feature (20)..(20): Xaa is any aa, unknown, or other
  misc_feature (33)..(33): Xaa is any aa, unknown, or other
MQAAATARGVSGVLPARXXXRENRVVARVPPQXDRPCNLRRRDRAGQID

SEQ ID NO: 61009 - DNA, 668 bp, Zea mays
  misc_feature: Ceres CLONE 1522041
  misc_feature: Encodes the peptide sequence at SEQ ID NO. 61010
aggagctccccgcggtggcggccgctctagaactagtggatcccccgggctgcaggaattcgtctcacccctagaaaaattttttcgaccgccgccgcccccagtccccgatccgaagctgtgcctcgtaccatttcgatccaatggcgccgacgtcgaagctgtcgacgggcatcaagcgcgcttcgcggtcgcacgcgtaccatcgccgtgggctgtgggccatcaaggccaagaacggcggcgccttccccaaggccgacaaggccgccgccgccgtgtaacccaagttctacgctgccgacgacgtcaagccccgcgttcccagcacccgcaagcctaagcctaccaagctcaggtcgagcatcacgcctgggacggtgctgatcctcctcgcaaggcgcttcatggggaagagagtggtgtttctcaagcagctcaagtccggcctgctgcttatctctgggcctttcaagctcaatggagtagcgatccgccgcgtgaaccaaaccaatggcattgctacatcatcccaagttgacatctctggtggtgatgtcgcccaatttgaaggacagtacttttgccggggagaagaagccaaaggggacaaaaactgaggggcaaggtttttgaaaaaaaaaaaggggcctcccgagtcccggcct

SEQ ID NO: 61010 - protein, 70 aa, Zea mays
  misc_feature: Ceres CLONE 1522041
MGKRVVFLKQLKSGLLLISGPFKLNGVAIRRVNQTNGIATSSQVDISGGDVAQFEGQYFCRGEEAKGDKN

SEQ ID NO: 61011 - DNA, 658 bp, Zea mays
  misc_feature: Ceres CLONE 1522042
  misc_feature: Encodes the peptide sequence at SEQ ID NO. 61012
  misc_feature (409)..(409): n is a, c, t, g, unknown, or other
  misc_feature (452)..(452): n is a, c, t, g, unknown, or other
tccccgcggtggcggccgctctagaactagtggatcccccgggctgcaggaattcgtctcacccctagaaaaaagcctccgcccatacacacacagccccatcccgccgccgcaggcgagaaccagcgccaccttaggttagggcggccgccgccggagaagtgcgcggttgccaagatgcagatcttcgtgaagaccctgacggggaagaccatcacgctggaggtggagtcctcggacaccatcgacaacgtgaaggccaagatccaggacaaggagggcatcccgccggaccagcagcgcctcatcttcgccggcaagcagctcgaggatggccgcaccctcgccgactacaacatccagaaggagtcgacgctgcacctggtgctccgcctcaggggaggcgccnagaagcgcaagaagaagacgtacaccaagcccaagaagatcangcacaagcccaagaaggtgaagctcgccgtgctccaggtctacaaaggtgacgacgccaccgggcaagtcacccgccttccgcaagagtggcccaacgcccagggcggggccggggggtctcatggggcaccccttcgaccgcccttaagggggtaagggggggcctcccctaagtctaaaaaccgaagggggaggaggccccttt

SEQ ID NO: 61012 - protein, 143 aa, Zea mays
  misc_feature: Ceres CLONE 1522042
  misc_feature (6)..(74): Pfam Name: ubiquitin Pfam Description: Ubiquitin family
  misc_feature: SWISSPROT Homolog: EC 3.1.2.15 Ubiquitin thiolesterase
  misc_feature (78)..(78): Xaa is any aa, unknown, or other
  misc_feature (92)..(92): Xaa is any aa, unknown, or other
MQIFVKTLTGKTITLEVESSDTIDNVKAKIQDKEGIPPDQQRLIFAGKQLEDGRTLADYNIQKESTLHLVLRLRGGAXKRKKKTYTKPKKIXHKPKKVKLAVLQVYKGDDATGQVTRLPQEWPNAQGGAGGSHGAPLRPPLRG

SEQ ID NO: 61013 - DNA, 648 bp, Zea mays
  misc_feature: Ceres CLONE 1522044
  misc_feature: Encodes the peptide sequence at SEQ ID NO. 61014
  misc_feature (622)..(622): n is a, c, t, g, unknown, or other
ggagctccccgcggtggcggccgctctagaactagtggatcccccgggctgcaggaattcgtctcacccctagaaaagtccccgtctcaccgcactgcttaccccctcctctcgtctgcctcgcttagcttagccgccgctgctacgcactctcgccgtccttgttcccgcgtcgctctgctcgcgatggcgtcccgcgttgcagtgctgctcgtggccgtggcggccgtgctgttcgccgcggcgtcggcgcaggagatggacctgggcgtgccgcccgcgccggcgcccgtcacgggcgcggcagcggggaccgcggcatcggccctggccgtggcttgctctgccgtcttctccatcctcgtcgccggtcgcctcgtgcagtaggcgctgccgtcgacgtggttcggggtccggcggagccctgttcgatcgttttcgccttagctagtagtagaagtagcagtcatgggctgtgttgattgtttccctgtctcccacctggtgggcgttgtgaccttgtgctattgcttattctttttgtaccatactgcattgttccacgtataccttgtgttgaggcgtgtgttgtatgaataaagatgatggatctcgttcgtcnaaaaaaaaaaaaacgagacgctcgag

SEQ ID NO: 61014 - protein, 66 aa, Zea mays; identical to SEQ ID NO: 8261
  misc_feature: Ceres CLONE 1522044

SEQ ID NO: 61015 - DNA, 655 bp, Zea mays
  misc_feature: Ceres CLONE 1522047
  misc_feature: Encodes the peptide sequence at SEQ ID NO. 61016
tccccgcggtggcggccgctctagaactagtggatcccccgggctgcaggaattcgtctcacccctagaaaaacgtgcctctgcctggtgatccaactccgcgtcacacacctcacagagctgcaacagcatcagctgccacctccttccttccttcctgcatgtataggttgctacacctatatattctgaagaagagatcgagatgaccagcgtgtggaagaccaaggttctgcctggcctcaacaagatctttgacaaggatggcaagaaggctgcagctgcacgcttcttgaagtccttcaacatggacgagattgactaggacattgaggactagaatacatagctggagcccaaggtcgtggaggcctacgaagcatctcctcctgaggtcaaggctctgttcaaggataagaagccagtcaaggtcagcaagaagaactcggctgcagtcaccaagttcctcgatgagctggctaagattgacttccctggagccaatgtggtgagcgaagcggtggccaagtccggcacctcgcccctgcattctgcgatcaccttcatctaggacaaggtcgcaccgtttatccccaatgacgagcccaagcggagcgggcggcgacgccactccggaaaaatcctccccctggaa

SEQ ID NO: 61016 - protein, 39 aa, Zea mays
  misc_feature: Ceres CLONE 1522047
MTSVWKTKVLPGLNKIFDKDGKKAAAARFLKSFNMDEID

SEQ ID NO: 61017 - DNA, 605 bp, Zea mays
  misc_feature: Ceres CLONE 1522049
  misc_feature: Encodes the peptide sequence at SEQ ID NO. 61018
ctccccgcggtggcggccgctctagaactagtggatcccccgggctgcaggaattcgtctcacccctagaaaaactgccttcccagtctcccatccctgaggacctcaaaaaaccctcgtttgctccccaccaccccgccgcgccgccgcctgtgccagctgcgtcaagatgagtcggcaccctgatgtgaagtgcgctcagaggatcgacaaggtttacatcactgtacagtctactgacgcacacgatgctaaggtctatttggatccagatgctgtcttcacattctctggcagctctggtacaaacttgtatgacttgaaactagatctgactgacaaggtaatcgtttacgctaccaaataaattgggaggtccagtccattatcgggatgggaaaaaaactttaaccccatggggggaaaaaattccttcccaaatgaccaaggggcccccccctttgtggaaaacctccatggggccaacaaggggttgaataaaaaaagaaagaatggggcccgcacacccccccgggggggggggggggggaaattttcccaaaatttttggggggggcccgggggggatttttgccgaaattggg

SEQ ID NO: 61018 - protein, 65 aa, Zea mays
  misc_feature: Ceres CLONE 1522049
MSRHPDVKCAQRIDKVYITVQSTDAHDAKVYLDPDAVFTFSGSSGTNLYDLKLDLTDKVIVYATK

SEQ ID NO: 61019 - DNA, 617 bp, Zea mays
  misc_feature: Ceres CLONE 1522050
  misc_feature: Encodes the peptide sequence at SEQ ID NO. 61020
  misc_feature (217)..(217): n is a, c, t, g, unknown, or other
  misc_feature (263)..(263): n is a, c, t, g, unknown, or other
  misc_feature (277)..(277): n is a, c, t, g, unknown, or other
ccgctctagaactagtggatcccccgggctgcaggaattcgtctcacccctagaaaaaggcccaaatcccccgactcctcgcttcctcccgttccgtcgccgccgcgcgcctcggagaagagatagaggcggccgctgcatcgaccccgcgccacctccgcctgcctcccccggcaccgatcgggtttgatcgatggcgtcgaagaggatcctgaangagttgaaggacctgcagaaggacccgcccacctcctgcagcgcangtcctggtggtgangacatgttccattggcaagcgaccatcatggggccttcggacagcccatttgcaggtggggtattcttggtgaacattcacttcccaccggaatacccctttcagccaaccaaggtggtcttccgcaccaaggttttccacccaacatctacagcaacgggagcatttgccttgacattcctaaaggacagtggagcccctgccttaactatctcaaagggtctcctgtgcaatctcctcactggtccggacccaaacccggaggaccccttgtgcccgagattgggcccctgggacagaacgaacggggcaatatgtaacccccccacgctcctggaaa

SEQ ID NO: 61020 - protein, 141 aa, Zea mays
  misc_feature: Ceres CLONE 1522050
  misc_feature (5)..(134): Pfam Name: UQ_con Pfam Description: Ubiquitin-conjugating enzyme
  misc_feature: SWISSPROT Homolog: EC 6.3.2.19 Ubiquitin--protein ligase
  misc_feature (8)..(8): Xaa is any aa, unknown, or other
  misc_feature (24)..(24): Xaa is any aa, unknown, or other
  misc_feature (28)..(28): Xaa is any aa, unknown, or other
MASKRILXELKDLQKDPPTSCSAXPGGXDMFHWQATIMGPSDSPFAGGVFLVNIHFPPEYPFQPTKVVFRTKVFHPTSTATGAFALTFLKDSGAPALTISKGLLCNLLTGPDPNPEDPLCPRLGPWDRTNGAICNPPTLLE

SEQ ID NO: 61021 - DNA, 629 bp, Zea mays
  misc_feature: Ceres CLONE 1522169
  misc_feature: Encodes the peptide sequence at SEQ ID NO. 61022
caaagctggagctccccgcggtggcggccgctctagaactagtggatcccccgggctgcaggaattcgtctcacccctagaaaaaaggctgcgcctggctgcacgcactgttgtgtagttattaccagcatcggtggtgcgccatccaacaagcatcagagctcggtgtcacaaaacctgaccgatggcggcccggtgctccacagctgcctccgtggtcagaacaggatcgcgagacctctccccctccttttccttcacagccgcggcgctcccctcggcgcgtctgaggccggtaggagcgtgggtccgcggtggagggtacacctgcaggctccgcgccgtctgcgccatgggctccgcgccgtcgtcgtcccaatccccgtcgccgcacacgccttcaggacaaacccaagggaaagcagattataaatcactgagtgaagaggagtggaagaagcgcctgactgaagagcagtattatgttactcggcagaagggcactgaaagagcattcactggggaatactggaatactaaaaccccaggcatttatcagtgtgtctgctgcgacacccctctgtttcagtcatcaaccaaatttgatagtggtactgggtggccatcct

SEQ ID NO: 61022 - protein, 148 aa, Zea mays
  misc_feature: Ceres CLONE 1522169
  misc_feature (87)..(148): Pfam Name: SelR Pfam Description: SelR domain
  misc_feature: SWISSPROT Homolog: EC 1.8.4.12 Peptide-methionine (R)-S-oxide reductase
MAARCSTAASVVRTGSRDLSPSFSFTAAALPSARLRPVGAWVRGGGYTCRLRAVCAMGSAPSSSQSPSPHTPSGQTQGKADYKSLSEEEWKKRLTEEQYYVTRQKGTERAFTGEYWNTKTPGIYQCVCCDTPLFQSSTKFDSGTGWPS

SEQ ID NO: 61023 - DNA, 741 bp, Zea mays
  misc_feature: Ceres CLONE 1522175
  misc_feature: Encodes the peptide sequence at SEQ ID NO. 61024
ggagctccccgcggtggcggccgctctagaactagtggatcccccgggctgcaggaattcgtctcacccctagaaaaagtacttactcactctccccccacccgcgccagggcagacagactaactgagcacccgctgcaaggagtccgcgcccatggcgagcaccaacatggcgtcggccacctcgcggttcatgctggccgcgggcgtgcccaccggcagtagcggtggccgcatcaactacaccacggcgcccaaccggcttggctggaggctcgtggtctgagcctaacacgaggccgccgcacctgaagcgacgtacagtgagggggaccgggcccccaaaatccacgccttataaccccccgcctagggggggggggaggggtcgtctagggcgaacatcctttaggaggggagttctacaagggaaaaaacgagatctggcaaagttccatcaccgtccaaagagtggatctctgccgccctgctaaccccgccgacataatccttccaccatgacagttggcccttaccacccgggctatgccgagtccccacaacaaccaccgttttgagcgtaggtgcctcccaacgacacaaataatgttgtcgtcccggccctagaccccgaaggggggcccccacaacaaaagccgaacacaacgccctgcgttattttgaacaccccctcacccattaacaggggcgccatgtgaaaatccgcaccctccccgcgag

SEQ ID NO: 61024 - protein, 43 aa, Zea mays
  misc_feature: Ceres CLONE 1522175
MASTNMASATSRFMLAAGVPTGSSGGRINYTTAPNRLGWRLVV

SEQ ID NO: 61025 - DNA, 678 bp, Zea mays
  misc_feature: Ceres CLONE 1522178
  misc_feature: Translation starting site: 146
ggagctccccgcggtggcggccgctctagaactagtggatcccccgggctgcaggaattcgtctcacccctagaaaaaactctctctccccatccgcgccagtccaaccaagtcagcacccgcgcgcggcaaggagttcacgcccatggcgagcaccaacatggcgtcggccacctcgcggttcatgctggccgcgggcgtgcccaccgccagtagcggcagcggccgcgtcagcttcgcctcggcgcccaaccggcttggcaggaggcttgtggtccgggccgatgaggagtccccggcagagccggcgccgacggcggaaggggagggcgccgtggccaccaagcccaaggccgataagccgccccccatcgggccggggagaggcgccaaggtgaagatcctgaggcgggagtcctactggtacaacgggatcggcaacgtcttcacccgtcaataagatcctaacaccccgttccccggtggtggtgcggttcaacaaggtgaactacccctgcgtgtctacccacaacttcgcccttgaaccagatcctccagggtgaatggagtaaggccgtcctgcttcaagaacccattgcacctgtttgaattggtaaatttaaaagtaaaggctgcctccctaactgcctacgttaggcgcgccacgtcacaaaaata

SEQ ID NO: 61026 - DNA, 711 bp, Zea mays
  misc_feature: Ceres CLONE 1522179
  misc_feature (6)..(6): n is a, c, t, g, unknown, or other
  misc_feature (7)..(7): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (24)..(24): n is a, c, t, g, unknown, or other
  misc_feature (27)..(27): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (42)..(42): n is a, c, t, g, unknown, or other
  misc_feature (43)..(43): n is a, c, t, g, unknown, or other
  misc_feature (45)..(45): n is a, c, t, g, unknown, or other
  misc_feature (46)..(46): n is a, c, t, g, unknown, or other
tttttnntnnnnttnnnnntttanttntnnnnntnnnntttnncnnacccccccaaactggaactccccgcggtggcggccgctctagaactagtggatcccccgggctgcaggaattcgtctcacccctagaaaaacatctgctgaggtaattgctgatgtggctctctgcccttttgaagctgtgaaggtacgtgtgcagacacaacctggatttgctcgtggattgagtgatgggctccccaaatttgtccgatctgagggtgttcttgggctctacaagggaattgttcctctctggggtcgtcagattccttataccatgatgaagtttgcttcctttgagaccatcgttgagcttatctacaagcatgctgtgcctgttccgaagtctgagtgcatcaagactacccagttgggtattagctttgctggaggttacgttgcccgtgtcttctgtgctattgtttctcacccggctgacaaccattgtgtctttcctgaacaatgcccagggagctacagtgggagatgctgttaagaagcttggtctctggggtctcttcactagaggacttcctcttcgtatcgtcatgattgggacccttactggtgctcagtggggaatttacgatgcattcaaaagggatgggttggactccccacaacggggaggtgttacacctggccccagccgcagagggctgaata

SEQ ID NO: 61027 - DNA, 485 bp, Zea mays
  misc_feature: Ceres CLONE 1522184
  misc_feature (328)..(328): n is a, c, t, g, unknown, or other
  misc_feature (330)..(330): n is a, c, t, g, unknown, or other
  misc_feature (331)..(331): n is a, c, t, g, unknown, or other
atagctggagctccccgcggtggcggccgctctagaactagtggatcccccgggctgcaggaattcgtctcacccctagaaaaaacggcagtcgtcacaccacgaaagcagcagcaaagtcatcagcaacccacgatcggtcgatcgatcgggtacctgctagcgaattcgatcgatcgggtacctgctgctagcgatagcagcagccagccagccagatcccgtcgtcgccggcacgatggcagcccgtcgtcgtcgtcgtcgtcagctctggtcgtctcgtggtggtctagcgcggcgtgcgtgctcgcgaccgcccgtccccccngnnacgggcggagccgccgagaaagaagtaaaacggccgacccctgcaccagggccgggggttaaacccccgggaatggggcccttccaaaatcggagccccttattccgggaattggggggttggaacaagggcccccccccccccccccgggggg

SEQ ID NO: 61028 - DNA, 650 bp, Zea mays
  misc_feature: Ceres CLONE 1522197
  misc_feature: Encodes the peptide sequence at SEQ ID NO. 61029
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (641)..(641): n is a, c, t, g, unknown, or other
ggagctccccgcggtggcggccgctctagaactagtggatcccccgggctgcaggaattcgtctcacccctagaaaaagcatttccatcctgtcgtgggatcccagccaccgccgctagaagaagagctcggcgattcccaggtcccgcgagaatatgccgaagcagatccatgagattaaggacttcctcctcaccgcgaggaggaaggatgcccgctcagtgaagatcaagaggagtaaggatgttgtcaagttcaaggtgcgctgctccaagtacttgtacacgctctgcgtcttcgatgctgagaaggcaaacaagttgaagcaatctcttcccccaggtttgaccgtcgaggaggtctgattggatacatggcaacgccgagttgaactacccaagcttctttatcagtagcagagcatgctactctatgtacttttggaacctaagctattagacctgtcagtgttggatgtctggatcttgcatttttggagaaataccaatttacctcgttcaaggatgcaagtatatttcttgtttaactgcacattactttatatttatgcctgtttcatacctttcctctnnnnnnnnnnnnnnnnnnnnnnnnnnnnnnnnnnnnnnnnnnnnnngganaaaaaaaaa

SEQ ID NO: 61029 - protein, 69 aa, Zea mays; identical to SEQ ID NO: 8575
  misc_feature: Ceres CLONE 1522197
  misc_feature (2)..(69): Pfam Name: Ribosomal_L38e Pfam Description: Ribosomal L38e protein family

SEQ ID NO: 61030 - DNA, 676 bp, Zea mays
  misc_feature: Ceres CLONE 1522207
aagctggagctccccgcggtggcggccgctctagaactagtggatcccccgggctgcaggaattcgtctcacccctagaaaaaagccaagcgaataagacgacttgtttcattgattcttgaagagatcgagcttcttttgcaccacaaggtcaaggatgtcttgcaactgcggatacaagctgcggctgcagctcacgctgcaagtgcggcgagaagtaccctggacctggaggagactagcaccgccgcgcaggtcatcgtcgtcctcggggtggccccggagaacaaggccgcgcccgacttcgtcaaggccgcggcggagtccggcgaggccgcccacggctgcagctgcggtggcgactgcgagtgcgacccctgcaactgctgatcacatcgatcgactaccatggatatgattattatctatctagattgcggtgctggctgaacaatacataaacgagggcgagctggctgccatacatatgtattgcgtggtgcgcgcgagagacatagaaacagagttcttcactttgctatcatctctctgcatgtctggcgtcaggctatgcgctcatgtgcgtacgtgcgactacctgcgtgtaagctgatccgattgcatctgctgaaaccctatgtatgctggacctctatgatgtgacttgatactatgg

SEQ ID NO: 61031 - DNA, 645 bp, Zea mays
  misc_feature: Ceres CLONE 1522210
  misc_feature: Encodes the peptide sequence at SEQ ID NO. 61032
  misc_feature (645)..(645): n is a, c, t, g, unknown, or other
tccccgcggtggcggccgctctagaactagtggatcccccgggctgcaggaattcgtctcacccctagaaaaaagcagtgacgaactcgaagcttgcgttcttgtagtagaggtcggcagcaagcggtagagcgagaggtcgagaagatgaagagcagcactctgttggcgatcctagttctccaggcccttctggtctctgcggccgtggccaaaggacctgcagggccgacgacgaagaagcagtgctggtgcggcgagtgcaccagctggtcgggcgtgtggacctgcgacgacctcctcaccaagtgcgccgccacctgcaagaactgcgtccccgtgtccacggacaagggcaccaccaagtacaggtgccgcgacttcctccccgaaaactgcggctgcaagatccactagactcatccacagcggcacagccgatggatccttccatgctcctccgtccgtccgccttgctataagcaggcaggcagccaccaataagctagctcttgctgttgttttgcatgtttgattgggtgtcccttcccagtcgagatggaataaaataaatgtcaggcgcacgtacagatgtgttattacgatatttctcccctacaaataaaaactcgatttgtggggttn

SEQ ID NO: 61032 - protein, 89 aa, Zea mays; identical to SEQ ID NO: 50292
  misc_feature: Ceres CLONE 1522210

SEQ ID NO: 61033 - DNA, 648 bp, Zea mays
  misc_feature: Ceres CLONE 1522212
  misc_feature: Encodes the peptide sequence at SEQ ID NO. 61034
  misc_feature (583)..(583): n is a, c, t, g, unknown, or other
  misc_feature (648)..(648): n is a, c, t, g, unknown, or other
ggagctccccgcggtggcggccgctctagaactagtggatcccccgggctgcaggaattcgtctcacccctagaaaaaaagatccaagaactcgctcgcgcgcacggacagggccggaacccagggatcgagactgaacagcagtccgagacgccatgaacgtggaggaggaggtcgggaggctcaaggaggagatccataggctcggccagcagcagcccgatggctcttacaaggtcaagtttggcgttctcttcaacgacgatcggtgtgcaaatatctttgaagcactagttggcaccttgagggccgccaagaagaggaagatcttgacctacgaaggcgagctgcttctgcaaggtgtccatgacaacgtggagataaccctgttgcccccacctgcagttgctgccgcttgaagcgaagagcaacaccaagttctcgattccatacaactcgtatgcttgtattctgccgtgcctatattagattctctcgaaccatttggtgttccttgaaaactgctatcgtgtgatgtatgaaattgtggtgctcaagaaattgccttgcttgcaaaataaanataaaaaaataattattttttccttttatccaatacttaaatcaacccatacccatctcaccaan

SEQ ID NO: 61034 - protein, 87 aa, Zea mays; identical to SEQ ID NO: 46334
  misc_feature: Ceres CLONE 1522212

SEQ ID NO: 61035 - DNA, 666 bp, Zea mays
  misc_feature: Ceres CLONE 1522213
  misc_feature: Encodes the peptide sequence at SEQ ID NO. 61036
  misc_feature (666)..(666): n is a, c, t, g, unknown, or other
tggagctccccgcggtggcggccgctctagaactagtggatcccccgggctgcaggaattcgtctcacccctagaaaaaaaaactcagagcttgcaagagctacaacttcagtccagctatctaacaagactctacacataaaaaatcagcactagttccgtttctgaggaagacaatccaaaccaaagatgtctgagtccaggagctctttccgcaacgttaacactgattgcaactggagcaaaaaggagaacaagctgttcgaggaggccctagcccgctatcgcgagggcacacctgaccgctggctcaaggtgtcccgtgccatgggtggcatcaagacagctgatgaagtccgccgtcattatgagacccttaatgaggatgtcacactcattgtatctggcggaattccattccccacctacaacacacagggagcttggaactgaggagtgaaggatgtgaagaaccaccatacatgaactagatatcttagctattgaaggaaatgagctgatatgttattgtattaagaagtttatgattgcttgagtaagaagtacaagaagctagagaatatacataactgtgttatgtgtaaatagctatagactgagcatatcatcagttatgctatagaaaccagggaaccctctgtctgn

SEQ ID NO: 61036 - protein, 87 aa, Zea mays
  misc_feature: Ceres CLONE 1522213
  misc_feature: The sequence is a functional homolog of SEQ ID NO 976 in the 11/435,388 US patent application
MSESRSSFRNVNTDCNWSKKENKLFEEALARYREGTPDRWLKVSRAMGGIKTADEVRRHYETLNEDVTLIVSGGIPFPTYNTQGAWN

SEQ ID NO: 61037 - DNA, 751 bp, Zea mays
  misc_feature: Ceres CLONE 1522214
  misc_feature: Encodes the peptide sequence at SEQ ID NO. 61038
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (436)..(436): n is a, c, t, g, unknown, or other
  misc_feature (439)..(439): n is a, c, t, g, unknown, or other
  misc_feature (751)..(751): n is a, c, t, g, unknown, or other
gttaggtgtggggggaagagtgaggggggccgaccccccnnnnnnnnnnnnnnnccaatagctggactccccgcggtggcggccgctctagaactagtggatcccccgggctgcaagaattcgtctcacccctagaaaaaattccactgcaggtccctaacccccacccacctcgaccaaattgcaaccttccccgagtgctccaggtcccgtggccggcccccagatcctctccaatgccaatccaagtatcgaacggatcccatcggtggcgctcgagcgagcgagtgcggccggaaccgagcgaagatgggcatctcaagcatgccggcgcccgaggacagcctgctggggttcgtgctgtacaacacggcggcgtcagaggcgatcctggcgggcctggtgcgcgccgcgctgctgttcctgggactgtttncanacccacgaccacgagccgcggcagcaggccccacccatgacggtcaccgccgtggggaccaatctcacctacctgttccggaccatgttccggccctcgcgctacgggcggtgccggggctggggactgccgccttgtgccttggtgcggttccatacgggaatccgttggtgcataatcccttccctgggggaccccctcttgacaaccggggccatgcgctcggggaccttgggatgggactgacgaaccagcgccggcacttggtctcggcggggggaccggccgagcggagttacctttgggcgcccn

SEQ ID NO: 61038 - protein, 147 aa, Zea mays
  misc_feature: Ceres CLONE 1522214
  misc_feature (43)..(43): Xaa is any aa, unknown, or other
  misc_feature (44)..(44): Xaa is any aa, unknown, or other
MGISSMPAPEDSLLGFVLYNTAASEAILAGLVRAALLFLGLFXXPRPRAAAAGPTHDGHRRGDQSHLPVPDHVPALALRAVPGLGTAALCLGAVPYGNPLVHNPFPGGPPLDNRGHALGDLGMGLTNQRRHLVSAGGPAERSYLWAP

SEQ ID NO: 61039 - DNA, 541 bp, Zea mays
  misc_feature: Ceres CLONE 1522221
aagctggagctccccgcggtggcggccgctctagaactagtggatcccccgggctgcaggaattcgtctcacccctagaaaaaatattttctagggcggccacgctcatccatggcgatcatggattaactcaacagatgtgttctgaaatacaaacggactatatggcgaatgatcataatctctgacttcttctgggacattgtgcagctttgttataatcttccttcacacactgttctctctggtccaccctgacaacctccagactgggcatggtgctcgtgataagtgtgatcaacgacctggtggtggtgtacgggcccattcgaggtgcagaggtgcaagatcacgtctaagtgcaggtgctcacgggccttagcactcttatgatatccactcatgaccacccttactgccctgctgtggatgctcctgtggctactaagagtgctaccgttccccctgatgacccctgttaacgaaggaaaaccaatgggctcctcctgggcccaaccaacctcctaacatgtgattggcc

SEQ ID NO: 61040 - DNA, 676 bp, Zea mays
  misc_feature: Ceres CLONE 1522222
ctagaactagtggatcccccgggctgcaggaattcgtctcacccctagaaaaatgaacgagcactcgcctgcgctcttctctctctcgtggcgacgactgggtgaccgccggcgccccaggcctgaggcctccatcttcgggcccttcactggctacgagcaccaccagaggattatggattggctggggcagaagcgcgcggagatgctgatgcaggtgctgctggtggcgtctgctgtggcggcgttcctggtgggctacgtggcgcgcggacttccagctcatgctgctcgtctacgccgggggggtcgtgctcacagcggtcgtcaccgtccccaactggcccttcgttcgacgggaacccgctcaaggggctcgacgtctgcgagggtgaggggccacccggggcccccaggtcaacccccggtgcggccaccagggtggaaaaaaaaaagtccggggaagaaaaaaataactaatcttttcggagggaaaatggggtccctttgtgcgatttggcctccgaaccttattttaaggttttattttttctcgaaactcaagccagggggtaacaagaggttttgggggggtctcgaccaaaaaaaaagaaaagaaaaacggatgcctctccgcgggagacccccaattccctcccctgaaagaggggaggcg

SEQ ID NO: 61041 - DNA, 665 bp, Zea mays
  misc_feature: Ceres CLONE 1522234
  misc_feature: Encodes the peptide sequence at SEQ ID NO. 61042
tccccgcggtggcggccgctctagaactagtggatcccccgggctgcaggaattcgtctcacccctagaaaaaacccctgacgctcgacgcctctcctcctctcctcccccacccgtccatcgcccctccctccggtctgcgctcccacagcctcacccctgcgcccccgccgattcgcgtcgccctttgttggaaggaacgatggagcagaccttcatcatgatcaagcccgacggcgtccagcggggcctgatcggggacatcatcagtcgcttcgagaagaaagggttctacctcaaggggatgaagttcatgaacgtggagaggtccttcgcgcagcagcactacgctgacctttccgacaagcctttcttccccgggttggtggagtacatcatttccggccccgtggtggcgatggtgtgggaggggaaggacgtcgtgttgactggccgcaagatcattggggccaccaggccttgggaggcagcccccgggaccattcgtggggactacgccgtggaatgtcgctggaatgtcatccatggaagcgactccgtggataacgggtaagaaggagattcgcctctccgggtttccctgaatgcgttgtcaccacttggaacaactcaacatttccccccctgggatcctaacaatagct

SEQ ID NO: 61042 - protein, 123 aa, Zea mays
  misc_feature: Ceres CLONE 1522234
  misc_feature (2)..(124): Pfam Name: NDK Pfam Description: Nucleoside diphosphate kinase
  misc_feature: SWISSPROT Homolog: EC 2.7.4.6 Nucleoside-diphosphate kinase
MEQTFIMIKPDGVQRGLIGDIISRFEKKGFYLKGMKFMNVERSFAQQHYADLSDKPFFPGLVEYIISGPVVAMVWEGKDVVLTGRKIIGATRPWEAAPGTIRGDYAVECRWNVIHGSDSVDNG

SEQ ID NO: 61043 - DNA, 645 bp, Zea mays
  misc_feature: Ceres CLONE 1522235
  misc_feature: Encodes the peptide sequence at SEQ ID NO. 61044
ccccgcggtggcggccgctctagaactagtggatcccccgggctgcaggaattcgtctcacccctagaaaaaaaacaagcaagctagctggtcaccagttgttaacatatacatcagcaagctccacgaaagcaagaagaagaagaaacatgacgaccactgctgcggtcgtcaagctcctgacagccgtactcctcttcttcgccgtctctcttcggggtaccaagggcgagccatgcggcacgtccagcatccacgtgcagaccgtcaacacgggcgcgacggcggctgccggcgacacgctgttcgaggtccaggtgaaaaacctgtgcttatgcagcgtcaggaacgtgcgcgtggacggtggcggcttcgcgacgacggtggaggtcgacccggccctgttccgcccagtggacggcggtgtctacctagtgaacgccggcgagtccatcgcgagcatgggcatcgtgagcttccgttacgcttgggaccacttcttccagttgactcctaggagcttggaggtcgacggccagggctagtagctactcactccgtttctttttatttatcgctggataatgtaaaatttcaatatccagcgataaataaaaaaacggagggagtactagctaccaaact

SEQ ID NO: 61044 - protein, 131 aa, Zea mays
  misc_feature: Ceres CLONE 1522235
  misc_feature: SWISSPROT Homolog: EC 2.1.1.43 Histone-lysine N-methyltransferase
MTTTAAVVKLLTAVLLFFAVSLRGTKGEPCGTSSIHVQTVNTGATAAAGDTLFEVQVKNLCLCSVRNVRVDGGGFATTVEVDPALFRPVDGGVYLVNAGESIASMGIVSFRYAWDHFFQLTPRSLEVDGQG

SEQ ID NO: 61045 - DNA, 672 bp, Zea mays
  misc_feature: Ceres CLONE 1522244
  misc_feature: Encodes the peptide sequence at SEQ ID NO. 61046
ggcggccgctctagaactagtggatcccccgggctgcaggaattcgtctcacccctagaaaaaacccgtccgcctctctcgaaggcgcagcaccagcgagcatgtcgcctgtcaccgcactcctggcgggcacggtggtgccgccggcctcggccccggccccgtcgccggcgaggcacgcccgccattactccgtcggcttctccccgctccatggcggcgggcgcgcggcgctggcggtggagtgctcgtcgcggccgcagaagaaggggaccaagcaccacatgaagacgcggcccaagaagacgcagccgtgggacatcaagcgccgccccacgcagaacccgccgctgccgccgctcccgccggactggacgctcgtcgcctcccgcgccacagtctacttttattaggcggaagcccctgcacccgccgcgactctcgtcctcgatgtggccgcggccccccaactgtagcctgtctcggcgtgtcgccaaaagttgtgtcacttgaaccctcaacataaagccgtttttttcttttgaagaatttatttttataaaaaacccatggggttgcccccagaattttggtgattttattatactttaggaattcttttttattagcttcgccccccggaagtaatcggagtctcttttgaatataata

SEQ ID NO: 61046 - protein, 103 aa, Zea mays
  misc_feature: Ceres CLONE 1522244
MSPVTALLAGTVVPPASAPAPSPARHARHYSVGFSPLHGGGRAALAVECSSRPQKKGTKHHMKTRPKKTQPWDIKRRPTQNPPLPPLPPDWTLVASRATVYFY

SEQ ID NO: 61047 - DNA, 649 bp, Zea mays
  misc_feature: Ceres CLONE 1522249
  misc_feature: Encodes the peptide sequence at SEQ ID NO. 61048
ggagctccccgcggtggcggccgctctagaactagtggatcccccgggctgcaggaattcgtctcacccctagaaaaactccattcgcggtttgcctctctgccttccctacctcagatcctccctcagattgccatggcggaccagctcaccgacgaccagatcgccgagttcaaggaagcattcagcctcttcgacaaggacggcgacggctgcatcaccaccaaggaacttggaactgtgatgcgctcgttggggcagaaccctactgaggctgagcttcaggacatgatcaacgaggttgatgctgatggcaatggaaccatcgacttccctgagtttctcaacctgatggcacgcaagatgaaggacacagactctgaggaggagctcaaggaggccttccgcgtgttcgacaaggaccagaacggcttcatctctgctgctgaacttcgacatgtcatgaccaacctaggtgagaaactgacggacgaggaagtggatgagatgatccgtgaagccgacgtggacggggatggccagatcaactacgaggagttcgtgaaggtgatgatggcccaatgagatgatgggcctgttttgaaactagttcttcctctggagggtagtaacctagtctaggggttgg

SEQ ID NO: 61048 - protein, 149 aa, Zea mays
  misc_feature: Ceres CLONE 1522249
  misc_feature (121)..(149): Pfam Name: efhand Pfam Description: EF hand
  misc_feature (85)..(113): Pfam Name: efhand Pfam Description: EF hand
  misc_feature (12)..(40): Pfam Name: efhand Pfam Description: EF hand
  misc_feature (48)..(76): Pfam Name: efhand Pfam Description: EF hand
  misc_feature: SWISSPROT Homolog: EC 2.7.11.1 Non-specific serine/threonine protein kinase
MADQLTDDQIAEFKEAFSLFDKDGDGCITTKELGTVMRSLGQNPTEAELQDMINEVDADGNGTIDFPEFLNLMARKMKDTDSEEELKEAFRVFDKDQNGFISAAELRHVMTNLGEKLTDEEVDEMIREADVDGDGQINYEEFVKVMMAQ

SEQ ID NO: 61049 - DNA, 665 bp, Zea mays
  misc_feature: Ceres CLONE 1522256
  misc_feature (665)..(665): n is a, c, t, g, unknown, or other
caaagctggagctccccgcggtggcggccgctctagaactagtggatcccccgggctgcaggaattcgtctcacccctagaaaaaaagcaaaaaaaatgctctgttatcatagcgtgacatctcgagtctcccagtcagacggaactcgtgctcgccagaactcactgtctcgagtctcctcggatgtgacgccatcgctgggaagggagggaaagggctgctcaccgcgaagactaccgcggccaagaccgtcgaaaaggacaacgtcgacgaaggccccattttcacgctcttcccccgccgacctccaattccctcttggacatagcctcctgcagctgacgcgtaggactccggctacatggtcttcgttgcacgccaccggctggctgtcgtactcccaatgcccattcctgggaagtgcctttacctgcccggaagtttcctggaacttggctggacaatgcctagcaagcgatcctaaccgttcaagagttttcgcccccgtcaagaatttttcaaaccttgcccatttcgaggggaataaagaggggaggccgggggcacccccaccccaaagggcccccccctccggaagggggaagggtcgccccttcccccgagaaaaatttcccaatatcccccgggtaagccaaaaaaaacn

SEQ ID NO: 61050 - DNA, 625 bp, Zea mays
  misc_feature: Ceres CLONE 1522262
gctctagaactagtggatcccccgggctgcaggaattcgtctcacccctagaaaaaacgggcgtagagagagagagagagagagagagagagcgaagagggcgtgagagaggagggaggccaagccgtacgcgtcatctcctgctgtttcttcggttcttcccatccctttcctgcctcggcttgcaccttcaaccttgcttgtcaacatctctgattccattttcatctgttgggtggcaagaaactaatcaaggagtcccttctcattccttgcagtggaggactgtttagctgtagctgagcagcatgctttccagaacataaattggtggaagagaagtttgatgctaccactttgcgagaaggaccgaaccagacacaattcgcatgattggttgcccgctcgcgtccatccatgctctccacatgcattgaccgagtgatgaacagtgtttggtttcttgtatacacgagaccagggactgcacccgcagctgcaggataaactagaaatagcacatctagttgcatatctgattgcatgcatagatacgcacaaaaatcccgtttccggcgggccaagcacacatgagccatgctacgctcatccagctatccaatca

SEQ ID NO: 61051 - DNA, 645 bp, Zea mays
  misc_feature: Ceres CLONE 1522263
  misc_feature: Translation starting site: 209
  misc_feature (336)..(336): n is a, c, t, g, unknown, or other
ccgcggtggcggccgctctagaactagtggatcccccgggctgcaggaattcgtctcacccctagaaaaaactcggcacgcaggcagaggcagcacagcagcagccagctccatccatcctctttcccctcctcgcttcgcttcctcggcggattcctcctccctcggccgtccccgtcccctttttcggcgcgcgagctcgcccgagatggcaaacgcgagatcgggtgtcgctgtgaatgacgagtgcatgctcaagttcggcgagctgcagtcgaagaggctgcaccgcttcctaactttcaagatggacgacaagttcaaggagatcgttgntggaccaggttcggggatcgcgctaccagctacgaggacttcacaaacagcctccccgagaatgactgccgatacgcgatctatgatttcgactttgtcactgcagaagatgtccagaagagcaggatcttctatatcctagggtccccatccctccgccaagggtgaaaagcaagatgcctttatgcaagcctcaaaccaaaaaattccagagttggggctctatgggcattccctggtggaacctgcaggcttactggatgccaagtggaaaatccgccccttgattgaagatccaaggggaccggg

SEQ ID NO: 61052 - DNA, 824 bp, Zea mays
  misc_feature: Ceres CLONE 1522266
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (56)..(56): n is a, c, t, g, unknown, or other
  misc_feature (57)..(57): n is a, c, t, g, unknown, or other
  misc_feature (824)..(824): n is a, c, t, g, unknown, or other
nnnnnnnnnnnnnnnnnnnnnnnnnnngggggcgtcactcctcctaaatcgaaatnnaaccataatcggagctccccgcggtggcggccgctctagaactagtggatcccccgggctgcaggaattcgtctcacccctagaaaaaaccttatcccaccctcgctatgcacatccaccactgcccatgctaggctcgctgcggtgccgcgtcatgccgcgcccgcgcaccgccaccagtgtctcatcacacatcaccgagctccgtcgagcgctggagaatggacatcagccacccccatccgaaggcttgcaacgcccgaagctacgccagagaaccacggacatcgacgcctctgactgcgatccattttcgagcttcaaggaatcgacaggcaagcttcggcaacgcaagtgatcgaatttttctagttctaccaagggtgaggacccttgaacatcttgtttggtggaagtgaagccccctggccgcaatcctatagctggggggacaaggaagaaagaccttcgagggtggcatactccccagcggattccccagggactgtttgaatggagtttcccaagggaatttaacgctttaacctacccctcccccccatgtctagcgcttcctttattggcccgcccctgctcccacctgtgcgcgcctaccccttctccctacccctgccgcaccccccacaactctacattgaaccctcaaacgaaaactccccgggcacaagaaaactatccaccaacccccgcatcccggtgactccggccaccgcccgaccgcgagcccgcggcctaaccgccagcan

SEQ ID NO: 61053 - DNA, 643 bp, Zea mays
  misc_feature: Ceres CLONE 1522267
  misc_feature: Encodes the peptide sequence at SEQ ID NO. 61054
catagctggagctccccgcggtggcggccgctctagaactagtggatcccccgggctgcaggaattcgtctcacccctagaaaaagtctagggttcagggataaaagacccgctcctgtcccgcaggcaactgagcgccggcccgcccgcccgcccaccagccgccgccgcaccgccaccgcgcgacctcccttcttcgccgcaaaccgctctgggcgcttgaagatggcggtgccgctgttgactcagaagatcgtgaagaagcgggtcaagcagttcaagaggccccacctcgaccgctacaagtgcctcaagccaagctggcgcaggcccaagggtatcgactcccgtgtcaggcggaaccccacgggatgcacggggagtgcgtacattggatatggctctgacaagaagacaggcactacctccccaccaggttaagaaggttgtcgggcacaatgtttctgagctggagttcctatgatggccaacaggacatactgcgctgaaattcgcccacacgggtcccctaagtaacgccagggaatccgggagccaacctgctccactggactttgggggccccaaaaaccttccccggccccccacccaggaaaatattatacctgttcctagcagtatg

SEQ ID NO: 61054 - protein, 71 aa, Zea mays
  misc_feature: Ceres CLONE 1522267
  misc_feature (14)..(69): Pfam Name: Ribosomal_L32e Pfam Description: Ribosomal protein L32
MAVPLLTQKIVKKRVKQFKRPHLDRYKCLKPSWRRPKGIDSRVRRNPTGCTGSAYIGYGSDKKTGTTSPPG

SEQ ID NO: 61055 - DNA, 755 bp, Zea mays
  misc_feature: Ceres CLONE 1522268
  misc_feature: Encodes the peptide sequence at SEQ ID NO. 61056
  misc_feature (482)..(482): n is a, c, t, g, unknown, or other
tcaccgcggtggcggccgctctagaactagtggatcccccgggctgcaggaattcgtctcacccctagaaaaagcacaaatcctcttcctcgagttctcctcaaccaaattcaaagtcacagcggcgaaactctcggcgatgtctggccgcggcaagggcgggaagggtctgggcaagggcggcgccaagcgccaccgcaaggtgctgcgtgacaacatccagggcatcacctagccgtggatccgctggttggcgaggaggggcggtatcaaacgcatctccgggctcatccacgaagagacccgcggcgtgctcaggatctgcctacgagaacgtcatccgcgacccctgtcccctacactctaagcaccgccccgcccccatccccgaccccgccatgtcaccgctcccccacccccccccaaaaccccacgacccccacccctcttaccgctttctggccgcgttctcttaccccccncctccacaaccgcacgaaattaccacccattagcccgccccccccccctcgtcgctccgagtatccctagccaccaataataatatcatctaccaccacccccccccccaccccccctctttccctgtcggcaccctctcctccccccccacccatgccccacactcgcatcacccccccccctacaataaaaaatacacccacccgcccaccaacctaacagctcctacgtacccccccccctgcacacccccctctcaacccttctccccc

SEQ ID NO: 61056 - protein, 31 aa, Zea mays
  misc_feature: Ceres CLONE 1522268
MSGRGKGGKGLGKGGAKRHRKVLRDNIQGIT

SEQ ID NO: 61057 - DNA, 633 bp, Zea mays
  misc_feature: Ceres CLONE 1522270
atagctggagctccccgcggtggcggccgctctagaactagtggatcccccgggctgcaggaattcgtctcacccctagaaaaaaacccttaggtgcgccgccgcctccgtagatcgtctcttcgtacccgcacgagcaaccgataatccgccggggctgagatgtgggtttatcaagacctcctatctggcgacgagctcctgtcggattcattcacctaaaatgagctctagaacggggtcctgtgggaggtagagggaaagtgggtcaccccacggcctgttgatacagaccttgctgccaatccatccacccagagtagggagaataaaagccctgatgacacaccctcgaaagtgggtgatagtggtgacacattccgtctacaggagcaacctccatttgacaagaaatcatttatctcttacatcaaaaagaacatcaggaatctcaccgccgtgttggaccccgagaaagcgcatcacttctaaaagggtgtcgagggggcaaccaactgtctccttaacaagctgaaagaccttcaaatttttgtctggtgagagcatgaaggacgaagcgtccctggtattcacctactacaaggatagagccactaatccgacattcctcta

SEQ ID NO: 61058 - DNA, 672 bp, Zea mays
  misc_feature: Ceres CLONE 1522272
  misc_feature: Encodes the peptide sequence at SEQ ID NO. 61059
  misc_feature (262)..(262): n is a, c, t, g, unknown, or other
aagctggagctccccgcggtggcggccgctctagaactagtggatcccccgggctgcaggaattcgtctcacccctagaaaaaagccacggagagcaaaggcagcacactcagctatccagcaaaagagatcgagacgcaggagtcatggccaccgtcagcgccgccgtggtgaccaccatcgttgcccgcgccgcgatcgccaggcccaatgctctagggctgcctgcgctgagggcgaggagcgagagggtgcggtgcanctacgccaaggacgcggcccctgtcatcaccaagggcgcaggcgcgtctctgctcgccgcatcgggcgcggtgaccgcgtctgcggggcccgctttttttctcccccccaagggggggggggggagggtacctggtttgaccctcggtttctataaccaccctgctgggggaggatccctccctgggggtctttcgggcttctttggtctcctcttaccccttttaaccccctttgagctcccacaagaaaaaaaagaatccccgggggccccctccccctcacaatccccccccctccccccggtaccgggtttcgcaaagtaacccctgggcgcgcccttttccttccgggcggaaatattttgggcacgggggagggtgggagacttttagaaatcccactctctcg

SEQ ID NO: 61059 - protein, 146 aa, Zea mays
  misc_feature: Ceres CLONE 1522272
  misc_feature (39)..(39): Xaa is any aa, unknown, or other
MATVSAAVVTTIVARAAIARPNALGLPALRARSERVRCXYAKDAAPVITKGAGASLLAASGAVTASAGPAFFLPPKGGGGRVPGLTLGFYNHPAGGGSLPGGLSGFFGLLLPLLTPFELPQEKKESPGAPSPSQSPPLPPVPGFAK

SEQ ID NO: 61060 - DNA, 647 bp, Zea mays
  misc_feature: Ceres CLONE 1522273
  misc_feature: Translation starting site: 122
  misc_feature (37)..(37): n is a, c, t, g, unknown, or other
  misc_feature (51)..(51): n is a, c, t, g, unknown, or other
  misc_feature (70)..(70): n is a, c, t, g, unknown, or other
ctccccgcggtggcggccgctctagaactagtggatnccccgggctgcagngattcgtctcacccctagnaaaagagtgccgccccgcccgcccgcgctatccactcgtctctccgtccccatggccacttatctcaacgcaccgccggcagccaccacgacgactgcaagctgccgccatgccttctccggtggcagcctccgtctactccggccgagccgaccgacgctgcacgtgacgtgccaagccgccgcctcctcccagcagccgtcgtccccgtccaggaaggtcagcctgccctcctccggcatcgcgtggcgccctccccggctcccgcccaagttgcccgccctccggccggcctaaacccgaagaaagaaaccgggccaaaaaaccggctgggggggctgaacccaattttccccctttgccccgtgcccacagaatctctccaacaagggtaaaaacaaacaagcgccggaaacacggggggtccagcggcttccctttccctccaaaaaaaccgggcgccttctcacccttggggaggagaaaaaacgacgtgccccccaccttttaggccgctcgaccactatacctctctaaatcccggggtgggggcccaaaaaatatgtgtttctttctg

SEQ ID NO: 61061 - DNA, 643 bp, Zea mays
  misc_feature: Ceres CLONE 1522274
  misc_feature: Encodes the peptide sequence at SEQ ID NO. 61062
  misc_feature (502)..(502): n is a, c, t, g, unknown, or other
ctggagctccccgcggtggcggccgctctagaactagtggatcccccgggctgcaggaattcgtctcacccctagaaaaaggcggcgcgaggtggcggccatgatggaggagctggacacggaccgcgacggcttcgtggacctgggcgagttcagggcgttccacgcgcgcggcgttggcggcggcggggacgaccacgacgacgcggagctccgcgccgccttcgccgtgtacgacgccgacggcgacgggcgcctcacggcggccgagctgggcagcgtgctcgcccgcatcggcgaggggtgcagcgccgaggagtgccgccggatgatcgccggcgtcgacgccgacggcgactgctgcgtcgggttcgaggagttcaagatcatgatgcgcggcccccagccccagccccagccccaggccggcgccggactgactgccgtgccggacaaggccaataaggagtgacgggtgtaggtgtaggtgtactcatccggnccatcagtcgggggggaaagggatcggggtcctctgcctcttctgttgctttcacctaggctggactggaggaatggaaatactcaacttcctacgcaacacaaaaaataacgagacgctcgaggtacccaattcgcccta

SEQ ID NO: 61062 - protein, 123 aa, Zea mays
  misc_feature: Ceres CLONE 1522274
  misc_feature (37)..(65): Pfam Name: efhand Pfam Description: EF hand
  misc_feature: SWISSPROT Homolog: EC 2.7.11.1 Non-specific serine/threonine protein kinase
MMEELDTDRDGFVDLGEFRAFHARGVGGGGDDHDDAELRAAFAVYDADGDGRLTAAELGSVLARIGEGCSAEECRRMIAGVDADGDCCVGFEEFKIMMRGPQPQPQPQAGAGLTAVPDKANKE

SEQ ID NO: 61063 - DNA, 641 bp, Zea mays
  misc_feature: Ceres CLONE 1522275
  misc_feature: Encodes the peptide sequence at SEQ ID NO. 61064
tccccgcggtggcggccgctctagaactagtggatcccccgggctgcaggaattcgtctcacccctagaaaaacgcaacaatgcgccggcaaccgccgccatcgatcgatcgcccggaaactgacctctaccgatgtctggagccggcgaggaggataagaagcccgcggagggcggcgcccacatcaaccttaaggtcaagggacaggatggcaatgaggtgttctttcgcataaagaggtccacccagctgaggaagctgatgaacgcctattgcgaccgccagtctgtggacatgaatgccattgcattcctgtttgatggccgcaggcttcgcggcgagcagacccctgatgagctggagatggaggacggcgactagatcgacaccttgcttcaccagaccggaggcagcgttcctagcaccacctaaaagcagcaactgcggagcctcgttttgctctccgccctgcgtagtactagacaaaagggaaacagtctttttaaggaacttgagatgctctggctccttgtgccattgctgagggacatccttagactttatttactggtatggttgggtactttgttctgtcgtcactcgattatctatcgctaatacatgccggcatgattgtact

SEQ ID NO: 61064 - protein, 82 aa, Zea mays
  misc_feature: Ceres CLONE 1522275
  misc_feature (21)..(83): Pfam Name: ubiquitin Pfam Description: Ubiquitin family
MSGAGEEDKKPAEGGAHINLKVKGQDGNEVFFRIKRSTQLRKLMNAYCDRQSVDMNAIAFLFDGRRLRGEQTPDELEMEDGD

SEQ ID NO: 61065 - DNA, 668 bp, Zea mays
  misc_feature: Ceres CLONE 1522280
aagctggagctccccgcggtggcggccgctctagaactagtggatcccccgggctgcaggaattcgtctcacccctagaaaaaatcgccctacagacaccacagaccgaaaccctcgccgccgatcggtttcggagaagacaacctcatcaagatgtttctcggctcggtcccgcggtgcccgagcaaggaggctgcttactagctgctgcggtcgtacatcatcgtcgtggactcctgcgccggcggcatccgcgccaccccttacatcctccatttcctcgtccgcgacagcgacgtacatgaagtcaagctagatctgtatcgcccgtccgttagcgtcgccacctccacaggtgctccgaaggcaaccgttagtgcgagccctctgcacggtactatggacttagtggctatagcgcctgcttaagttgatgtgttcttcccagattagtgacgcactgacaatggagaagaaactgacctgtgctgcgacaaggagtgacgtgttgcctatctgtatggtctcatctttgtttgcccgtggtgcatttgctgagatgttgtcggtcatgatttcatccgggcttgccccaaaaagtaaaagaggccgtcgctcaaggcgacgccgacgacccaaagaaacccctcctgctcggcggccctgtt

SEQ ID NO: 61066 - DNA, 657 bp, Zea mays
  misc_feature: Ceres CLONE 1522281
  misc_feature: Encodes the peptide sequence at SEQ ID NO. 61067
  misc_feature (657)..(657): n is a, c, t, g, unknown, or other
ggagctccccgcggtggcggccgctctagaactagtggatcccccgggctgcaggaattcgtctcacccctagaaaaagtcgtcctcttcgtctccagtccaagcaagcgaagagcacccctcgagatctctccctccccgcgccgccatggacgcagttgactcggtagtcgacccgctccgggagttcgccaaggacagcatccgcctcgtcaagcgctgccacaagccggaccgcaaggagttcaccaaggtcgccgcgcggactgcgatcggcttcgtcgtcatgggattcgtcggcttctttgtcaagctcatcttcatccctatcaacaacatcatcgtcggctccggctgatccgttcacctcaggctagtggctgcaggagtggacaatggcgtcactaccttggaggcagcaccgttttcagctctgatttccgcaaagcaattcctttaggacttgtgttgttaaagggcaactcccttatcttttcctctcttgaggtcgtgtggtagatctggaactcttttgtacctggtgccgaatagtcttttgtggatcagcgggtgacaaaattaaatggttactgtcttggggattgctttgtgcgtttgtggtgcggcaccgttcataatttaccttttgacccaaan

SEQ ID NO: 61067 - protein, 69 aa, Zea mays; identical to SEQ ID NO: 51077
  misc_feature: Ceres CLONE 1522281
  misc_feature (10)..(66): Pfam Name: SecE Pfam Description: SecE/Sec61-gamma subunits of protein translocation complex

SEQ ID NO: 61068 - DNA, 642 bp, Zea mays
  misc_feature: Ceres CLONE 1522282
  misc_feature: Translation starting site: 329
ccccgcggtggcggccgctctagaactagtggatcccccgggctgcaggaattcgtctcacccctagaaaaaatctcacggctagctagcacaagcatagtgcaggggcttgccacctaagtaaggacagcctgagagccataggatccaaggtcgtcctcttcttgggtctcaacctcctgttattcacggtaggccaacgcctgcggaaactgcccgaccccaacgcccccggtcgagccaccgccgccgcctcctgctgctaccccacccccttcgtccaacggcaagtgcccactgaacacgctcaagttcggtgtgtgcgccgatgtgctcggcctcatcaaatgcgaggttggcaaatgtgcctgccgagccatgctgtaccctcatcaaaggccttgcagacttcgaggccaccgtctgtctctgcaaagccatctaggccaacgtgctccctcgtcaatcctcgaatgtcccctttgaggatcatggaatttcctcaaaataaatgtaggcaaatggaccccccccaagggggtcaacattttttgggcaaaaaaaccaagtttttccgggggccgggttaaaaaaatgggcccccccctttctttcttttttttttctgagaaaaaaaaaaag

SEQ ID NO: 61069 - DNA, 509 bp, Zea mays
  misc_feature: Ceres CLONE 1522285
  misc_feature (140)..(140): n is a, c, t, g, unknown, or other
caaaagcctggagctccccgcggtggcggccgctctagaactagtggatcccccgggctgcaggaattcgtctcacccctagaaaaaaaccgagacaccgcgtgcgaaccaagcagaccacagcaagaagcgtagtcgtncgccggaaggaaaagggcgcggagcaaagattgtcgtgggcaggcgtacgtcgatgagcactgatgtgcgagatcaaggaaacatctcagcgccgccgccatggtcggtaacaaaagcagggcttttgggccattcccaaaagcttcccaagttaaaccctgaagaaggtgcctgggtccataaaggaattttggataaaaacccggggtacccttttcccaaagggggtctttttccttggggggaaaaaaaaatatgggggttcccaaggggaaccccgggtgttgtccccccccgaaaaaaaaaagggcgcttggggggtttttctttttaaaaaaaaaccccggtgttttgctttttattttttt

SEQ ID NO: 61070 - DNA, 612 bp, Zea mays
  misc_feature: Ceres CLONE 1522289
gctctagaactagtggatcccccgggctgcaggaattcgtctcacccctagaaaaaaagagcctttcgctgcatcaacacctgccgactgctgcaggcaagtaaaggtactcctctcctcccctctgctgcagtcctctgcccgctgcagatcatggaggaggaagcatggcaggagtgtctgcatgggtcctgagagtcgcgtgagcagcgaagcagttcacggatggttggatggagggcaatgaccagctgctgagctgctgctgctcctcctggtcgaccatcagtttgtatttgtccatgcctcgtgtagccggccgtcttcttgccctggctttgtccagttccggaaagcgggccaagcccgggtgaaggcgtggaacagaagaccggccaaggtcaaagattcggccattagtgaagctcccagcagggaagcccaaccttggaacccccctttaatttaaccccccgttttaaaggggttcccccttttttttgggggggtgtttcccccgcgggcgttccctcctggagttttcccccccttggagagggggtcacccccccccgggggtccccccaaaaaaaatcatttaaatcaccgaat

SEQ ID NO: 61071 - DNA, 659 bp, Zea mays
  misc_feature: Ceres CLONE 1522290
  misc_feature: Encodes the peptide sequence at SEQ ID NO. 61072
tggagctccccgcggtggcggccgctctagaactagtggatcccccgggctgcaggaattcgtctcacccctagaaaaaccctagccaccgcatcgtcgccctcaaattcgttccgtccaggcaaggaagaaatcgagcagccaaggagaggagaagatggctcgtacgaagcagaccgcccgcaagtccaccggaggcaaggccccgcgcaagcagctcgccaccaaggcggcgaggaagtctgcgccgacgaccggcggcgtgaagaagccccacaggtacaggcccgggacggtggctctgcgcgagatccgcaagtaccagaagagcacggagctgctgatccggaagttgcccttccagcgcctggtccgtgagatcgctcaggacttcaagacggatctgcggttccagagccacgccgtcctggccctccaggaagccgccgaggcctacctcgtcggcctgttcgaggacaccaacctctgcgccatccacgccaagcgcgtcaccatcatgcccaaagacatccagctcgcccgccgcatccgcggcgagcgcgcgtaggcgtatctcgcgcccggccccagtggcggcggagggatggaggagggcaatttgtaaccttatgctgtttgttcgcttttagacggcgtgg

SEQ ID NO: 61072 - protein, 136 aa, Zea mays; identical to SEQ ID NO: 35188
  misc_feature: Ceres CLONE 1522290
  misc_feature (58)..(132): Pfam Name: Histone Pfam Description: Core histone H2A/H2B/H3/H4

SEQ ID NO: 61073 - DNA, 663 bp, Zea mays
  misc_feature: Ceres CLONE 1522291
  misc_feature: Encodes the peptide sequence at SEQ ID NO. 61074
ggagctccccgcggtggcggccgctctagaactagtggatcccccgggctgcaggaattcgtctcacccctagaaaaactcgagcctgacccttacgccttcgctcgcgccgccgccgccgccgccgctacgccccgcacctcgcttcatttcgtgtcgccaagatgacgaagcgcactaagaaggcaggaattgttggcaaatatggaaccaggtatggtgctagcttgcgtaagcaaatcaagaagatggaggtatctcagcattccaagtacttttgcgagttctgtgggaagtttgctgtgaacaggaaagcagttggaatttggcggtgcaaggactgtgggaaggtgaacgctggtggtgcttacaccatgaacactgctagtgcggtcaccgtcaggagcacgatccgccgcctgagggagcagactgaagcatgatatagctctttatattattggggcttcctgtaattgctcttgtcacgcatgttgtgagggccttatctagtgcagatgtggaatcactgtactggctgttttgccgacacaatgctccgtatatttgggttatgctctacaaaaaaaacaaacaaacgagacgctcgaggcacccattcccccctatgggagtcgtattagccccgctcactggccgacg

SEQ ID NO: 61074 - protein, 92 aa, Zea mays
  misc_feature: Ceres CLONE 1522291
  misc_feature (2)..(91): Pfam Name: Ribosomal_L37ae Pfam Description: Ribosomal L37ae protein family
MTKRTKKAGIVGKYGTRYGASLRKQIKKMEVSQHSKYFCEFCGKFAVNRKAVGIWRCKDCGKVNAGGAYTMNTASAVTVRSTIRRLREQTEA

SEQ ID NO: 61075 - DNA, 669 bp, Zea mays
  misc_feature: Ceres CLONE 1522292
  misc_feature: Encodes the peptide sequence at SEQ ID NO. 61076
tggagctccccgcggtggcggccgctctagaactagtggatcccccgggctgcaggaattcgtctcacccctagaaaaaatcgccaattcctccttcggatctcgcattcatcgcaccgcttgtgtgaacgaagggggactcaaaagacaatggcgctcgcgtacaggaagctcttcatccaggtctacgccaaaaatgagatgcggatcctcatggacgggctctacacagccggtgaaatcacgatcctctacaagctcaagctcggtgagatctatgcgaccatccgcaccatcggtttcaatgtcgaaactgtggagtagaagaacattaccttcactgtctgcgatgtcgggcgtcaggacaatatcacacctcttgtgatgtataacttcgagaacatccagcggcttatctttgatgtggaaagcaatgagcgtgaccgagtagctgaaaccagataggacgtcctcggaatgctgatcgatgatcagctacgtgaggcagtgctgatggttattgcgcactagcgagatcttcgcaatgacgtgcaggctgcgtgagattactgagaagattggtattcactacactgaggcagtgatgctgatacatgcaagacctcttttgcccacaactggaccatggtccagtatccaaaggcctag

SEQ ID NO: 61076 - protein, 57 aa, Zea mays
  misc_feature: Ceres CLONE 1522292
MALAYRKLFIQVYAKNEMRILMDGLYTAGEITILYKLKLGEIYATIRTIGFNVETVE

SEQ ID NO: 61077 - DNA, 766 bp, Zea mays
  misc_feature: Ceres CLONE 1522295
  misc_feature (36)..(36): n is a, c, t, g, unknown, or other
  misc_feature (43)..(43): n is a, c, t, g, unknown, or other
tctccgcggtggcggccgctctagaactagtggatnccccggnctgcacggattcgtctcacccctagaaaaatctcttcttccactgcctccccaccacttcgtcctcgccggctcgcaactccttgatggcggccacggcgagtctcactaccactgctccctcccctccagctctcctcaaagcatcagctcctttgcttatctcctttcgccccgtctcccgccactgcaagaacctgtgcatcgagacccaggccaccgataatgatcagtctcctacaaagcatcagaaggtgaataactttctttgccaggactgccaaatggaaatggggcagtccgtatgccctctattttcacacaaaatggcggggggaggcggtttaaccattttctcaacgccccatttaattgtctggtatctttcctgttttggtttttctcagaaggccaccgcctcgcaactccccattctcctggatcctgtcaccttccattcttttccttcctttctccttccgcattttataaaaccactattactgataaaatactgaaacaagataaaccacaactgctttcatcgcctcttgccatttaaatacccttccccatcccccccacacccccctcccaatttacctacacacacccttcgacccccccacgacccccccctcctcccctctctctcctcactcccctccccccaccccctccccactccctcaccccaacaattctcccattttctctttagtta

SEQ ID NO: 61078 - DNA, 661 bp, Zea mays
  misc_feature: Ceres CLONE 1522302
  misc_feature: Encodes the peptide sequence at SEQ ID NO. 61079
  misc_feature (100)..(100): n is a, c, t, g, unknown, or other
  misc_feature (181)..(181): n is a, c, t, g, unknown, or other
atagctggagctccccgcggtggcggccgctctagaactagtggatcccccgggctgcaggaattcgtctcacccctagaaaaaacagagtcatctcggngtgttcaattactaaatcttcttgtaggaaccaatgtatgggtccaactaagcggcgatgtctgggggcggctagggcggnaatgcgctgggcaaggttgatgagaaacgccaccgtatagttctccgcgacaacatggagggaatcacgaagccggcaatcctaaggctggcgaggatgggcggcgcgaaccgtatctccgggcttatatacgaagagacccgcggcctactcaaaatcttcctcgagaatgtcatccgcgacgcggtcacctacaccgagcacgctcgccgcaagaccgtcaccgccatggatgttgtatacgccctcaaccgccaagaacgcactctgtacaggttctggtggtctgaacccctcctcatccccctcaaggacttgataaaatattttctcccccccgccccggctaattcaattgagatttcccacataaaaaaccctactatatactctcaccccctcgggacaaacaccttcctcgctgtgcttggttgccactcagtatggtgtgcctggggatcaccccacaccacaaaaatt

SEQ ID NO: 61079 - protein, 142 aa, Zea mays
  misc_feature: Ceres CLONE 1522302
  misc_feature (3)..(68): Pfam Name: Histone Pfam Description: Core histone H2A/H2B/H3/H4
MEGITKPAILRLARMGGANRISGLIYEETRGLLKIFLENVIRDAVTYTEHARRKTVTAMDVVYALNRQERTLYRFWWSEPLLIPLKDLIKYFLPPAPANSIEISHIKNPTIYSHPLGTNTFLAVLGCHSVWCAWGSPHTTKI

SEQ ID NO: 61080 - DNA, 649 bp, Zea mays
  misc_feature: Ceres CLONE 1522307
  misc_feature: Encodes the peptide sequence at SEQ ID NO. 61081
ggagctccccgcggtggcggccgctctagaactagtggatcccccgggctgcaggaattcgtctcacccctagaaaaaatcgacaccgactggcgcacgggagccacggagagcaaaggcaggacactcagctatccagcaaaagagatcgagacgcaggagtcatggccaccgtcagcgccgccgtggtgaccaccatcgttgcccgcgccgcgatcgccaggctccaatgctctaaggctgcctgcgctgacggcgaggagcgagagggtgcggtgcagctactccaaggacgcggccccagtcagcaccgagggcgcaggcgcgtcactgctcgccgcagcgggcgcggtgaccgcgtcggcggggcccgcgctggcgctcgtggacgatcgcatgtccacggagggcaccgggctgagcctcgggctcagcaacaacctgctggggtggatcctcctgggggtcttcggtctcatctggaccctctacaccgtctacacctctgacctcgacaaggacgatgagtccggtggcctctcgctctacatccaccctctcctgttaatgatctgaatgtatacctggtggcagtcattggtgtaaatttagacatgggtatctgcatctaatatccatcatgtccagg

SEQ ID NO: 61081 - protein, 59 aa, Zea mays
  misc_feature: Ceres CLONE 1522307
MSTEGTGLSLGLSNNLLGWILLGVFGLIWTLYTVYTSDLDKDDESGGLSLYIHPLLLMI

SEQ ID NO: 61082 - DNA, 674 bp, Zea mays
  misc_feature: Ceres CLONE 1522311
  misc_feature: Encodes the peptide sequence at SEQ ID NO. 61083
aagctggagctccccgcggtggcggccgctctagaactagtggatcccccgggctgcaggaattcgtctcacccctagaaaaaaagcaaataagacgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacggctgcagctgcggtggcaactgcaagtgcgacccctgcaactgctgatcacatcgatcgacaaccatggatatgattattatctatctagcttgtggtggtggttgaacaataataagcgaggccgagctggctgccatacataggtattgtgtggtgtgtgtgagagagagagaaacagagttcttcagtttgctatctctctctgcatgtttggcgtcagtctttgtgctcctgtacctacgtgtggcctacctgcatggggggttgatccaattggctccgcctgaaccatatattaattgggtccacgatgatatgaatttgaaaccataaat

SEQ ID NO: 61083 - protein, 76 aa, Zea mays; identical to SEQ ID NO: 8464
  misc_feature: Ceres CLONE 1522311
  misc_feature (1)..(76): Pfam Name: Metallothio_2 Pfam Description: Metallothionein

SEQ ID NO: 61084 - DNA, 629 bp, Zea mays
  misc_feature: Ceres CLONE 1522314
  misc_feature: Encodes the peptide sequence at SEQ ID NO. 61085
tccccgcggtggcggccgctctagaactagtggatcccccgggctgcaggaattcgtctcacccctagaaaaaccggtctcttgctcagatagtttgatccaggacgtacgtacgtacgtatatcgatccatcgatcgatagctagctgacgaccatggagacactctcctctgccgccatcaccgccccttccttcacggccgcgcccgctcgcgcagtggtcagaacgaggtccattcaccgtgcgtgcctctctccgcaaggccactgcgcaccgccgccgtggccggtgccgccagcgtcctgcttgccagcagaagggccatggccaaagaagcgctgctggccgcatgcgacagagggctcgtcttagagcccagccagttcaccgacaaggccggcgacaccatcacgttcaataacaacgccagattaccgcacaacatcatgttcgacgaagacaagatgccgagcggcgtcgacgcctccaacatctcggacgaggagtacctcaacgcgccaagagagacctactccgtcaccctcaccgtgccgggcacctacagcttctactgcgatcctcaccaaggaacaggaatggtcggcaagatcacagtcaactaaggct

SEQ ID NO: 61085 - protein, 99 aa, Zea mays
  misc_feature: Ceres CLONE 1522314
  misc_feature (3)..(99): Pfam Name: Copper-bind Pfam Description: Copper binding proteins, plastocyanin/azurin family
MAKEALLAACDRGLVLEPSQFTDKAGDTITFNNNARLPHNIMFDEDKMPSGVDASNISDEEYLNAPRETYSVTLTVPGTYSFYCDPHQGTGMVGKITVN

SEQ ID NO: 61086 - DNA, 633 bp, Zea mays
  misc_feature: Ceres CLONE 1522319
  misc_feature: Encodes the peptide sequence at SEQ ID NO. 61087
  misc_feature (593)..(593): n is a, c, t, g, unknown, or other
ggagctccccgcggtggcggccgctctagaactagtggatcccccgggctgcaggaattcgtctcacccctagaaaaaggttcccctcctgtctccgtcttctcaccaccgctgcctccgcggtttcgcttccccccgtcttcccaagcctttgcttcgctcttcgcttcggattccctctgctcatggccgggagagggaaggcgatcggctcacgggccgccaagaatgccatgtccaggagctccaaggccgggctccagttcccagtgggaaggatcgccaggttcctcaaggccggcaagtacgccgagagggtcggcgccggcgcccccgtctacctcgctgccgagctcgagtatcttgctgctgaagttctcgagcttgccgggaacgcggctcgggacaacaagaagacctgcatcgtcccgcgccacatccagctcgccgtccgcaacgacgaggagctctcccgcttgctgggcacggtgaccatcgccagcggtggtgtcatgcccaacatccataacctgctgttgtccaagaagtctggcggcggcactgccaaggctgcggctggtgatgaggactanaccgaccacgcctagccttttctccggtggtggcacctct

SEQ ID NO: 61087 - protein, 140 aa, Zea mays
  misc_feature: Ceres CLONE 1522319
  misc_feature (19)..(92): Pfam Name: Histone Pfam Description: Core histone H2A/H2B/H3/H4
  misc_feature (136)..(136): Xaa is any aa, unknown, or other
MAGRGKAIGSRAAKNAMSRSSKAGLQFPVGRIARFLKAGKYAERVGAGAPVYLAAELEYLAAEVLELAGNAARDNKKTCIVPRHIQLAVRNDEELSRLLGTVTIASGGVMPNIHNLLLSKKSGGGTAKAAAGDEDXTDHA

SEQ ID NO: 61088 - DNA, 655 bp, Zea mays
  misc_feature: Ceres CLONE 1522322
  misc_feature: Encodes the peptide sequence at SEQ ID NO. 61089
aaagctggagctccccgcggtggcggccgctctagaactagtggatcccccgggctgcaggaattcgtctcacccctagaaaaagctttcttagaggtgggttggcttctcctccccctccggttcgggttcgggttcgtgaggttctccggggttcgggttcgtgggtgaggggatcgagatggctgcgtcagatgttgagtaccgctgcttcgtcggcggcctcgcctgggccacggatgaccactccctccacaacgccttcagcacctacggcgaggtcctcgagtccaagatcatcctcgatcgggagacgcagaggtcccgcggcttcggcttcgtcaccttctccacggaggaggcgatgcgtaacgccatcgagggcatgaacggcaaggagctggacggccacaacatcaccgtcaacgaggcccagtcccgcggcggccgtggaggctgcggcagtgggtacggtggtggccgtggaggcgtcggctacagcggtggcgggcgccgtgatggcggtggcggctacggcggtggccgcggctacggtggcagctgcggctacagtggtggtggctgcggctacagcggaggcaaccgtggccgtggctactgccactcccacgggaactggaggaactgagcggtg

SEQ ID NO: 61089 - protein, 155 aa, Zea mays
  misc_feature: Ceres CLONE 1522322
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAASDVEYRCFVGGLAWATDDHSLHNAFSTYGEVLESKIILDRETQRSRGFGFVTFSTEEAMRNAIEGMNGKELDGHNITVNEAQSRGGRGGCGSGYGGGRGGVGYSGGGRRDGGGGYGGGRGYGGSCGYSGGGCGYSGGNRGRGYCHSHGNWRN

SEQ ID NO: 61090 - DNA, 646 bp, Zea mays
  misc_feature: Ceres CLONE 1522323
  misc_feature: Encodes the peptide sequence at SEQ ID NO. 61091
  misc_feature (520)..(520): n is a, c, t, g, unknown, or other
aaagctggagctccccgcggtggcggccgctctagaactagtggatcccccgggctgcaggaattcgtctcacccctagaaaaactccaaaccctagtctcagagcagccgcatccacaacctgcctctctcgtcccctggcggcgtccgcggcaggatggcggaatctacggcgaggacggtgaacgatgtcaacccgcacgagttcgtcaaggcctactccgcccacctcaagcgctccggcaagatggagctccctgagtgggttgacattgtgaagactgcgaggttcaaggagcttcctccttatgatcctgactggcactacatcagggctgcatccattgcaaggcagatctacctaaggcaaggcatcggtgtgggtggctttcagaagatctacggtggccgccagaggaatggctcccgcccaccacacttctgcaagagcagtggcgctgttgcacgcaacatcctgcagcagctgcagattatgggcatcatcgatgtcgatccctanggtggacgcctcatcatcaaccagggaaagcgtgatctgggacatttgcctggaaggtcgctgttgaacgggacccgggtcctctttgttccacggtgtcatgttaaagatgaaaaagctgccccc

SEQ ID NO: 61091 - protein, 163 aa, Zea mays
  misc_feature: Ceres CLONE 1522323
  misc_feature (7)..(146): Pfam Name: Ribosomal_S19e Pfam Description: Ribosomal protein S19e
  misc_feature (121)..(121): Xaa is any aa, unknown, or other
MAESTARTVNDVNPHEFVKAYSAHLKRSGKMELPEWVDIVKTARFKELPPYDPDWHYIRAASIARQIYLRQGIGVGGFQKIYGGRQRNGSRPPHFCKSSGAVARNILQQLQIMGIIDVDPXGGRLIINQGKRDLGHLPGRSLLNGTRVLFVPRCHVKDEKAAP

SEQ ID NO: 61092 - DNA, 810 bp, Zea mays
  misc_feature: Ceres CLONE 1522333
  misc_feature: Translation starting site: 196
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
nnnnnnnnnnnnnnnnnnnnnnnnnnnntttgggggtttnnnnnnnnnnnngggggaggannnaacaaactgagactccccgcggtggcggccgctctagaactagtggatcccccgggctgcaggaattcgtctcacccctagaaaaaatccactctcagcatcaccagctaagaacaggtcttcgtctcaataatggaaggcaaaacagggcagctcaggtgctgtttcgtcgccatcgtgctcgtcctgggtcttgtccttgagcagtcccagcaggctgaagctagaggcaaatggtgctgcgaaaccgccaccggaaaataccattttaatcgctgctttgactccggttgggtcgacaaaattgggtttctgtgcgagtaatgccggttgcatcattatggaggacagatgtggaggttcgttgcccccagtgccggcgggggggggcggctttctcctggatgtccttttggaatccctctcacaaggcaagtaccgtggaaagttaaggaatatctcgggggccggaaggaactggtctatccgagcggatttgggtttatagttcagaaacctggagccaaacggccccccccaaatggcccaacacttgacccaatgacgccccaccagtcgggcggaagccacggggccccctccccctttccataactctagagcccacaatggccgcccgtcaccgggaactccccccccccggaccccaaccagaacacctcgcggacccgccacctacgcgaaaacgggtcgctcctattttccgaccaccaccccaccccccat

SEQ ID NO: 61093 - DNA, 648 bp, Zea mays
  misc_feature: Ceres CLONE 1522335
  misc_feature: Encodes the peptide sequence at SEQ ID NO. 61094
atagctggagctccccgcggtggcggccgctctagaactagtggatcccccgggctgcaggaattcgtctcacccctagaaaaagccttcccagtctcccatccctgaaaacctcacaaaaccctcgctcgctccccaccaccccgccgcgccgccgcctgtaccagctgcgtcaagatgagtcggcaccctgaggtgaagtgggctcagaggatcgacaaggtttacatcactgtacagttacctgacgcaaaggatgctaacgtcaatttggatccagatggtgtcttcacattctctggcagcgctggtacaaacttgcatgaattgaaactagatctgaatgacaaagcaaacgttgaggctagcaaaataagtgtgggggtcaggtccatattctgtatcgtacaaaaagctgaagccaaatggtgcaagaaactcgttcgagatgatcaaagggcacctcactttgtgaaagctgattgggacaaatgggttgatgaacatgatgatggtgctgatatcaacatggatgggatggacttctcgaatttcagaggcatgggtggtatgggccgcatgcgtggcataggtgatatggctgatatgggtggctcttggtggcatgagtaggtatgggggcccttg

SEQ ID NO: 61094 - protein, 151 aa, Zea mays
  misc_feature: Ceres CLONE 1522335
  misc_feature (5)..(79): Pfam Name: CS Pfam Description: CS domain
  misc_feature: SWISSPROT Homolog: EC 5.3.99.3 Prostaglandin-E synthase
MSRHPEVKWAQRIDKVYITVQLPDAKDANVNLDPDGVFTFSGSAGTNLHELKLDLNDKANVEASKISVGVRSIFCIVQKAEAKWCKKLVRDDQRAPHFVKADWDKWVDEHDDGADINMDGMDFSNFRGMGGMGRMRGIGDMADMGGSWWHE

SEQ ID NO: 61095 - DNA, 648 bp, Zea mays
  misc_feature: Ceres CLONE 1522337
  misc_feature: Encodes the peptide sequence at SEQ ID NO. 61096
  misc_feature (371)..(371): n is a, c, t, g, unknown, or other
  misc_feature (391)..(391): n is a, c, t, g, unknown, or other
  misc_feature (401)..(401): n is a, c, t, g, unknown, or other
tggagctccccgcggtggcggccgctctagaactagtggatcccccgggctgcaggaattcgtctcacccctagaaaaaagcaacccgcatccacacctcgcagccgtattcctgtctcgaatcctctctcgccgctccgatggcccgcacgaagcaaacagcaaggaagtcgaccggcggcaaggccccccggaagcagctggccactaaggctgcgcgcaagtcggccccggccaccggcggcgtgaagaagccccaccgcttccgccccggcaccatcgcgctccgcgagatccgcaagtaccagaagagcactgagctgctcatccgcaagctccccttccagcgcctcgtccgcgagatcgcgcangacttcaagactgatctgangttccagttntccgccgtcgcggcgctgcaagaagccggcgaagcgtacctggtgggtctcttcgaagaaccaacctttgcgccatccacggcaagcgcgtcactatcatgccaaagacatccagctcgcgcggcgcatcaggggcgagagggcttgaacgcccgtcgtgctgctcgctcgttgaatggtactagaagtagatggtggctttcgtttcctggctccttatcctggaggaagtatggtctagatgtct

SEQ ID NO: 61096 - protein, 169 aa, Zea mays
  misc_feature: Ceres CLONE 1522337
  misc_feature (58)..(146): Pfam Name: Histone Pfam Description: Core histone H2A/H2B/H3/H4
  misc_feature (77)..(77): Xaa is any aa, unknown, or other
  misc_feature (84)..(84): Xaa is any aa, unknown, or other
  misc_feature (87)..(87): Xaa is any aa, unknown, or other
MARTKQTARKSTGGKAPRKQLATKAARKSAPATGGVKKPHRFRPGTIALREIRKYQKSTELLIRKLPFQRLVREIAXDFKTDLXFQXSAVAALQEAGEAYLVGLFEEPTFAPSTASASLSCQRHPARAAHQGREGLNARRAARSLNGTRSRWWLSFPGSLSWRKYGLDV

SEQ ID NO: 61097 - DNA, 849 bp, Zea mays
  misc_feature: Ceres CLONE 1522338
  misc_feature (35)..(35): n is a, c, t, g, unknown, or other
  misc_feature (38)..(38): n is a, c, t, g, unknown, or other
taatttttcctttcctacatcctcataaaaccaanggngatttcctctaaaaacggatgggggttccacgcggtggcggccgctctagaactagtggatcccccgggctgcaggaattcgtctcacccctagaaaaaatccgagatacctccggtatgcgctcccaatcactgacccctgcgcccccgccgattcaagtcaacctttgtaggaagaaacgatggagcggaccttcttcttgatccctcacgacggagaccagcggagcctgatcagcgacatcatcattggctttcacaacaaaggcgtctgcgtcacggtcgataacgcttacgcaagttgaagagggccgtacgggatcggctcttcgctggacttttctgaacctcgcttatcttccccggcgttgggggagttactttgttttccggcccccttggttggccgatggtttcgtggaaaggtaaaggaccggccattgcttaaagtaggagaggcgtgaaccggctggggaggttaactaatcgccctagggaaagggcaaacgccccccggggaactaatttcccgggattcaccttaacgtatctgcggcgtaacacccctccacgggaaatgggccactccaagtggggaaaccgaatcaccccctcgggtataaaccggctattgaatatggaagaaccggtccctccaagatctccctatgaaacggggagcgggaaatatttggaacaaaaacccagccctcaaaacccctggcaataccaccgaaggtgtttgctacaatattaaatacattgagaatgctatcggcctcttttcctcttggcaccccggacaggtttg

SEQ ID NO: 61098 - DNA, 661 bp, Zea mays
  misc_feature: Ceres CLONE 1522341
  misc_feature: Encodes the peptide sequence at SEQ ID NO. 61099
  misc_feature (143)..(143): n is a, c, t, g, unknown, or other
  misc_feature (144)..(144): n is a, c, t, g, unknown, or other
  misc_feature (442)..(442): n is a, c, t, g, unknown, or other
  misc_feature (603)..(603): n is a, c, t, g, unknown, or other
ggagctcaccgcggtggcggccgctctagaactagtggatcccccgggctgcaggaattcgtctcacccctagaaaaagaccacgctaccaggcactgacgccgtgaactagttagtcatagccccccccccccccaaccccnnttgaaatcccagtctcccaagtcccaaccaaggagccttgtgcccatcccatccgtcgtcgtctggacatgcagggaggtgtgagctgcgtcggcgggcggctgggcctgaccatcgacccggctggcgacggggaggcccccgcggagcgcgtggggcggttggtccgcgagagccccgtggtgatcttcgcctggcgcgggtgctgcatgtgccacgtgatgcggcagctgctggcggccgtgggcgcgcacgcgacggtgatcgagctggaggaaggcgccgaggaggccgcggngtcggccgccgccgccgccgccgtgccggggctgttcgtgggcggcgcgcccgtgggcgggctggacgggcttatggggctccaccttaggggcctcctattcccgcggctccgggaggtgggggggttttggggtttagccggggccggggcgggcgtcntcaatttgctggggggtcggggtttttttgtcgaataccgggttagggtaagggtact

SEQ ID NO: 61099 - protein, 149 aa, Zea mays
  misc_feature: Ceres CLONE 1522341
  misc_feature (38)..(95): Pfam Name: Glutaredoxin Pfam Description: Glutaredoxin
  misc_feature (77)..(77): Xaa is any aa, unknown, or other
  misc_feature (131)..(131): Xaa is any aa, unknown, or other
MQGGVSCVGGRLGLTIDPAGDGEAPAERVGRLVRESPVVIFAWRGCCMCHVMRQLLAAVGAHATVIELEEGAEEAAXSAAAAAAVPGLFVGGAPVGGLDGLMGLHLRGLLFPRLREVGGFWGLAGAGAGVXNLLGGRGFFVEYRVRVRV

SEQ ID NO: 61100 - DNA, 620 bp, Zea mays
  misc_feature: Ceres CLONE 1522342
  misc_feature: Encodes the peptide sequence at SEQ ID NO. 61101
  misc_feature (450)..(450): n is a, c, t, g, unknown, or other
tggcggccgctctagaactagtggatcccccgggctgcaggaattcgtctcacccctagaaaaaacagccctacaacttactgcttgctctagctagctagctgctcccggcccatatccactacacaagtaggctagcagcagcagcagcaatggcctcggtgacgaggttcccggccgtggccctcgtcctgctgctcgccgccagcgccttcctggccagcgaggtggcggcgtgcggcggctgcccgaaaccaactcctcctcctccatcgccaccaccgccgtcgcccaccagcacgccgtgccctccgccaccgtccagctccggcggcaagtgccccaagaacgcgctgaaactgggcgtgtgcgccaacgtgctgggcctcgtcaaggtgtccatcggcaaagtgcccaccgactcgtgctgcccgctgctggacgggctcnccaacctggaggccgccgtctgcctctgcaccgcgctcaaaggcaaagtgctcgggatcaacctcgacgtccccgtcaagctcaccctggtccttcactaatgggggaaggagggtcccctcagggcttcctgtggccctaaaaaaaaccaaaggggctaggttccgccc

SEQ ID NO: 61101 - protein, 132 aa, Zea mays
  misc_feature: Ceres CLONE 1522342
  misc_feature (63)..(132): Pfam Name: Tryp_alpha_amyl Pfam Description: Protease inhibitor/seed storage/LTP family
  misc_feature (100)..(100): Xaa is any aa, unknown, or other
MASVTRFPAVALVLLLAASAFLASEVAACGGCPKPTPPPPSPPPPSPTSTPCPPPPSSSGGKCPKNALKLGVCANVLGLVKVSIGKVPTDSCCPLLDGLXNLEAAVCLCTALKGKVLGINLDVPVKLTLVLH

SEQ ID NO: 61102 - DNA, 643 bp, Zea mays
  misc_feature: Ceres CLONE 1522347
  misc_feature: Encodes the peptide sequence at SEQ ID NO. 61103
  misc_feature (609)..(609): n is a, c, t, g, unknown, or other
tggcggccgctctagaactagtggatcccccgggctgcaggaattcgtctcacccctagaaaaaaggttcgttcagttcaagaccagacgaggaggaagagaggcgcgcaagcggtccggtctcatggcgcccttccccgccctccgctcatcgtcgccggtggccgccgccgcggcgccgtcgctcggtcgcgtgtccggccacgcatctgcggcgcccagcaagaggcgcgtcgtctcctgcagggccgtcagcagcaggtcgctgtccatcatcaggtgcgagcagagcgcgaagaagggcggcgggccggacacatggctgggccgcgcggccatggtcggcttcgcctccgcgatcgccgtcgaggtggccaccggcaagggcttccttcagaacttgggcgtgggtactccggcgccgacgctggcgctggccgtgtcggggctcgtcgtcggcctcgccgtcttcttcctgctgcagtcgggaggaggcacgcgagactgacgactgatggaacccatgagctgagctgagcacgcgtcgaacatcgtctcccactcgacatcagttgctgtgctgtaatgggtggtgaagatgaaaaccangatatatatcatcatcatgtcatgtgtaacaaga

SEQ ID NO: 61103 - protein, 127 aa, Zea mays
  misc_feature: Ceres CLONE 1522347
  misc_feature: SWISSPROT Homolog: EC 4.99.1.1 Ferrochelatase
MAPFPALRSSSPVAAAAAPSLGRVSGHASAAPSKRRVVSCRAVSSRSLSIIRCEQSAKKGGGPDTWLGRAAMVGFASAIAVEVATGKGFLQNLGVGTPAPTLALAVSGLVVGLAVFFLLQSGGGTRD

SEQ ID NO: 61104 - DNA, 769 bp, Zea mays
  misc_feature: Ceres CLONE 1522356
  misc_feature (1)..(1): n is a, c, t, g, unknown, or other
  misc_feature (20)..(20): n is a, c, t, g, unknown, or other
  misc_feature (28)..(28): n is a, c, t, g, unknown, or other
  misc_feature (29)..(29): n is a, c, t, g, unknown, or other
  misc_feature (35)..(35): n is a, c, t, g, unknown, or other
  misc_feature (368)..(368): n is a, c, t, g, unknown, or other
  misc_feature (382)..(382): n is a, c, t, g, unknown, or other
  misc_feature (404)..(404): n is a, c, t, g, unknown, or other
  misc_feature (451)..(451): n is a, c, t, g, unknown, or other
  misc_feature (452)..(452): n is a, c, t, g, unknown, or other
  misc_feature (478)..(478): n is a, c, t, g, unknown, or other
  misc_feature (482)..(482): n is a, c, t, g, unknown, or other
  misc_feature (483)..(483): n is a, c, t, g, unknown, or other
  misc_feature (514)..(514): n is a, c, t, g, unknown, or other
  misc_feature (523)..(523): n is a, c, t, g, unknown, or other
  misc_feature (543)..(543): n is a, c, t, g, unknown, or other
  misc_feature (577)..(577): n is a, c, t, g, unknown, or other
  misc_feature (674)..(674): n is a, c, t, g, unknown, or other
  misc_feature (715)..(715): n is a, c, t, g, unknown, or other
  misc_feature (748)..(748): n is a, c, t, g, unknown, or other
naaaaccgggggggggggcncccccttnntgtggntgggggggggggggggggaagggtggggctccccgcggtggcggccgctctagaactagtggatcccccggggtgcaggaattcgtctcacccctagaaaaaagtgctttcttagaggtgggttggcttctcctccccctcctgttcgggttcgggttcgtgaggttctccgggggtgggtttcgttggtggagggatcgatatggcggggggggatggtgagtagggctgcttcctcgggcggctcgggggggcgacccacgaggggtccctccacaagggcttccgtacgtagggggaggggcgcgtgtggggttttatgttggatcggtnagaaggataggtgngggcggggtggggcttgggcgnccttctcttctttggagggcgatggcgggggggcacccttgaggggnngtgcgggggtggagggggtgggggtncgcnnagggccgcccgtgtggggagggcgccattgncctggtacngcccctggtaggtttactgngggggggaacccagttgtttgttctttgagaggnggatttgttgcttatgttgggcgggcctcacttaatatagagcgagtcatattccctttgttttctttttgcgttgttatgctgcttccaattcggncgtgctcaggatggtggttggttcttgttatgtggcggcgntttcctccttgtaattacatttttatcttatcnccccagaaggatactcgggcg

SEQ ID NO: 61105 - DNA, 766 bp, Zea mays
  misc_feature: Ceres CLONE 1522359
  misc_feature: Encodes the peptide sequence at SEQ ID NO. 61106
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
nnnnnnnnnnnnnnnnnnnnnnnnnnnnnnnnnnnnnnnnnnnnnnnnnnnnnnnnnnnnnnnnnnnngggtaaataaatcaaagctgggactccccgcggtggcggccgctctagaactagtggatcccccgggctgcaggaattcgtctcacccctagaaaaagtctcgctccaaaccaaagccatcggaggagcaactggacgaccatggcctcgccgctgctcaagtcacactctcagctcgccgccgccgccgccctgcactccgtgaggagagccgaccgctgccctgcgacactacacctgggcaagttccatgaccacgggctcaggtccggccgttctaagagatccggttcagcgagggtgggcgccttcccgtcactggacgtggtgccgctgatggtgacgatggtggagcacgtggacatgtcgcgggactacgtcgtgaccaagtccatctggcatctcagcgacgtagccctcaagagcgtctataccttctaacgccatgttcaccgtctggggagtctgcttcttcgcgtccatgaaggatcccttctacgacagcgagacgtacaggagccaaggtggcgacgggaccgtgcactggtactaccacaggcaagaggacctgtaagcgtcttgccaaggaaagaaactgctgccggaaggagcttctccgagggaatattgatgcacaagggtttggggggccctccggggaaacctgggaggaaaacccagcccagggtaggtaacca

SEQ ID NO: 61106 - protein, 99 aa, Zea mays
  misc_feature: Ceres CLONE 1522359
MASPLLKSHSQLAAAAALHSVRRADRCPATLHLGKFHDHGLRSGRSKRSGSARVGAFPSLDVVPLMVTMVEHVDMSRDYVVTKSIWHLSDVALKSVYTF

SEQ ID NO: 61107 - DNA, 638 bp, Zea mays
  misc_feature: Ceres CLONE 1522363
  misc_feature: Translation starting site: 159
  misc_feature: SWISSPROT Homolog: EC 2.7.4.6 Nucleoside-diphosphate kinase
  misc_feature (374)..(374): n is a, c, t, g, unknown, or other
caaagctggagctccccgcggtggcggccgctctagaactagtggatcccccgggctgcaggaattcgtctcacccctagaaaaacctccggtctgcgctcccacagcctcacccctgcgcccccgccgattcgcgtcgccctttgttggaaggaacgatggagcagaccttcatcatgatcaagcccgacggcgtccagcggggcctgatcggggacatcatcagtcgcttcgagaagaaagggttctacctcaaggggatgaagttcatgaacgtggagaggtccttcgcgcagcagcactacgctgacctttccgacaagcctttcttccccgggttggtggagtacatcatttccggccccgtggtgccnaatggtgtgaggtggggaaggacgtcgtgttgactggccgcaggatcattggggccaccaggccttgggtagcagcccccggtaccattcgtggggactacgccgtggaagtcggcaggaatgtcatccatggaagcgactccgtggagaacgggaagatggagatcgctctctggttccctgaaagtgtggcacagtggaagagcaaccttcatccctggatctacgaggcttgagcagttgaccttggatgccttggccgct

SEQ ID NO: 61108 - DNA, 676 bp, Zea mays
  misc_feature: Ceres CLONE 1522365
  misc_feature: Encodes the peptide sequence at SEQ ID NO. 61109
ttgcggccgctctagaactagtggatcccccgggctgcaggaattcgtctcacccctagaaaaaaccagcctcattgcctcaaccccaaaccaatccgtcgcagacactcaaggtcgcaggatgccgccgccgcgtgagcaccaccagccccaggacgaagaggacgacgataccgcatgcgttgtcaagctcatcagcgccgagggcttcgaattcgttgttgacaggaaggccgccatggtctccaacaccctccgcaacatgctcacatccccaggcggcttctctgagacgcgccagggtcgaggtccgctttcccagagatccccaccaacatccctctagaacatctgccggggtggggggggggggccctccattactcccgtggggaaggagacagccggagttttccaatcgaaacgggagataaccctgggaggtttatgaatggcccgcaaactcttcttgggacactttgaagaaggggcccttggggggggattaatccttaggtttgcgtcttgaatagggaaagaaccgagagcggttgtagtacctgtggggattcttttcccctcccatcccatttcctttttccctttttcgggttgtgttttgtggggcgtcacatggagggttgccccccgtatcccctgtggagtaaatggtttg

SEQ ID NO: 61109 - protein, 74 aa, Zea mays
  misc_feature: Ceres CLONE 1522365
MPPPREHHQPQDEEDDDTACVVKLISAEGFEFVVDRKAAMVSNTLRNMLTSPGGFSETRQGRGPLSQRSPPTSL

SEQ ID NO: 61110 - DNA, 642 bp, Zea mays
  misc_feature: Ceres CLONE 1522373
  misc_feature: Encodes the peptide sequence at SEQ ID NO. 61111
tggagctccccgcggtggcggccgctctagaactagtggatcccccgggctgcaggaattcgtctcacccctagaaaaaagggcgaggcaacctccgcgccactcgccagctgcccagtcgtctcccacgtcctatgacaacacactacagctagcagaggtatctgccatccaccatggccgtctccatcgccggcaggagcatccgcctccacgttgccccgcccagtcgccgccgcgtcagcgtggtctccgccgccgccgcggcccggctcgaccggcgctcggcggccctgctcctgctgtcctcggcggttccagcaagatccgcagcgacagctcccccagcgagcgccgcgggcatcggtctcttcggcatccgcaagaagctggagcgcgcgcaagaggcggcagccgacgcagtgaagaaagtggaggatgcggtggacgatgcctgcgcggaggccgcacccgtgggccgaagaacccgggaaagaaagcggcatgcaatgaccctgcagataggggaatgatgccgccatattagttcgcggcaggccgtgaaggggggcggtgacggatgccaaaaaaggaaagtcccagccaagggcctgcaacctggtggccgtggccagaaacccc

SEQ ID NO: 61111 - protein, 118 aa, Zea mays
  misc_feature: Ceres CLONE 1522373
MAVSIAGRSIRLHVAPPSRRRVSVVSAAAAARLDRRSAALLLLSSAVPARSAATAPPASAAGIGLFGIRKKLERAQEAAADAVKKVEDAVDDACAEAAPVGRRTRERKRHAMTLQIGE

SEQ ID NO: 61112 - DNA, 827 bp, Zea mays
  misc_feature: Ceres CLONE 1522375
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (40)..(40): n is a, c, t, g, unknown, or other
  misc_feature (41)..(41): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (486)..(486): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (501)..(501): n is a, c, t, g, unknown, or other
  misc_feature (502)..(502): n is a, c, t, g, unknown, or other
gggggnnnnaaccgcttggggattccccataaatataaannggatttacnnnaaaaaaattgggactcaccgcggtggcggccgctctatactagtggatcccccgggctgcaggaattcctctcacccctagaaaaagatccgagcgtgcatatcgcggaatcccagcggctcatagtccagggggagggagctcgcggagactgaggacggcgttcgcccccgtcgcgtatttcctcgacaaagagatggggcctctcctttcgggaaacgtgttccacccttcctctttcgcccaaagcaaaggaaaaattggaccgaattcccctccatgggccctggcgcttttctcccttttccctattcctgagactatagaatatccccctccctgttcatttcctcgtataatggcacctctccccccatgaagcccccccccgtgccgcatacgaaacgccttgcccccctctcattnnnccctgnggnnnnnnnnaactnntattcacccccctaaaagtgggtgtttattctctgcgggcttaaccatccattcttggttggttagtttatatataaaaaatgagtggtagttttttgggggggctctcccccccccacattgccgcctcgcttgactgctctgctttttcatgcacccaaccccccgcgcccttcttcctcatctcggagcgggggtaaatccccacccgccttctctttttcagagtccgtccgttttctcccgcgattaccccagtagcattctctttcctgttcaactcggcggctcgcaatactggattccttcatttctccactctatc

SEQ ID NO: 61113 - DNA, 630 bp, Zea mays
  misc_feature: Ceres CLONE 1522380
  misc_feature: Encodes the peptide sequence at SEQ ID NO. 61114
  misc_feature (94)..(94): n is a, c, t, g, unknown, or other
  misc_feature (440)..(440): n is a, c, t, g, unknown, or other
  misc_feature (471)..(471): n is a, c, t, g, unknown, or other
  misc_feature (472)..(472): n is a, c, t, g, unknown, or other
  misc_feature (630)..(630): n is a, c, t, g, unknown, or other
accgcggtggcggccgctctagaactagtggatcccccgggctgcaggaattcgtctcacccctagaaaaaatctccactcgctagcactattncatagcccgtctctttcttttctgcttccagacattgtccacgagctggtgcactggtgtcgctcgcaaaccaaattaaggactgagccatgggatccaagggcgtcctcttcttggctctcaacctcctgttcttcacagtgagccaaacggctgcggcagatgctcgacccccaacgccccccgggtcgagccagccgcccgccgccctcctgggtaccccaaccgcccttcaatctaccaagttgggaaaagtgccacgccttgaaaaccgctcaaattcccgaggggggcccttaaaggccttcggcctccggtcaaaaagggaaagccctggaaaaaaggnaccatacttgaaaaccaatgggttgcaaaanntcttcacattaaaaaaggccctttgggcaaaaatttttcaaagagccccgccccttttggcccatattgcacaaggggattattaaaaaagggggggagaaacgctcttcccacaggggggaacaacccctcccaaaaagagcccccccacaaaaaan

SEQ ID NO: 61114 - protein, 124 aa, Zea mays
  misc_feature: Ceres CLONE 1522380
  misc_feature (86)..(86): Xaa is any aa, unknown, or other
  misc_feature (96)..(96): Xaa is any aa, unknown, or other
  misc_feature (97)..(97): Xaa is any aa, unknown, or other
MGSKGVLFLALNLLFFTVSQTAAADARPPTPPGSSQPPAALLGTPTALQSTKLGKVPRLENRSNSRGGPLKAFGLRSKRESPGKKXPYLKTNGLQXXFTLKKALWAKIFQRAPPLLAHIAQGDY

SEQ ID NO: 61115 - DNA, 678 bp, Zea mays
  misc_feature: Ceres CLONE 1522382
  misc_feature (382)..(382): n is a, c, t, g, unknown, or other
tcaccgcggtggcggccgctctagaactagtggatcccccgggctgcaggaattcgtctcacccctagaaaaatccctccttcaccatcagcaaatcggtctgccctggtttcccccgtcgtgaagcagaaacctctctgctgccattaccgtgctgcgcgccgtcgcggtgaggcttggccacaaccgtggaactgtctccatatggcgtaggcggcgtaccgagcttcgcctgatggatttgcagtccagtgggcccataatttctcgccggaccgcgagcagcaacaaccctctcctcgccggccatgacctctacgcactccaagctctcctccgaggaccgtcttcttcccccctgtaggcggaggggggcacaatnatcttaaaaacccccctgctttctggaatttcaagtgctaaggaaaaaaccagggggttccggaagaccccccttacacctgaggagttcgatttgatctaagggggtgtttccctcgtcccaatttggcggcccacaaaccttaaaacaagttataagttaaatccttttattttgggaataaaatctgtgcccctcgcgaaaaaggagcccccgcaatttgttaaagaaggtttattgtcctgttgcctctcctgtgggttggtggtagagggagattagactagcgaccgcgg

SEQ ID NO: 61116 - DNA, 645 bp, Zea mays
  misc_feature: Ceres CLONE 1522389
  misc_feature: Encodes the peptide sequence at SEQ ID NO. 61117
  misc_feature (504)..(504): n is a, c, t, g, unknown, or other
aagctggagctccccgcggtggcggccgctctagaactagtggatcccccgggctgcaggaattcgtctcacccctagaaaaagtagctccggggcttttgagtaaaagcctcgcaatagaggccataataaataagggcgacacgccatccccaccgaaccctacccgcgacttcgctccgcttccgccgatcggcttgccccgtcgatttcgccaacccctcgacccgatcgactccattgatcgtacctcgtcgtccggttgtcgatggccaggacatctttcaaaatggagcacgacctcgagaaaaggcagtccgaatctgccaggatcagggataagtatcccgacagaattcctgtgattgttgagaaagctggcaaaactgatgtccccgagattgataagaagaagtaccttgtccctgctgatctcactgtcggccagtttgtctatgtggtgaggaagagatcaagctgagcccagagaaaggcatctttgtncttgtgaagaacaccttgccaccaactgcctctttgatgtctgcaatctacgaagaaacaaggacgaagatggcttcctttacatgacctacggggggaaaaacccttcggctctgcctaaagaatcgcccctggcactga

SEQ ID NO: 61117 - protein, 70 aa, Zea mays
  misc_feature: Ceres CLONE 1522389
  misc_feature (14)..(70): Pfam Name: MAP1_LC3 Pfam Description: Microtubule associated protein 1A/1B, light chain 3
MARTSFKMEHDLEKRQSESARIRDKYPDRIPVIVEKAGKTDVPEIDKKKYLVPADLTVGQFVYVVRKRSS

SEQ ID NO: 61118 - DNA, 700 bp, Zea mays
  misc_feature: Ceres CLONE 1522390
  misc_feature: Encodes the peptide sequence at SEQ ID NO. 61119
  misc_feature (405)..(405): n is a, c, t, g, unknown, or other
  misc_feature (451)..(451): n is a, c, t, g, unknown, or other
cgcggtggcggccgctctagaactagtggatcccccgggctgcaggaattcgtctcacccctagaaaaaatgcaggttcctaacccccacccacctcgcccaaattgcaaccttccccgagtgctccaggtcccgtggccggcccccagatcctctccaatcccaatccaagtatcgaacggatcccatcggtggcgctcgagcgagcgagtgcggccggaaccgagcgaagatgggcatctcgagcatgccagcgcccgaggacagcctgctggggttcgtgctgtacaacacggcggcgtcggtggcgatcctggcggggctggtgcgcgccgcgctgctgttcctgagcctggcggcggcggaggacgaggagccgcggctgctggcggacgccctgacggncacggccgtggggcccagcctcgcggaacggtttccggagcaggtnccgggccgtcgcgctacgggcggcgcccgggggggggactggcccccgtgggcccggggggcggtttcaggacccgattccggggggggagcgggctccccctgggggcaccctttttcccaccggggcccggccttccagaaacctgggatctgaattaaaaaaccaccccccaccctggccccgcttgtggccagcccaccggcccttcactggcccatcccctgcccgatttgacacgcacaaaaa

SEQ ID NO: 61119 - protein, 124 aa, Zea mays
  misc_feature: Ceres CLONE 1522390
  misc_feature (58)..(58): Xaa is any aa, unknown, or other
MGISSMPAPEDSLLGFVLYNTAASVAILAGLVRAALLFLSLAAAEDEEPRLLADALTXTAVGPSLAERFPEQVPGRRATGGARGGDWPPWARGAVSGPDSGGGAGSPWGHPFSHRGPAFQKPGI

SEQ ID NO: 61120 - DNA, 620 bp, Zea mays
  misc_feature: Ceres CLONE 1522392
  misc_feature: Encodes the peptide sequence at SEQ ID NO. 61121
ctccccgcggtggcggccgctctagaactagtggatcccccgggctgcaggaattcgtctcacccctagaaaaaatcgtacgtttcggcggccattctggtgtccatggagcgaggcaatccccgcctcgccatcatcgacgtcaaggatgaggagaggagctaccaggctcacatcgggggttcgcaccacttcgccagcagcagcttcaaggcgcggatgccggagctggtgcgggccgccagcggcaaggacaccctcgtgttcctctgcgcgctgagccagggacgaggtccaacttgcgctcggatgttctcagactatctatcggagaccaaggaggatccagggaataaagaacatcatgacttctgggagcgcggcatttttaccggaaggggaaaagatttcaaaggggaaaaccctgttctggtccccattaaaaccccgaacccccctctttttaaaaaaaggggggcacggtgttttttttttttccccccccacgaaaaaatattattttttttttcccccaccaaaaaaggacctccccctcttttttacaccccccacaaaaagggagagtataaacaaaagataaaaaaaaaacccaccccccg

SEQ ID NO: 61121 - protein, 171 aa, Zea mays
  misc_feature: Ceres CLONE 1522392
  misc_feature: SWISSPROT Homolog: EC 3.1.3.48 Protein-tyrosine-phosphatase
MERGNPRLAIIDVKDEERSYQAHIGGSHHFASSSFKARMPELVRAASGKDTLVFLCALSQGRGPTCARMFSDYLSETKEDPGNKEHHDFWERGIFTGRGKDFKGENPVLVPIKTPNPPLFKKRGARCFFFFPPHEKILFFFSPTKKGPPPLFYTPHKKGEYKQKIKKKPTP

SEQ ID NO: 61122 - DNA, 509 bp, Zea mays
  misc_feature: Ceres CLONE 1522394
tccccgcggtggcggccgctctagaactagtggatcccccgggctgcaggaattcgtctcacccctagaaaaaccctctatctacccaccgttcccgtctctccgccgcttccttggaagacgaagaaccctcctccaccaccaacccgatccagctacatccgttgaggccgtgcgttcttccctgttctccatcaatcgacctagccttacgccgaccaggggcttcctctatcgatctggtgtctgtctgtggtatggtctgggtgcatccagggcaagagcaactagccgtcttgtttgatccgtcccaccccccacggggtttcaatttccggaaagaaactgatgggcaaaacaaattctttaaacttggagcccccccccagaaaaaggaacctaggggttaccccttccaaaaaaaaaccccggacaaaattccctgttttttttaaaaagggtaaaaaaagtgtttttttcccgacccccccaaaaaaaaaacccccccc

SEQ ID NO: 61123 - DNA, 646 bp, Zea mays
  misc_feature: Ceres CLONE 1522397
  misc_feature: Encodes the peptide sequence at SEQ ID NO. 61124
tggcggccgctctagaactagtggatcccccgggctgcaggaattcgtctcacccctagaaaaactgtccctgtctactatccagcgaaaccatcctgcttgcacgcaagccactccgaggccaagtctagggtttgggaatctgtaggaggggagaggggagcgcgctcagggtcagggaggcgaagatgatcgaggtggtgctgaacgaccgcctggggaagaaggtgcgggtgaagtgcaacgaggacgacaccatcggcgacctcaagaagctggtggcggcgcagacggggacgcgccccgagaagatccgcatccagaagtggtacaacatctacaaggaccacatcacgctcaaggactacgagatccccgacgggatggggctcgagctctactacaactaggcgccctgaccccaaccgtgccctgatggaaggttaatccgaattctgaagtcatgggtgcgcttccaggcgcagcgtcttttggctaaaaggctcgcatacctctgggcaactttgagtggagctttggtgtaaccggatatgggttggtgtgggcaaaccggcccaggggacaattgggccatcctttgcattttttttgggccttggtgaccaggggattccagccctcccca

SEQ ID NO: 61124 - protein, 73 aa, Zea mays
  misc_feature: Ceres CLONE 1522397
MIEVVLNDRLGKKVRVKCNEDDTIGDLKKLVAAQTGTRPEKIRIQKWYNIYKDHITLKDYEIPDGMGLELYYN

SEQ ID NO: 61125 - DNA, 629 bp, Zea mays
  misc_feature: Ceres CLONE 1522402
  misc_feature (187)..(187): n is a, c, t, g, unknown, or other
  misc_feature (194)..(194): n is a, c, t, g, unknown, or other
  misc_feature (196)..(196): n is a, c, t, g, unknown, or other
  misc_feature (197)..(197): n is a, c, t, g, unknown, or other
  misc_feature (212)..(212): n is a, c, t, g, unknown, or other
  misc_feature (273)..(273): n is a, c, t, g, unknown, or other
  misc_feature (274)..(274): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (577)..(577): n is a, c, t, g, unknown, or other
  misc_feature (579)..(579): n is a, c, t, g, unknown, or other
  misc_feature (580)..(580): n is a, c, t, g, unknown, or other
  misc_feature (582)..(582): n is a, c, t, g, unknown, or other
  misc_feature (599)..(599): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
cttgaactagtggatcccccgggctgcaggaattcgtctcacccctagaaaaagagccacggagagcaaaggcagcacactcagctatccagcaaaagagatcgagaggcaggagtcatggccaccgtcagcgccgccgtggtgaccaccatcgttgcccgcgccgcgatcgccaggcccaatgctncttaggngnnctgggcctgggcgcntgaagggcgaggaagcgagagggtgcggtgcagctacgccaaaggaacgccggcccccccnnttcacaccaaaggggcaggggcgtctttttttccccaaaggggggggggggacccccttctggggggggcccccccctttggggctctttggggaaaaaaaaaaatttttttttcctcagggaggggggcccggggggggtaaaacctccttttttaaaaaaaaaaaggggggggggggggggggggaatctcccccccggggggggggggtttgttttcccctcccccccccccaaccccaacannnnnnnnnnnnnnnnnnnnnnnnnnnagggagggtagccaggcgcnnnnnccccttncnncncccccccggggtgtttntcnnntttaaaaaaaagagaaagaaagggg

SEQ ID NO: 61126 - DNA, 624 bp, Zea mays
  misc_feature: Ceres CLONE 1522403
  misc_feature: Encodes the peptide sequence at SEQ ID NO. 61127
  misc_feature (94)..(94): n is a, c, t, g, unknown, or other
  misc_feature (103)..(103): n is a, c, t, g, unknown, or other
  misc_feature (240)..(240): n is a, c, t, g, unknown, or other
tagctggagctccccgcggtggcggccgctctagaactagtggatcccccgggctgcaggaattcgtctcacccctagaaaaagccacacgttngtaaacacnctcacattggaagctggactccgcccccgtgatgatcttcgccttgactttctccgccggagaccccgccgcctcagctcctccatttccattcaaaggaaaatccttggatgggattttgtgggctattggtctcntccgcacgagtgctattgtaggaatattttacttcattggatttggaatgttctgccttgaatcactgatcaccatcgttgtcattcaggaggtatacatgtacttccgtggaagtggaaaacctgtccagatgaagcgagaggcggcccgtggtgctatgagcaacgccttttgatagagcgatctatgcgactggacgagacacggtgtgacaatgggaaactacgttatgtacatatgctgctcgtctctgagactacttctactagcttatgagcatcttgccttcgtgcactgtataccacctacccacggagctctgatctcttaccgaggttcagatgcgccttaaagcggaactaggttcttcttatacatttccc

SEQ ID NO: 61127 - protein, 93 aa, Zea mays
  misc_feature: Ceres CLONE 1522403
  misc_feature (1)..(75): Pfam Name: SCAMP Pfam Description: SCAMP family
  misc_feature (36)..(36): Xaa is any aa, unknown, or other
MIFALTFSAGDPAASAPPFPFKGKSLDGILWAIGLXRTSAIVGIFYFIGFGMFCLESLITIVVIQEVYMYFRGSGKPVQMKREAARGAMSNAF

SEQ ID NO: 61128 - DNA, 705 bp, Zea mays
  misc_feature: Ceres CLONE 1522404
  misc_feature: Encodes the peptide sequence at SEQ ID NO. 61129
cgcggtggcggccgctctagaactagtggatcccccgggctgcaggaattcgtctcacccctagaaaaaaagtccgcgcgcgctctgtgctccccctcagtcctcgctggtcctttctccatcgcaaacgctagtattttcctaaagctcggacaccgccggatgcgattgatggtgtgcaagactaagagcctgctgttggcgctgatagtggcggcactgctggcggcgcggtcggagtcccactgcctgggggacttcacaagcggaaacgactaggcgacgacgacgccagagatgccaaaccttcggcaaccccctcggcccccgcggatcctcccggaggccctccaaggcctccatactccgcccagccgggaggcccacgggcgctccccggtcaccctccaaaggacgttcgctctcccacagggtgatgtggaaggggcccggcccgcccaccccccccggaggggctctcgttctcgtggccccccctggcgctgaaccaagccaacgggtgtgcggattttgggttctgggggggcggggttccccagaaccccctctgtgtgtcaaaacggagaaagggagccccggccttctttgggtgaacgtgttaccgaaagggttaggtgttctctcggtgtttaaagggggcccccctcgctgtgaaggcgggcggtaaccagaagaaagagaagc

SEQ ID NO: 61129 - protein, 35 aa, Zea mays
  misc_feature: Ceres CLONE 1522404
MVCKTKSLLLALIVAALLAARSESHCLGDFTSGND

SEQ ID NO: 61130 - DNA, 644 bp, Zea mays
  misc_feature: Ceres CLONE 1522405
  misc_feature: Encodes the peptide sequence at SEQ ID NO. 61131
  misc_feature (644)..(644): n is a, c, t, g, unknown, or other
ggagctccccgcggtggcggccgctctagaactagtggatcccccgggctgcaggaattcgtctcacccctagaaaaagtgagccgcccatttgcgccgccgcagcccgcagtcgcttgcgcgcagcagcacttcgcaccgccgccccatcccatcgccgccagtgtctgctcgatccgatggctcccacgaagaagtcgaagaagagcacagagagcatcaacaacaagctgcagctggtgatgaagagcggcaagtacaccctgggctacaagaccgtcctcaagacgctgcgcaactccaagggaaagctgatcatcatcgcaaacaactgccctccacttaggaagtctgagattgagtactacgccatgctggccaaagttagcgtgcaccatttccacggaaacaatgttgatcttggcactgcctgcggccagtactacagggtgtgctgcctcagtatcatcgacccaggtgactcggacatcatcagtaccacccctggcacccagtgagccagccccgggaacccatgcagctgcttcgcttttcccaaaatgaaatgaaatgtaacgcctccgggccctagggcccggttccttttttttaaacccttaaaaccaagggaaatttttggcccn

SEQ ID NO: 61131 - protein, 112 aa, Zea mays
  misc_feature: Ceres CLONE 1522405
  misc_feature (12)..(106): Pfam Name: Ribosomal_L7Ae Pfam Description: Ribosomal protein L7Ae/L30e/S12e/Gadd45 family
MAPTKKSKKSTESINNKLQLVMKSGKYTLGYKTVLKTLRNSKGKLIIIANNCPPLRKSEIEYYAMLAKVSVHHFHGNNVDLGTACGQYYRVCCLSIIDPGDSDIISTTPGTQ

SEQ ID NO: 61132 - DNA, 641 bp, Zea mays
  misc_feature: Ceres CLONE 1522406
  misc_feature: Encodes the peptide sequence at SEQ ID NO. 61133
ccgcggtggcggccgctctagaactagtggatcccccgggctgcaggaattcgtctcacccctagaaaaaagcctccgcccatacacacacagccccatcccgccgccgcaggcgagaaccagcgccaccttaggttagggcggccgccgccggagaagtgcgcggttgccaagatgcagatcttcgtgaagaccctgacggggaagaccatcacgctggaggtggagtcctcggacaccatcgacaacgtgaaggccaagatccaggacaaggagggcatcccgccggaccagcagcgcctcatcttcgccggcaagcagctcgaggatggccgcaccctcgccgactacaacatccagaaggagtcgacgctgcacctggtgctccgcctcaggggaggcgccaagaagcgcaagaagaagacgtacaccaagcccaagaagatcaagcacaagcacaagaaggtgaagctcgccgtgctccagttctacaaggttgacgacgccaccggcaaggtcacccgcctccgcaaggagtgccccaacgccgagtgcggcgcgggggtcttcatggccaaccacttcgaccgccactactgcggtaagtgtggcctcacctacgtctacaaccagcaggcgta

SEQ ID NO: 61133 - protein, 155 aa, Zea mays
  misc_feature: Ceres CLONE 1522406
  misc_feature (6)..(74): Pfam Name: ubiquitin Pfam Description: Ubiquitin family
  misc_feature (101)..(148): Pfam Name: Ribosomal_S27 Pfam Description: Ribosomal protein S27a
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKVDDATGKVTRLRKECPNAECGAGVFMANHFDRHYCGKCGLTYVYNQQA

SEQ ID NO: 61134 - DNA, 647 bp, Zea mays
  misc_feature: Ceres CLONE 1522407
  misc_feature: Encodes the peptide sequence at SEQ ID NO. 61135
tccccgcggtggcggccgctctagaactagtggatcccccgggctgcaggaattcgtctcacccctagaaaaactccacccgtcgccgcttcctcccgttagactaggttaggctaggctagggtgtcgaccagctcgcggtaatggtggccttcaggttccatcagtaccaggtggtggggcgcgcgctgccgacgcccggcgactagcaccccaagatctaccgcatgaagctctgggccaccaacgaagtccgcgccaagagcaagttctggtacttcctgaggaagttgaagaaggttaagaagagcaacggtcaggtcctggccatcaacgagatcttcgagcgtaacccgacgacgatcaagaactgtggcgtctggctgcgctaccagagcagaaccggctaccacaacatgtacaaggagtaccgcgacacaaccctgaacggcgctgtagagcagatgtacaatgagatggcttctcgccaccgcgtgaggtccccctgcatccagatcatcaggaccgccccagtacactccaagctgtgcaagagggacaacaccaggccgtttcacaaccgtgaaatcaagttccccctcagggaccgcaaggtccggccccccaccggcaaattgaacaccacg

SEQ ID NO: 61135 - protein, 140 aa, Zea mays
  misc_feature: Ceres CLONE 1522407
  misc_feature (1)..(140): Pfam Name: Ribosomal_L18ae Pfam Description: Ribosomal L18ae protein family
MKLWATNEVRAKSKFWYFLRKLKKVKKSNGQVLAINEIFERNPTTIKNCGVWLRYQSRTGYHNMYKEYRDTTLNGAVEQMYNEMASRHRVRSPCIQIIRTAPVHSKLCKRDNTRPFHNREIKFPLRDRKVRPPTGKLNTT
